United States Patent 8,067,671 (METHODS FOR GENETIC CONTROL OF PLANT PEST INFESTATION AND COMPOSITIONS THEREOF) - sequence listing, part 22

SEQ ID NO: 26690 - DNA, 1694 bp, Heterodera glycines
taactattttggcagtttttagcagtaaagtgattaaaatttaataattttaattctgctaatagaataaatttgaaattattatcttttaaattatcaaattaattataattaattgattttattccttcgaattttataatttttatttttcgttattatttattttttgcttaatttacttcaaattagcataaataataaatatctgcggatttatttcgttttcaccaaagagttccatcaatagcagatcaataagcaagcattctttcgcccattatacaacaaaatgtgattggatttgatgtataaattattggttagccgacttttgcgtaccattattatttttggattaaactgccaaaagaaaataagctaaaatttttcaaatattatgtaaaccaaatatattttttctatgtgttttttctgagttaagcattcgtctgaccataacttttttgaaattttacgaaatttttcgaaattatgcaggttaatagaggacacttaaggctatcgaatgaactcaataatcagatgaataagcaagcattcatactttcgcccattatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccattttattttttggcacaaataaataattaaatattggtaagcaattgatttcatcaaaatttcacagaatttaatttttgcgcctcggaataaatttttaattttttttttgttcgcttcattatttttggttttttaataaaaaaaaattttatgctggtaaaattcgaaaaataaaatatggttgcctttcttttttaaatttaccaaataattgtttatttatttttaatcctactgaagatcaatttcattattggtcgcattttttgacaacgatttcacattttcataagaattcaaataaaattattttctaattaatatattaatttagcttaattttgttactttttggataaaattttacgatttacatccctctaaatttgaaactatttggcacctcttttcccatttttagcacctattttggagttttttagaacctaaaaactaactattttggcagtttttagcagtaaagtgattaaaagggaaggggatttatccctttcaagagatatccatgaaacggataaaggcgggtattgcaaaaaagtgcaaaaattcccttgggagggggggttgctgtaaccccccgaaaactcccggagagccgagattgaggctgttcagctgacctgcgagagaaccatgctcctccctcgcacccccagagtcagttattaggccgatcactggtaactgtttgctacttgcccatcgggctttcgacaggaggctactccgcctagggggctcgaacttaccctcgggccatgccaccgaggagggttcaccacttcgccaccaaccaagtgaaatgactatcacatttctgaccctagtgagatcactttactcttctctcaatttcacttgatat

SEQ ID NO: 26691 - DNA, 1813 bp, Heterodera glycines
  misc_feature (168)..(168): n is a, c, g, or t
  misc_feature (1689)..(1689): n is a, c, g, or t
  misc_feature (1693)..(1694): n is a, c, g, or t
  misc_feature (1710)..(1710): n is a, c, g, or t
  misc_feature (1712)..(1714): n is a, c, g, or t
  misc_feature (1718)..(1719): n is a, c, g, or t
  misc_feature (1723)..(1723): n is a, c, g, or t
  misc_feature (1737)..(1738): n is a, c, g, or t
  misc_feature (1741)..(1741): n is a, c, g, or t
  misc_feature (1745)..(1749): n is a, c, g, or t
  misc_feature (1752)..(1752): n is a, c, g, or t
  misc_feature (1759)..(1760): n is a, c, g, or t
  misc_feature (1763)..(1763): n is a, c, g, or t
agtgtgtaacaactcacctgccgaatcaactagccctgaaaatggatggcgctggagcgggccacctatactccacgtccattggcttgtacacgtgcttgtcgcgtagtctgcccatgacgtgtaggagggtcgtggtggttgcgttgaaggctttgggcgtgggcncggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaaccccccccccccccccccgcccttcagagcacgacaaatatttcaacaaaaatttttaaaaattgactagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtnctcnnccatttatggggagcntnnntccnncgcngccttaaaagaggnnctnttgnnnnnctnttcccgnnggnttcgcctatgaacgtaaatctgggcgcatcggttcggggggactgccccg

SEQ ID NO: 26692 - DNA, 1060 bp, Heterodera glycines
tttttttgttttcggggcattccccccgaccgaatgcgcccagatttatggggaggccgaatctttcggggaatagtttccctatagacttgtactttaatttttgcgttggattttttgctccccattaattgtttgagtaccccaaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcatgttgcttttggtggggtgcttggaacagtggaatcattagaagccgtccgatctggcaagttaagcaacgattgctga

SEQ ID NO: 26693 - DNA, 1549 bp, Heterodera glycines
  misc_feature (1512)..(1512): n is a, c, g, or t
  misc_feature (1520)..(1520): n is a, c, g, or t
agtccagtacattcgaaagcattcgaaacctgaccccattgcatgcttgagtatatggcaagagctatgtgttttgagggaccgtgaggcggacgaaatgcacctttatcgtgggcatgagcaaaaaattgttaagaaatttttggccaacgcaaacagaccaatgtttgactatatgaccgagcgtttatacatatctgataagtacgaacgtcagatcagtgaaattgaactaagctatctcgagcggttgtggacaaataagaatccgacaaattttacgttgctaaagctgaattttgtatgcatgttaccacaggataaaactgatttcataataatagataacaaggtgtatctgattcgatcggaccgtcgtatttacaaatatggaattaatgacggtcaaatcaacccaaaatttgtgtccaacatcagtgacactaaatttaactttttattatttaaagaatatcgcgacgatgtaattaatatacttcaagccagctcgccaacgcctcaaatcaaattattgttatggtctgcttatacatttgacgtactgctggtcgtcatttgcgcatatgtaataagacaaattcgtcgtaccagcagaagcagtaaaacttcatccgaagatgttggcatgtttgaccaaatggaactggaaatgttttcggataatccgaaagatttagtgtacaggccaacaacggtcagagagaggagtatttaaggcgactattctatccatttgacttcattcttacacaaaccgtatatgcagcgagcaataaaatattttattgactattatgcgctaaatgatataactcagctgtacgctctcctaaaatccgaaatagactctgaaccgtccaactattatccaaatcctttgcaatcagttccttgtgtacaccttgtgaacgaagagtacgaaaatcagcctgttgttgtagaaggaacacttgatctgataggcgatctgttcttttcaacatgttatcccaagaagagacaggggatcgattggtaaaaattttaattattatttaaatgttgatttaattctttttatttattcaggagcgaacctctgtatgcggaattgaaggatctgatggtttgtccgggcgatttgcggaaatgtctgtcacacttcggacatcggaaggatcagcgcaacttggtcgtcgacgagctggattggcacgacgacgacgacgacgacataacagaaggagcttggtgaaagagctatgcttgtttaataaatgtagaccggaatatctcgcgatgatgcttcgaagaaggaagaaggaaaatatcaaatttataggcgatcggaaaatcgaaactgtacatcttcgacagaatttacaaatttatccggaatcatttactctttttggtgctaatcgtatgtacgcctatcgtggtatgcttggtgtcacggtagagcaacatttatacgctaaccatcgtgtccgtctaaaatttcccacctcncatgtgtntgtacagatggcggcacggccatcaaagt

SEQ ID NO: 26694 - DNA, 928 bp, Heterodera glycines
  misc_feature (36)..(36): n is a, c, g, or t
aagtcgaaattttgaaattttttctcaataactttnttccaattccaaaaacattttttttttgctttttgtaaggctaatgaagcatgtgaagagatttcaaatgataccaactatgttagatttggatatagtccaaaaacctgctggggcccaaacgtgccggcccaactgctgagcgagtccgttggggtgggagcgttaaataataagggacgccaaaacaaattactttgaaaattttacgagaaatccattgtttgaatttcttttcgcgtttttctgcttgagaagaaataaatttcatggaaaggactcgaactttcacacatttgcataaaaacactgagccattaatataattaaaccgatatttaagcaaaaaagttttttaaacttttttttattaaaaaatgacataaactggtggaaaaaagtctttactcaagccgatcaaagttgaaaaaattaaaatttcgactagaaaatttaattgattatttttttgtttatgtgtttttatttactcctatttatgtgctttttatgcaccacataattattttgatccactcattcattctgagcatgagtcgtttgatcactctttactcaaaaaaatggcggaaaaaagtctttactccgaacatgaaaaaccaccttaaaattcatttaaaaacctgaaataattcatgctagctgacttttaatatacaaaatcccatcctgcgcgaggtgcagccattagtgtaaagaaaatgtggggagagatggcaaaccgaacgcaaatacaataaatggcatggctttggttcaataattgtgaagttggcagagacgcagagggtcagttcgacagagacgcagagaatttgagctccgcggggcgcataaaaattggcaaaattaacaatctcggcgggtggga

SEQ ID NO: 26695 - DNA, 827 bp, Heterodera glycines
taggcgagatgtccagtaggcaaaatgtcagtaggcgaaatgtccgattttggcttagtaggcgaaacgtccgattttggcttagtaggcaaaatgtccagtaggcgaaatgtcatacagccgatgcaattatttaaagtaatcattttagcaaagcaaaaattcgcctatttgcttttgatttgtgatcaaactcatagcttttcattcggttggactgcattttgcataaaattgcttattgttttgtttttcatttttattttatcttttattttattcgaatttatttgggcattttttaattgtgagttgtaaaatcacaggagtcgggatccagacaaggcccgaaaaaaattcgggaaagggaaatgatctgatgacagttcaagaaccgctttgcttttttacatacagaaagtttttaaatctcttatttttccaaacttatgcctatccaatgaaaaaaaacccattaaaattttaatttttgttgaaaatgagaatttcgaaactgacatttaggtgctgggtattttcttatatcggccaagggcttctctttggattttccttttttattttatgtttttaacttttttattaagcatgtgtctgaaaaaaaatccaactaaatttaagacgagttaaaattaagtgattttttctctttcaatcactttttcaacagtttacgaaaattgtgacaatttgttaatgaaataatataacaaagaagcataaaaaatctattctttttgtataaatgaattttatataataatattttgtattctacataataaattcaactgacaaagctttgt

SEQ ID NO: 26696 - DNA, 1200 bp, Heterodera glycines
  misc_feature (1147)..(1147): n is a, c, g, or t
tttgaagaagtgtcaaagaacatgcagcaataagcctgcaaaatctataagtggaaatacatgagtatagaatttatttcagaaagtgtcacagacttttggaaaaatatattgcaattatcaacaatttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgctttagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgctttagctatntatcatcgggcttgtcaatccaaagcgaacaacaaagatgctgttttgaacga

SEQ ID NO: 26697 - DNA, 1233 bp, Heterodera glycines
  misc_feature (1184)..(1184): n is a, c, g, or t
  misc_feature (1187)..(1187): n is a, c, g, or t
ctttcacaagttttgccttaaaaagtgaaaatttgccacgaaaatagtcataaagggcaaaaaaagttaaaaaattccaaaaagtcaaattagagtcgagatctccagactgacattctcgaacagcacacccgtcctcctttccccccccccccagctttttcaacatacgtcacgtcaattccgtcgactccattaatgccacattcgtccaatgtttcattgtcccgaagttcaaccgctgtgccatccgttgtctgtctgcgcagttttatttcgccgataaaatggtccaaatgtttagcaatcctcggcttaatctttcccttcaaattttgcacagtatctgtgcctttcattgaaatcttgtatgaattgccattacatttgacgaaaatttcaaattccctccacaaataaacgtgcgaattttcaaaaattttgtaatcttttaattccttttcgtccatcagcagccagtggccatttggattgtcctcgccatggattgtttgttgttcgggcgggattttagtgatttctgagattttctgcttcaatgtggccacagtgtcggtgtcctccacttccacgggcaaagacacataaattttaaagccatccgtagatgatggcatcagcattagcataataagcattgccatgagaatcccagcagaaatgccaaaatgattaattatgcgggaaatctgttggcaatttgatgggatgggagggggtgaggaatttgtatggaaattgtaggatttggaggggtaattaggaatgaatgaatgtgaaaactgttcgatgacctattttatgggcagaattcaactcaaaaattaattatattaataattaagtgatcacttttattcaccatttttctagtcataaaatgtaatgtgtagtggatgtaaaattctttctctgcaatatatgaaaatgctttttttaaatcaattgacacaaaagaaaaagatgttgagcggggaccgggccgggaattcccggtcatccgaggtcccggttcccggtcccggattttgaaaagctcaggtccaggtcccggtagggcgaccgggaaccgggaattcacttgaaataaattaaaatttgaattttttaaaatttttttgaatttttaaaaatccccggttggtcccggttcccggtcccgnaanaaatcgaggtcccggtcccggcttctcaggtcccggcaagtcccgg

SEQ ID NO: 26698 - DNA, 2039 bp, Heterodera glycines
aaagtagcatttcttatggatagccatttatttgaaagtcaaaagtaataggcggcagtgaagcaagagcatcacatcccaaaataaaaattataatctttcattgtccatgaaagttcatcatcgaaaagacgacaattatgtccacatattcatttcctatttttaaagtcacacgagcagcttctttgacatgcactggatgaccggaagcactcattaaatgtgcctctgatttaaatgttttaatacctaagtaatcggctaacgcttttggtgcaactgaggtgcttgagccagtttccactaaacatttcatttggaaattattaagagagacaaaagtggtccctgtcattgtattattatttaacgacccaagctgtcccatcaaagaatttaattcaaaatgagtgctcatttgtgttggatttggtccatgcctatttcttttgaaaggtctggtgaaagattttttaaatgaatttcctgcccttctaattcttggtggccaattaatctgattaattggttcttcataaatttctccttgttgaattttagtctccctcaattttcttactctgctcccagctttctgaattgttgtaccaaataataaattgcctaagcgcccattccctgcataaatttcacttaaaccaattgtcaatcttatcgccaagtcaattgacagaatggtaataattagagacataattattaaccacatttttctgtaatcaccaatcactgctttgatcatttggctttcaacctcttcccattcttgagaaattgtagctgtgattttggtgtccttttcatgaatctgataagtcatttgactcaattttaccatattactcacaaaagcatgatcttttatgtctgtcagatttagtagaaccaatttgtgaaaagcatgtgcttctatttgaggaagcaaattgtttagcccaaattttatttcatgatgaatcagtttatttgggcttaccgaagtaatttttccttctatttggtcaatttctaaaatttggccttcaatttgaattataatttttctaaattcctcacaggaaccttttcttgatgatggagagattatcattgactttgggtcaatgaaagcaaaatgttccctaccctgcgtcttcaaattaattggtatgaattcgaaacattgattttgaagtttggttggtctaaattcataatctttttggtccaaaggaacgcatggccaaatttttaaaagtgtttgggctgctcttttagcataaatgaatggattagagaaagtaaatctagccaaatccgttggatttgaaaagaatgaggcttcaacccatcttctattctcctcaatgaactcacaaaatgtcctaagtgattgagaaaatgcaaaactcattgtttgagttaattctgcatccaaataagtcaattgagaagctaactgagaagaagtcacaatcccatccactacccgatttttggtttctttcttactccttttccttctgcgagttttatcttccaaaatgattgagccaataccctgatcagacactgttatgttttgcccacaatcaattaaattcgtttgattcccgaaggatagacccagctcaccatcatcagataaccaaattttgtccatcattttcccatttttatttccaattggaataaaattacactttctttcaaagtctatttgccaaatcaagactgatttgtcggacaaaatacagtaccctttactgtatggacaatcatgagtttcactcaatggagtcacaattgaactagctccaaagtgtgaatcaattcgagtttcaaaaagaaagcaattttcacttgagacattcttccatccaaatgaacctaatagccaaaatctgggagttaaatctattttattttcagtttgccaaaaatttgtgatcccttttaaattgccaaagctacagcttttgtgcttgatcatttgcctgcattcatccaaagacacatcaaaattctctggttct

SEQ ID NO: 26699 - DNA, 1024 bp, Heterodera glycines
ggcagtgaagcgtctgaagaggaagctggcggagggcgtaattttgagtgggtgggcgagggacagactcgcgcacttgtctgtaccgacgtgcgtgcccttgttgagggtcgacttcaagcgttggcaaaaagtggtgagaggaaaataaataattttttaaatttataacaaaggccgtctgcaactccatcaggaatttgtctcccaaattgtgatggtgctgaagggtgacaaggggcgacggcgtggcagcaacaacaaaattggtactagtgatcggcaacgttgatcacccaaattccccaaaaaatctgtccattttgggcatgatgaccgaaaaaatttggagaacaaatttggcttgatttttgcgcaattgaaccagctggaaaccgttgcattcgaaattgctcattccagttcaaatgtaaagaaataaaaatcaggaatgttaatgtttattttcaggcttctctgtgccgacctcaaattcacttcggcgctgatggggcaccagggatctgcggcgaccttcccttgtccgctttgtacagctcggcgggaccaattgtcggacaaaattgtggatgcccgcccgtcgcctcccccaccccaaaattcgtacaccggctctccactcgtcaacattgctttggtgaatgttgtaccgccgagtttccatctcttgcatggtgaagaaaacgaattaaaaaaacgattcagaatttacaggcaaatgcccagcgaataattgacgccatttgttcggaagcggacgctcgtggaaagggggactttgttcggaaacgactatttgatgtcggcgtgcgacggcaccctcggacaaaacaattcacgggtagaatgatgggatggggtggtggttattgaggccaactttgacaggtggcgacatctacaaaatcctcgaccacgaaaacttcgcttcattcacggcaccaattcctgctggaccgttgaaatttttgctggtcgacgccatgaatgacctccgccacat

SEQ ID NO: 26700 - DNA, 1173 bp, Heterodera glycines
aaataattttcgtatatttttctcaattatttcaaaaagccaaaaaaaatgattcaattttgaaacgaaatagtgcacaaaagggagggatggttagacgaaaagaggaatttttagaaaagagcgcccccatctgatatttccattttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatatttccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtcgttgtccaataaggtacttggactttccacagtaaaatgtggtacaaaattttggaactgtcccgcctcacggcggggcttaaaa

SEQ ID NO: 26701 - DNA, 1383 bp, Heterodera glycines
aaaaaattactaaattcgatcataggaaaatcaaaaatataacatttgaacattttatacgtgtttagaatacattttgtaaaaatgaggctttttgacccaaaatgaggtttttttgcatgccaaatgaggcttttgaaaattttaatctggtagccctggttaatagagaaaacccgaatttacttcggcacatataactttttttctactcatacaatttacaccaaattttgcatatcgatagagaaaaaaattcttcatttttctatgctgatttattattgtctatgctcaagttcattacaagtttagaacacccatatattttttctaactcaccaaactgttcaacatttgcttagaaaaagcttctcctcatcaagagcttttgaatgataccaagatctttcaatttagttggcaaaaagcttccaaaataatttccgaaaatctattttttaaattttttttgacaaaaataaataaaaatattaatgttgcacaacggactcgaacctccacccccctcatcgctttgttcttttactatcttacaaaaaccactttgccacacatgcaaatctttttggcactggattgaaacggtgtgtattttgggctaattttataagaaaaaaattaggttttttaggggggggggcggtgccgatatgcgccgccgggtgaaacttttaagaatctttaatgaattttgttaagaaatagccaaaaattttcagaaatttccctcttttctcgttcgtcggcgacctcccccccccctcttttacaccggcccccctcgatgcgaaggggtccccaattttggggcactttgcggccgaagggggggggggggtcgaccctttccccccgcttttcatgtatgaacttcagcattgaacacaacatcaacccaaagttcgacaacggcggaagggacaaaagaagcaagtggaaaagacgagggaatttctgaaaaggcaaaaacgaatcggtaacagtttttgaatgaccggcgtgtcacattttaaactcactaattgtcctttcagtgccgaaaatgccacggaaattgtgccaattgtcttttcgactttcgcggttcctccgcggcattccgtcgccgatgatttgcctgcgtgcgctgaccatccgccgggactgatcggtcccattccggtatggatggacgggccgggattcgagacgctcaacaaattgtacccgcgggtgaggcagggagggcacaattggccggacaaatgcacggcgcggcatcgagtggccataatcattccgtacagcaggtggcgaaattgggggtcgaaaaagagggcgcatttacagtaaaaatcggcctagatttaccctatgttt

SEQ ID NO: 26702 - DNA, 1123 bp, Heterodera glycines
tttttgtcccgttttcccataaatgacgatccgccccataaatttaatttttattcgttcgttaggttaaatttcatagacagcatttttaaaagcattagaatagagaacctaacatattgaaaatgctgtttaaattttaacttgaaaagacagtttctattaggtttaaaattgattctttgaaaaaactcgatctcgagtgagtccttgaaatagctcaatttaaatgtccttgaaaacatttcttaaccgaaaatctatcagtgctaattaaaatattaatattaattaatttaaagaagtttatgcgttcttcaattacgccatcaacatttttgcaaagtgtgttccggcttaacaaatggaaaagccacaactacagggacaaagaattatgggttatcaatcgcgatgaaagaaatccaaagttgaataaaatgttgacaaattggttgtggaatgatcatttgccgaatgagaacgcattttttatccgtgcaaatcttaaatatggtgcatcgaggtattttgttgggaaattataattaatcgttttttatgggtttcaaaataattttataaaaatatttaattaatattttttgaatttaataaaataacgaaaatttatttttgcattattgaaactaaacccaaattatcaaacagaatttaaaaatccaaatttacttgtgagataaaagtttcgcttaatttttttttatttgtataatggtatagataattggtatcttttccgttttggggtttagatttgaaaaattagcgcagaatggccataccttggctctttactcctcattcttccttcccagtagtgctgttcgttagtttatttttgggtctcgactcgagaaaagtctcgggtttttgtctcggtctcgattttcacgatgagaaaattagacatctatgcaaatttttaattcaacactccaaaattgtgcatcgtccatgagtaatactagagcccggaaatttcaaatttgcggatcccgctgcgggattggtactgaaaattctttgcgggacgggatcccgcgggattaatcccgcaaatcccgcaatcccgcaaatcccgcatttaaaatttgcggga

SEQ ID NO: 26703 - DNA, 949 bp, Heterodera glycines
atcaagccacagcaacaaataataaaaaatattttttaacatttgaaaatctatagatttttttttatatattcgaaattaccaaaaaagtataatctttttttttgcattttaccaatacatctttaaattggtaataaaaaattgcccctaaacccccccccccccccttgttcccaatttttttgaaattatttgtagcagccgcataacctatttataaggtttttctattcatgtttagattaagtgagctaaggtatgctttattatttatcaaataaaattaaaaataataaaaaatattatttatttctagctatatttgtttgaggaatttttcgttttaatagttttgaaattcttcgaatatttaggtgaatattattttaaatgcatttctttagtcgtagaaatcttgcaaaaaccattttatttgatgaatttaaaactctttctaaaaatttataaaatgtctaaaatggatttttttgtattaattatcaataatttcaaaatttttattttatttagtcacattcggaatagtagttattcaaatataatattcatatttaaatttaaatttgtcaatttttgaaaaatgaaaaagttaatattataattagagaccgacttttgaggcatatgcttattatgcctaatttttgcctttttcgggattttcgtgccttttggcattttgccggtttgttgccttatttggagttttttccgaaatctccaaaattatatatttatttttttgatataaattctagctttaaaattctccttatccgaaaaacattataaatatttctcaatcatttaaatgaccaaaattaagtatttgattaacttttacgtgttttgctccctaaaaatccttaataaaaaattaaaagtcttttttcatgcctttttcgagatttttggtgccttttta

SEQ ID NO: 26704 - DNA, 1405 bp, Heterodera glycines
ttttttcaaaaaagtgataaaaagttaaaataaaatttataaataggagcaaaaattccggatttttatattattttactttccaaaatatcttttcagaaccgatttcagaattttttactgaaaattcgaatttttccagaacttctggaataactttttttagtgtcatgatagaaaatctaaataaaacccataaaattctcctgattttttgctatttttaaagctttgttgtatgaaaattgacttaccctgaggttagttatgaattttcaaaatttaccccaaaatcccgagggtcaaaaaaattgaaaaaaatttcgaatttttaaaaaattctaaaaattatgaaacgaaaaacaaaggtcatattcgtgctcagcacatcaaaataccgcacaaaataatttttcacccactttttcaacccaaaaaaaaatttcgaaaatttctagggggcctagctcgaaaatttttgaaaattttcgaacatgtagtacaccattcgatagagctttaaaagctctacaattttgccctaaggcaatttttggctagaaccaacccccgacgagttatgggcccgggactcaaatgtcccgcttaggccaaaaattttttctatttcctggaaaaaatcgaaaattttctaaaaacatcactaatcgatagagctcaaaaaacgatgttttggaagtggtctccgttttcccgggaaaaatcgttaaaaaatcataaaattcaaaaaccgaaaaaccgaattttaggcctaactcgaaaaattttgaaaatttttgaaattttaaaatttggaaaaatcgagctcattgagctctacaataagtccgctggcgacaccctgctccgagcaaacccttacgagctattcgcctggtactgaagtgtccaaaaaaagtgattcttacgttgcctaacctacaggtcaggcctttgatctgatcaaaaattttttgctggcaaagttgtaggccatagttggggcatttcgcttttggggtccgctaagctctgaaagcaaaagcaaaaaatttcgtaacactgagactggcggcaaagtcagtttttgagccgctgggactcagttggccaccggaccaaaaaatccgtatttttcccggatgcgccgtctcgagttacccctgtgtgcaaaatttcagccccccagctattcccgttcttctcaaattagtttttgagatgagttgccttgtcaatataacgtatatataataaacgggtgcgtgaaccgtcggctatttagctgggaaaaagcgcttcgcgctttgggagcttcgctacctagattagctctggttgtggagattttgaatttttaaaaaattatctgggacttttaggccgcttcgcggcctcgaacggg

SEQ ID NO: 26705 - DNA, 941 bp, Heterodera glycines
cggactgtcccgcctcatctacatccgaaagttgcagaatgagatggtcagtgtgtgtgcatacaatgacaaaaatctttcccccaacgatcccagggatttgtttcaaaaaaagttcggaaaccggttgctttttgaaattttttgtaggctaatagagtacacataaggctatcaatgctattaaataaattctattaggctaaatatggacggagttatacccaaaaaacttttggccatcgcctgatgggttgcaccattaacataagttgtcacccgaaaaaatttaagggagcacggtcctaagaaaattttttatccaattttctactcctagggtaattatttttttaaataaactaaatcccaaaccgactaacccaaaattttcctcactttgtccccttctcaatcgtttgcttcagtttttctgtttttcacagaggcgaacaccgttcagcatggcggatgatgatgggcctgacagcagtgggcattcctcgtccaacgcaagtgccggcttcacaccgaaggtccagcatggcggcagtggtggccccgtcggcactgctgctgccgccgccgctgcacaggcgtcagcctcatccaccggtgtggcaccggtccatcggctgaccatcaccgacctaaaagcttcatggaccattgacaatcggtgggtctatggaggggtagaattgaaaattgggagcagctcgttctcccccccccccccaaaaaaaatgatttcaaattaaaattttcaaaaataaaaaaattgaagcgtttctttcaaaattttatgatttcaaaaaattttaccaaaaaatcactaaaattaaattttatttttattttattattaattttacacgtttaaaaattaaaaaaagttcgtagggaaatataatgcacttggaatatgagtattttttaaa

SEQ ID NO: 26706 - DNA, 1668 bp, Heterodera glycines
  misc_feature (47)..(47): n is a, c, g, or t
aaattctttagaaatttctgtgaaaaaaataaaaaacttttttttanaatgtaccctaaaaaataccaaaaatattttttaaatgtaaagggtggattctaaacctatttaggtcatttttctgccattttgtgccaatttaacactttacgaagatttatttccaaaaaatacccattaaaaaaaaaatttatttacatattttcgtacatattttgggtttttatacatatttgggatttttcatacatatttatgtacatattaggaccactttttgtacatatttttgaaaatacaagaaatgaaaaatgcaccccctaaaataaactgattttagtcccaacacctcgaaaagtatttgatataaatacacttgattttccaattattttggcattttttggttttctagcatatattttttaattatatattgcagaatttttagcacataatatccgttcactgataattattacaattaatttgaatttctctaaaagcggttgcaatgttttccattgcccaatttggcaacttttcataaatttatttgtgggaattctaaactgaacaaatgtgaattactacttaagtacaatttataaatttattctccctttcaaatatgtacaaaaatgtgagaatttcaaatgttgctgcacagcaattgttaaaaaagggcaaaaatttgcaaaaaaaaaaaaaattgaaaagtatttattaaatttttatttaacaaagtgttgaaaaatttttaagctcggcataatttcgaaggtttcttggttttgagattaaacagtggtaagaaacatgggcctagtgtgaagcttctagtcgttcttaattatttacccgaaagattttttgattacaaatccttcctcacattcgtcatcgtctggactgaagttcagcatctttaattataaattaattattttaaaactgaattagcattcccgttatattttattatctttttgttaataatttgcagaagaaatttctctctgtgcagaattatggcaaagatgggacgcttaaaattcattgtgtattgaatgcgattaaaaagaaaattaaattactcatctaatttataaaacaaataaaattggcttttgcacaaatcaacaaattttttgacttttcgtccgctccattccctatcaaatttgttcgataaaaaatgtgaaacacaggccaaattggcgagtgatgtgttgctgctatataattggaggaagagccaaattccctcacataattaattcgctaattaattgctcatttgtcagcccatcccaaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaagtgagaatgaaagtgcaatttaatttttaagagcgcctttttaaaattgaccgggactgagttaacgggacaaaacagtcccgcacccgctcttaagtatttttgtaggaacaaa

SEQ ID NO: 26707 - DNA, 2050 bp, Heterodera glycines
  misc_feature (816)..(816): n is a, c, g, or t
  misc_feature (2008)..(2008): n is a, c, g, or t
  misc_feature (2034)..(2034): n is a, c, g, or t
atggtacatacaatcaatggtggtgctttatgtgagtatgttaataacaagctaaacaaaatgaagtgacgggcgggggaatggcacggaattctgtgccgtgccgttgtcattgtagtaattttgatgacttaaacagagcaacaacaagcaatgcttgacaacatttctgcatcgaattgagtcgagaattttttttggtcgggattcgagtcaggatgcccaaaaaaaagttcttgacaaaataacagggggaacaaaagaactaaatatgccatcgtcatcatcaatatagaggagcatgcgtaacaaaaaaaaatttatataaaaattttctaacatataaaaaagttattaagaaaaatttaaaatttcggcttttttatttacaatttgcaattttcatttattctttattttttggtaattgccaagcattacctttaaacaacttttaaatatgttcagctttctaaaagtaaccaagatttttggatttggctgacaataaaaaacattatagtccaaaaattcgggttggcgccaaaacgtaagcgcaaaaacgacccaatccatcccacccaaatctttttaaaggggctttcccatagcctttggtccgtatttaatcacagttggatttcactttttccaccctcatttaacacattcaaaatccatcttttgtccctctcccagcagaagagaaaattagacgaataatcttttctttcttatccatcttaagaagaggcataaaaagaagggattttcgatggattttcacaaaggcaaaatttcaaaaatggacattanaaaaagtaaaaataaaatggatatataattttgggaaatattttttaattcagtaaaaaccgtttatttggataattaatgtgcttattaaatagccgagagaagcaaaagcaagcagagacagatgctttgctttgtccatctgtgcacataaaattttgcttacgattttcgctatttttggcgaatatgcaatttttaaattaaattcgtccatcaaaattaaaattaaattaagcgaatttccctctttttagaattacaattcttccaacaaaattttatataattagatttaaaattaaatcatttttctgtttttgtaatttttttagcctagcgccgaatcgatgtttttgttttatgactttattatttaatttaatatttaaaatttttttactattatatttaattgaatattttctgataatttaattttaatttaatattttttttattgcaaaaatatcatattatattaattttacgtaaaattaatttttgtttataataaaaaaaatgaagaaaaaaaaaatctatttttggcataacgaccgaaaagttggccagaggctgaaaaatgggggtggggggggggggggaaactgctgctgttctgtccctgatcatagcattcggctttcccatagatcctagggataaaatggagtgatttgatcaacaaaacaatcagccgtcgaagcggtgggcagcagggtgatcggaaggacgacgaacacacacaaaagcgatcaccagcaacacgtgttctgcgtcgggtgccctccccctcccgtccattaaagcgatgtgatcggtgccgccagctaacaactgttagctgattgatgagactgataacagcagatttttcttggcaaaatgttgggggccaagagcgggccatttttcaaacactcattttgtggcaacatccgccatgccaccagagagtatccaccggaagatacaataagggcacacatatgtgatttacgacgaaaacgtaacgacgacaaatccgccgaatttcccccggccctcgaaattgatgacgaaatcggagggttttgattgagaagaatgaattgctggtcctcttctccggctttgcattccattatcgttcgctgatcattcattcacatatcactcactcactcatcaaatcatcgaaaattttcctcanattgtctctctcctcatttcattcanttttttatgtacaatt

SEQ ID NO: 26708 - DNA, 992 bp, Heterodera glycines
  misc_feature (27)..(27): n is a, c, g, or t
cttacctcctttttgctaagtcccgcnttgagaccaaacatttttaaaaatgatggactaaccataccccggctcgagcttttgggattgcttgccgcggtcagggccaaaaattttgttgtcactaattttgactatccttttgaaaaaattttcttttgggccgattcacaaattgtcttatcttgggtggccaacgacaccccccaaccgccatttatcgccaatcgtcttaacgaaattcggagggaaaagggagcaacttttaagtacgttaggtccaatgacaatcccgcggatttaggcacaagaggggcttctcccagggaaattagcggactcaatttatggcattctgggcccaattggcttaagctttctgagcgtgaatggccagccgagtttcgggacattgtttcacccccggatcccccctttggcgctggggaggaaaaccccatttggaccgctgcgcccattgttgagtcaaaggcagagccctccctgctcaatccgcggcactttcatagctggtcaaaattattaataactaccactttcgtgttatattttttgtacaaaaaatgccaaaggagcgagaaattcaaaaaagggtttcccttcctcagtgaattggaaggggcggaaccatcatcttttggggcacggcaagtggcagaacggtggataatccgaagggaacaggcaaatttaccccccgcaaatcctatttttgtggccgccgacgggctggtgcggttgaagtctcggctcgctcactccgatcagcctaccaattttaaaaatcccgtagtgcttccccgggactcttgggtcacacgtttgctaattttatcggcccataaatcggtcgcccacgcgggtgtggactacaccctttccaagttcttaagcgagttttggtgtctcagggcacgtcggttgactatgagcattttacgggactgaccagttttgccaaagggacaaag

SEQ ID NO: 26709 - DNA, 482 bp, Heterodera glycines
atttaagtggtcagcccgcccaccacccccagtgagactgccaaataaagaaaggcaaacagggccgttgaggttcaattgggcaagccatcctcctctcataactatactaataatggccattgcctttgtctgtggcgggagcaccgctccccgtgccctcacgtgcgatgaacagggcatttgggtgtttttaaatccgcgggcggaaaacgcacttgtctgttgcgaggggatctgcagcagcaggggacatgcctcaccatatttactccccctccctctggatttattggccagtggctttgagtgtcatctttcgtactctctagcgggagacaggataacgtcgcaacttcagtgcgaaccagtggagggatgcggtctcattaagtgctacgtctgctgggagagagtccttaatccccactgttcccctaaacgcctcccctttgtcctgggaacagtagccggcgttttag

SEQ ID NO: 26710 - DNA, 2198 bp, Heterodera glycines
atcgattgatttctagcgcaaaattcgcccttaattgtgatcaatccgaaaccgaatttttggaatttttgcgcacccattgaatcgacgcgtttccatagttttgcatcaaattccaagacaaaataatttagccccgtttctcttctcttctcacctcgggctgcctttttttcatttgtttcccctccctctcccttttctccgtttctcttcaaatattcatgccttttatatgaatgaaatgaactggaagtaataattaagcgcacttaaatagatatttgctctcatcattcactcacaaaaaagcgatttcattaaacaaattacgacatttaaattacaaataattaatttttcttttttttattgagcataaacaaaattaaagtaaacaaaatcaagcaaaaataagagtgcatgaaagggacaaccagacgcaagcacagacagccttcgctgcaggacgacagcgggtccaacaacggcggcaaaacgtgagttgttggcacccgtttttttaaatgctttgttaagcctttaaacttttttttttgggcgcctaaatcttagtttttgcccgtttgttgttcttatttagaaaataaaaacttttgcttgctgagttttccagatacgccttttttatcttgaatttttttggcacttgtattatttctttccaaaatttatatcgaacctattcatacttatgcatatacatagacggcacattttgaaaatccggcgtagcgatcaggcaattggatcatcggtattaaaaagcactaaacttggactcttgctttaatcctttgtcttcggtgctatatacctgtgccacgattcaatttatttctggagggatgagttagaaaataccaaaatttggtgatcatcacctatctgctgtctcaatgtttggacatcatcattttcggtgtgttgttgatgttttctgtttgttggtggcctgttttttgcgatttgttgagactgctgctcgctgatgatccgtctctgtgctgcatgcaattgaattgaattgaattttgagttatgtgatgtgaatgcgtgtgtgtgtgtgtgtaaatgtatgtgtggtttatgtatgggaaaatgaacacagtgaggagacgacaaacgacgacggatggcggagatgaatgtgtggcggtgttggaatttttggggcgggaactgaatgagagtaaatcggtcggttgtccgccgctttgcttcttacttttcctccaccctccccccctctaattccctttaattccctctgctgttctgttctgtgtgtccatttcgctgttgtctctctcacttcagcccatgaaacaaaaatttgtttttttgttttttttttgcaacattatcacattgattcccgcatttgtttggtttataatgtcatttcacatgacaatttatcgggcaaaattgagtcaataaaatttttgtagaacaatgttataaacttaatttttcgattaaaaaaaactaactctatgttcacaaattcgtctgtttttttttggttaccttttctccctcccggtgcaggataccatttttccctactcaccggacccgacaaatctggttgagtcgggttttcccaaaaatttgggccatacacggtcataagtcctaccctaagggtttttttgggttttcccatttttttaaattttcctgttccaggacgcctgttcctactgctgctaccgccgctggaccccccgaggaatggcgtctggaagcggccattgtttcgctgttgacgctcactgatggggacaatcgccttatttgcccaccatttcgtgtgcttcctacgccgacggtttaaccattatttgtccaataatttaccgtcagacttattttccaataatttttgtttaggaattcccactttactacgagcatatcacgaacccaattgatctgaaatgcattgcggagcgtgcacgtgcgggccattacacggattgggccgcaatcgaggcggacatccaattgctgtgtcaaaacaccaaggttggcgtgttgcgcatccgatttcgcaaaatttcgccgttttttttaattttccaattttccaggacttcagtgagtcgggccaaatgctgcgcaaagatgccgaccttttgcttgaccacttcaaatcccgtgccagcgaa

SEQ ID NO: 26711 - DNA, 2185 bp, Heterodera glycines
atgtcctccaattttttgtaccttctgccaacggcggtaggaaaacgaagcaaatcgcaaacaaaaataaaatattcattgtctaaactaaagtggttgaaaatagtggtatttaaaaatggatgaaaactaataaattatataattaatgaaatcattgtttatatacatacaaaataaaaataatatggttgtttgatcatttaaatcaagataaaatctggagaaagactacggcttacaaattagcttagctacctggctttaagaaaagaatagattaaattatttattgctccaacaataattttgccctgtcatcccttctttccagtgtatttttaggttcggttgggcccggaacaaaaccgggtcaagtccaggtctggaaagagccgttgctggacccggtcgaaaaaggtaaatgacatgccgagtctcgaacccacggcattttaaaacattaggatgatctaaccgacttaattgggtccggcgtcccgtcattttgtgaaaccgagtaaaacgggcggcgttttttgggaaaaatataaataaatcttattttaatgataattatgagtgaattgcgtggtgtcttttaaactttatataaatacttgtttatatatcagttggcatatttatttgccaacattattattttaaaaaccgaattgcaaatagaaaaatttaaaaaatgcaaacgaaaattgaccatttcttttagagattttaaaaattaattatttaaaaattttgtatcaatggtttattttttacaaatttgcaatggaattctgttaattttcgcaagagtttctcaaatgttgttttcttgaaaattttccaattttgagaagacaaaatagccggacatttcaatgcgcaagaaaatggccgaagaaaaccgtcttatggaaaagcaagtcaaagtaaaagatagttttaaataatgccaaaatatttattcatttaatattttaaaatcaaaattttattcatattaacgggggggggggcggaaggacaggaaaactggagaaagagaagcagcgaaagagactgtgggaaaataagagaatagacagttaaagaacctacgagaggtcggttgcacactctgagcaccccgttaatgggattagtgttcaattaaaacaatttttgggtaattaagaatttaatgaattgcttagatgtggtttcgtaatcagcgtgaccaatggaaaattcaaggagcagaagaaatacttgagtaattaattaattaattaattaaatggcgacacatatagaattgacagaaaaagcaagaaggatgtgaaatgtggaaaaaatttggagagagagagtgagagagtgaaagagagtgagagagtgaaagagagtgaaagagagtgagagagaaagagagtttgttgacctttttaatttaaaaatgatggcacagaacaggatgatactatagatggtgcccccccccctttttttgaagaaaattttttttattctgtaaagtcttggaaacatatatgtgcgggagggtcgctgatcaagaatctgacatccatttcgaccaattccgaaccccggacccgaattcgaataaaaagtcaaaaattttaaaatttaactttttatattttttatacacttgccattggctttttaaaagttgcggacttaagtttccattttattttcataaaatgaccaattggattcaacttcaacagaagaccagctggggtcagatgcactcatcaagaaaattgttaaactaaatccgccaatgggttcgaaggaaatctggaagccttgtcataaatgaaattcagaaaattttaggttatgatttttttttgattaatttttgagtaaattttaggaatgttttgggaattttctttgtcatgtcactttttcatttttatcaattgccattcacattttgctcaataaagcatttttaaaaggcaacaattgttaattgaaaaaacacatattatataagcaattcacatatttttattatttttttcgcttatttttttgttcgttgacttattttttgttagcattattccttttttcggcatttcggcggccatttttatgatttgtcattttattttttgtgcttcaagagacccaaaatttgtgaaaaatttaatagtggcgt

SEQ ID NO: 26712 - DNA, 1262 bp, Heterodera glycines
  misc_feature (238)..(238): n is a, c, g, or t
  misc_feature (1218)..(1219): n is a, c, g, or t
  misc_feature (1228)..(1228): n is a, c, g, or t
  misc_feature (1245)..(1245): n is a, c, g, or t
aatggatggctttaaatctgcaagaaattagatgggcaatatgtgttggtaaaaactttttgggtaatgaattattttttgaagtgagtcaaacaccgtattagtgctttgctgtgccgagaaccggcaggcaatggatagctttaatctgcaagaattagattggcaatagttggttgtaaaaaacttttggtaatgaaatatttttgaagtgagtcaaacaccctattagtgcttngctgtgccgagacccggcaggcaatggatggctttcaatctgcaagaaattagattggcaataagtggttgtaaaaaacttttgggtatggaattattttttgaagtgagtcaaacacactattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccgtattagtgctttgctgtgccgagaaccggcaggcaatggatggctttcaatctgcaagaaattagattggcaatatttggttgtaaaaaacttgtgtaaggaattattttttgaagtgaatcaaacaccctattagtgctttgctgtgccgagaaccggcaggcaatggatggctttcaatctgcaagaaattagataggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattatttgaagtgagtcaaacacactattagtgctttgctgtgccgagaaccccggcagcatggataggtttaaatctgcaagaaattagattgnncatatgtgnttgtaaaaaacttttgngtatggaattatttttt

SEQ ID NO: 26713 - DNA, 1402 bp, Heterodera glycines
tcaggtgaacaacttccggcctagtctttaaaaatggcaaattttggcacagcgaaatttttggtcgcttttaaccgttcaaatttacttccccccccccccccccccgagaatttttttttttaatttgctaacttagaatttttcgagaaaaaaatcttagaaagttttttcatgagaaaattctaagaaaaaaatttttcgagaaatttttataatgaattactaagatttttcaaaaaaatttccaaaaaatcgctgagaatttctcgaaaaattttttattagaattttctcatgaaaaaactttgtaagatttctttttttaatttctcgggggggggggggaccgagctgggggggggggggggaaatgaagtgcaccccaaaaaaggatttgaccaaatttaaccgtatgttatctattagacagttcttgtagctcttaggggtcggattattcgtacgataccaagcatttttattatccttaacccatttcccaatcaccaataaaagcctcatttttttgtttctatgtcagtgtttgggtggtaatacggtggagggcggggcgctggccggctgccaagacattgctgaactgctcgcggagcgggcagagtaggagcagcagttgcggggagcgtggtccaacaaggtgggccgcccctcccaacgggagggcgccggcgtggcgcagtgtttggaacggacggtggtgcaacggcatccgaacatgcggtaggttgagttccggtgacattttttgagatattagggtttacaattagcattgggaaaatttcccgcgggaaaacccgggatttcgatttccggccaattttgtgaccacatttctttcgacaatttttgtctccaaaaatccttgagctgtttgaacttgctgtaatagttatagcttgtttccaaaaaacccctccagggcgtgaaaaaaaaaccctcgatgcttctaatacgagaaaatcggctaaaattcgtcccaaattatcaaagaatccatctatttgatcctttaaaattagcggttcttttgccaaaaaaagcgatggtccataaaagacaatttaatttgaaaacgcttttcagttctgtggtgatcagcgaggtggaaacacttgtgttccggtaaatttgttttattgacacgcatttttaaaccggttttttgaatggttttttaggaaaaacatttcgccaaaggcgcaacggtacgccgtgcattttctgtcccgcgtcattttggatgctggcgaggccgagttggcactgcagctgatccgcatctatttgaagctgttccacattttggtgaatttacctaaacgaattgtcttttttttatttttccacccaaaatttttgtttgaattctttcgag

SEQ ID NO: 26714 - DNA, 1589 bp, Heterodera glycines
aaaaaatccaaaatttttcttactaaaaattatttcaacgaaattttaagaaaaagttgagagatctttaatagcaacagaaaaatttcaaaaaaatattaaaaatttaaaaaaaaaattttttttttgaaatttaagaaaattctgatatggggggggggggggggaagagctgcttccagaaaacaataggacttttaaagaaatgcaatttttgtgtagcgcccggaagtgcggcggagtcggagctgatcagccaccaccttcggctgattgaggagaaggaggagttgtcccggcgacaggatttcctgaacacacagttggacctgcacgagacggagcagcgcattgtgcagttgcgcatgaaaattgttgccgaagacgacgccggaagtggtggtggacattgcaacggcacaggtgatcaacaattaatcaactaattgattaatcgctgttcgaatcccaaaacaaggtcgtagcctgggcgaattcccccccccccccgaccgaattctttttctcctcgacgatggaaattttgaaaaataacactggtgatcaaaaaaaaaggcattgattccctctccgagtcggatttcgtttttcctgatcacttttggcgtcgtaagccaattttataatgcgctatgggtataagtgctttgatgactgctcactgttgggaatgttcacctcgttaaagtcagttttgtctttttcagtttctgctcttccgccgacttcgcccttttacgccgcgctcagacaccaaaacaattcggcacttttgttggagctcaaacaactaattgaccacaagaatgatctcgtcatgcgcatttctgactatgaagacgaagcttaaactcataccgcacgcccctcccactcattttgccattaaaatgcgcttcttctttttcttgtcgcccctcccaaatttctcgcttttccttgtattatccctgtgctaactgtgaaaactcaacttatataaacgcctatacatacatatacatttgaatttatgcataacaattggtaggcccaaatgaaacacatttttaaaggaaaatgaaattttaatattttctaccatattttttgacattacttaattttcatttgagaaaaagttttgggacctaaaagtaatgttaaaagtgtttttctcgttggtgaccaacgccttaactgaatacgggcctaaggacggcaaacggttaaaagggaaaaaaatcgtcaaaaaaatcattggcgaaacaaaatgccattgtattcaaataaaaaacaaagtgtcttaactgtgatcaaattactaatcaaaaattagagcctccatttcaatacattttttttctcgagtttatttgagttaaaattgatatacaacattatcaaattattagcatgtattcactacaaaacgtggatagaagatcattaaaattatgagcattcgatgcagaacagttacctatacatacttgattttattttaatgcgactcactttaagaaataggcttaagtggtaagcattggatggaaatctaactgggtgcgtcagtcagccaatggaca

SEQ ID NO: 26715 - DNA, 1494 bp, Heterodera glycines
  misc_feature (1428)..(1428): n is a, c, g, or t
cgttctaagatttttttcttgaaaaatttctaagttagcaaaattttttttaaaactttcacggagggaaacggcggggggggggggggaaatgaagtgcaccccccaaatccaatacgtcctaaacatatctcttaattgttttgtttaaggtatttgccaaacttcgtgccaccctttttgccacttttgccaaatgccaaggccattgttccattgcaatggcttcttcttcggcttctgctgtcggggataacaatggttggtcgccagaagcgaagaaacggcgcacaattattggcactttgctgcgccggggcgacattttggagacgaacgatggcgacgacaaaaccgtggaacgcaatgatcaaaccgcagcagatgatgacgaaactgatcaaacccattcaaatcgacagtaagaccgggggacgtgacaaattttcgccaaaaaaaaataaataaaataaacttacaattcgaaattttttaagaaattttttttaattttaaaagaaaatttttaaaaaattagaaaaatttttcagccattttttcctgaaatttatgatgaattagtaagttttttatgaaattttttccaaaaatcactaaagaaaatttcaaaaatttttcccttggaattttcatataaaaaaatttctaatatttttttcttgaaatttgaaaaaaaaaattttaatcggcgcaattttggggtgcactcactctcagtccgtggattagggcatttattttttaaaaaacaaaccccccccccccttagcaacggtttttcggtcgaaacgcaacaaagtgtggacttgagttgcatgacgtttgccaatgctggactggaaatggacgaagctgagcagacgatgatgaacaacgaagacgaacaaaattgtagcgatcaacccattgttcaacggacaactcaagacgaatacgtcgtctctgaggattggccaaatgccaacaatgttggcacaaaaaaggcacgaaaaagcgaaacaacaacaacaacaagaaggacaagcgtgaaattgactgctggccaaaaggcattggaggtggtggcgagagttaattgagttatgccatgacaaacagaaattgtctcgagagcagctctcccccgccccgcctatcatttccaccctaaaagcggcttaaaaggggaactgaaattttttataaaaaaatttaatgaaaaaacgagttgaaaatttttcagcgattttttggacaaatttttgaaaaaatttagcatttaattattaaatttacaaatttcaacaataagaaaaaacaattttaaaagatttttctcaatttgagtgagcctatgaatgcgatttgattgaaacaatttttgacggaatttggtaattaatgaatgatgtggtgaccattctgcangcattctcattccaacggctttcgtctgctgctgggtcatcatcaacaacaattgaaacttctgct

SEQ ID NO: 26716 - DNA, 2061 bp, Heterodera glycines
tttcctccctttttcaggtgtttttggtttatgctgaccttcgccgtcgcattctctaccgaattatgttttccattgctctgtccgactttcttcagctttacgccatttggcagttcactctgttcgaagcactcggcttttccgactggtcaatttacattgaaaaggtaggcgactgatcaatgaatcggtgttgatcagtgagtgagtgcttttgcctctgatcaatgctttttgtccattttctgccgtccgatcgttcctttttagttcgctagcggtgtttacatcgtcgcttgggaccatctgatcgttcagcactttcttctcgccctcaaccgtctgatcataattttgcgcgcctattattcgcccgtctccctcaaaatgaacggcggtgagtcgcgtgctgagaaaggccttttcaatgtgagtgcgttgccggaaactgatcattcatcccttccccgttcgatcagtctctgctcgtcttctcctgggtcgttctgttactcctcgtccttttgttcatgacttcgatgtgcggcggcgtttgggacggccaagcggtcggtttctattacgaccggactttgaagtgcagcaatgtgttcatcgaggtggagctgtacttcaccatcactttccctgctctgtccgtgctcttttacctcctcatcgtcgtcatgctgaaaaaggttccactccaatttcgaattcgtttctcattttatttgcttctttagactcggaatggttgtgtgacggttgtccatgtgacttcgaacaatcagtcgctgaagcagcggtcgccggtgcgtctgctcagtgtgcaggagaagcgcattttgctgctgtccgtgctgctgttcgcgctgatcaccgcgttaatcttcgcttggtaccacgactaccgaagcccgccctggacgctgctgttctgctgctacttgctcaccaactccttcctcagtctgaccatgaactcggagtaccgaagtcgctttgtgaaaatgctcaaatggctaatgcactttttggtccgcgaaaagcgcggcggccaaaacgtaatgaaaaatgggacaaagcgggcggacggagtggcgggcagcagccaagtgcgaaacattgtgaacggaatgggacggccgaaacatgcggacgaactgttcatcagacgagggcacgctgtggggccacggtgcggaagggtcggcgcaattggagacggagtgcgacggcaccagtgaaaagcagagagagagacgaggggataggaagagacagagagacattgagaggaagagagagacaagggagagaagaagagacagagagacatttaaaggaagagagatacgagggagaggaagagagagagagacatttaaaggaagagagagacaagggagaggaagagacagagagacattgagaggaagagagagacaagggagagaagaagagacagaagagatacactgagaggaagagagagaagtgggagaggaagagagagagagacattttgagcaagagagagacaagtgagaggagaagagacagagagacattgagaggaagagagagacaagggagagaagaagagacagaagagatacactgagaggaagagagagaagtgggagaggaagagagagagagacattttgagcaagagagagacaagtgagaggagaagagacagagagacattgagaggaagagagagagagaaagaggtgaagagaggaagaaaggaagaaaggatggttcatttctgttaatggttttagttcgagattttatcgaaaaatgtaattaattttttgtcagccgtgccggcaattgttacggttaaacgttgattagacattgttgatactttcgttgtttgaaactccctagtaattttattaatttttccccactttttctctcctttcattatcaaattcctttcgtgccattgcacgcaatttgtcctcccttttttcctttaattttaaaaactgttaaggtcctctttcgcccttttcggtggcatcgtttcaaaga

SEQ ID NO: 26717 - DNA, 1004 bp, Heterodera glycines
cggggcagtccccccgaacccgatgcgccccagatttatggggagaccgaatccttccgggagtagcttccctattgcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagctttcctatagcctgtactttaattctgcgttggatttttgctccccataattgtttgagtaccccaaacggacacttgaaaaaatcgattttttttgttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattatttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccc

SEQ ID NO: 26718 - DNA, 1694 bp, Heterodera glycines
  misc_feature (1621)..(1621): n is a, c, g, or t
  misc_feature (1671)..(1671): n is a, c, g, or t
tttttaaaatttaattttttttaacccccccaaccaatagcaaaagggcggggggggggagcagaaacaatttgggaggccattttttccttgtgtgttggggtttcccttcctccccaaaggggttccattcggtcgttggacgccaaggtaaaagagaagacccaatgtgatggacccactgagtgtccaggtggggcgtttggggagtgaatctgtaaatggaaattttcatataaattttttgaaaaagacttcttacaaaaaatttagtcgtcgaagagtaagaaaaaatatataagtaagtttttggtttcctttttgaaactcaacgcaatttttaaaaatttctcagcaaataaagaacattcagtactatcaaatgaatagtattcatacaatttggtctactatgacaggcagagcaggacgttttcccccgaaaataatttttatataacttgtaaacaaatgaataattgttcaggggtctttgggaaaaattcatgaaatataagaaaaattctcaggaattttctgatacaaatcgctcataagatgttgtcatcttacctaacatatcgcttcatacgacttcagaggagcattgcgtgcgtaaatgtactacatgttacatgctaagagaggaaattcatgaactccctccgttttcatgtaacatgtaacatattttgaagcgggcgcgaagcaccgaggccacgaagtgttcttacgagccccacaaatttagaaatgggcgcgaagcgcccatcttagggcgtaaagctgcctacaaccccttaataacttttcaaaattcattgctttcattatgttaatacatgttacatgctaagagaggaaattcatgaactccctccgttttcatgtaacatgtaacatattttgaagcgggcgcgaagcactgaggccacgaagtgttcttacgagccccacaaatttagaaatgggcgcgaagcgcccatcttagggcgaaaagctgcctacaaccccttaataacttttcaaaaattcattgatttcattatgttaatacatgttacatgctaagagaggaaattcatgaactccctccgttttcatgtaacatgtaacatattttgaagcgggcgcgaagcactgaggccacgaagtgttcttacgagccccacaaatttagaagtgggcgcgaagcgcccatcttagggcgaaaagctgcctacaaccccttaataacttttcaaaaattcattgcatttcattatgttaatacatgttacatgttacatgctaagagaggaaattcatgaactccctccgttttcatgtaacatgtaacatattttgaagcgggcgcgaagcaccgaggccacgaagtgttcttacgagccccacaaatttagaaatgggcgcgaagcgcccatcttagggcgtaaagctgcctacaacctcttaataacttttcaaaaattcattgctttcattatgttaatacatgttacatgctaagagaggaaattcatgaactccctccgttttcatgtaacatgtaacatattttgaagcgggcgcgaagcaccgaggccacgaagtggtcttacgagccccacaaaattagaanatgggcgcgaagcgcccatcttagggcgtaaagctgccctacaccccttnataactttcaaaaattcattgct

SEQ ID NO: 26719 - DNA, 1442 bp, Heterodera glycines
cttaggcctaaaatgacaaaatatgtagtaaagggacgaaggggaaatgcgcacccaatccattcggacagaagcgacacattttgggtgaacaaactgctggacaagccctggctggcctcgttgttcaccgcaacggcctcctaaaagagcgaatttacaacaacaaaaaacgaaaaacaattgacacggggaaagaaatgagaaaaattaattgtcgggatggaagcaaaaatgagcaaatcttggtaatttaattctcgtggcacctcaaaatcggccactttcactgcgtaaacaatgggcgcaaatgtctctctgagcaccaccggtgcgtcgtgcgcaagcccagcgatcaccgtgggcagcacgtaattgcccttcgactcctccaacactttgccaccgcacagaatccgaccgccctaaatacagatggacatgaaacaaatgtgcggagcagctcatccaccccactcccccccccccttctcacaatcactgtgtccccgatcaattctatttatttaaaaccgcaaatttttttcaaaaaacccaaacaaatagtatcaataaaaaatttttaaatttggtttttttttctaaaattaaaattattatgttgttttcttacagtggcaatggcctcggcaatcgccgttttgtatttgagcaccgactcgcgactgtgcaaagggccgatcaaagtgcgctcatccaactgaaagttgtggaaaaggaagataagaaaatgtaaaatttagctgagggaaggcacccataaaatcaaaaaagtgccaaaaaaataataggaaaataagaggtatctcattcaatgtcaaagggttggccaatccgttccccattaaaaccgggtctccgatgcgcgtgtccatcagctgtttgtacgcgctgaccacccgttccaacaccacgtcgtacactttttcgtgaataatcagtcgccgtgtgctcgtacagcgctgccctaaaaagaggaaaaaatgggtaatttcatttgcaaaagaataaaaaatattaccagcagtgccaacggaagagaaagtgacggcgggcacaaccaaactcaagtcggcgtcgtccatcacaatgatggcattgttaccgccgagttcgagcagtaactgtagaggaagtccaaacaaatatcaaaaaatggggagggaggagaacagaccttgccaaaccgcgcttggacatgctgaccaaccacacggccaacctcagttgaccctgacaaaagaaaaatggcagtgttatttagttaaattcataccggtaaatgagagtaaattgacccgagggtccttaacaaggcacctttaaagagaataggaaagagttaattgagagttattcgtaacaaaactgacattccgacgtcacgacgccacaaatcaatgagcaaatggcgggcgaca

SEQ ID NO: 26720 - DNA, 1561 bp, Heterodera glycines
cactaataaaaaggtgattctaaattgattcgaacgtaaatgtcaaattcaaagaaattaatttttttgctgtttaaaaaatattaagaaacaaaattaaataataatttaaattagatttatttatttttgaaaatttttttaaattttgagattggtccctttcaaattaatcaaattttatatgaacataaaaaaagttaaagattttcaaaattaattttctagcctattgtaatgagaaataaagtttttttcgcttttcatttaatttcaattaatttcaatgttataaattttttgtttttaccattttttaaacaccaaactcacaagtttcttttcacggatgtaagccacatccggttgaatgacagggtcaatggcacacccatcgatgtccaacttgaaaaaatttcaagttttaattggaaatttttaaatttttaccaaatcaaatttggaaccccgtccatcatcgacggcacaggaatggaccaggaattcgtaggccgggtcatcgcattgccacacatggaaaattttgtctcccaccttgccaagcctattttaaataacgtaaaactcagactattttaattataactacggtatacatctcatgctgtatgcttaatggatactgtaatgagcggcgtaagacacaaaaattactgtactattcataactttttttattataagtacggtattaaaatttttctcatactgtatgcttaatggctaccgtaatgagcggcatagcacccgaaaacttactgtactggtggcccttccggcgactgggcatggatggagtacaagcaggacggtgtcttggcagtgtctgcaaaatgccaaagcgcgccattttaaaaatttaaaatttttttttaaaattgcctacctaacaattccgtggtggccgccaggttcacgtcaattgcatttgtcaatgttttgatgttacggaagaagcacatgcagcgataggcacggtccgaacgtgtgacaaaagtgccatgaaatgacaccacaatggtcaatgaaagcatcatgccctccagcgagccggtgacgcgttggcgttgcactaacaaaataaaaaatctcagaacgaaaatttttaagaaaattttaattttaactaaaaattttaataaaaattctttttttggcacttttctgttctattcataaaacgaagtcataatatgacatctaattgacaaaaaattctttttctcacatgtataaattaactatttaaacaatgatgaccccgcaatttaaagagatgttgtctctgaatttgtgccattaaattatttttttcacaatttcgcttctttttctcggcatctgtgccatgttttaatccattcttgagattaacctaatctctagctctcaggctcggatgggaatagaacccacgcctccaccgagtttgtgggcagctctaccattgagctaccgggtggcacgccctccctccattccttttatggatttcgaaaatgtaccgcccatttcaacttctttacaataatttaaatag

SEQ ID NO: 26721 - DNA, 1512 bp, Heterodera glycines
  misc_feature (1383)..(1383): n is a, c, g, or t
  misc_feature (1417)..(1417): n is a, c, g, or t
aaaacttcccctctctgcgtgccattccccttcccacctgttaattaaattttgtagccaaccaaaattcaaattttggttctctccgtgccagttcccttctcgttgtcattcaaattggttctttcgctagtcttctcccttctttcaccacataccgcactgaaaatcgatcacgcttcgctaatggttccgccccttcacattttgccggaattggcgtcctttcattcgctcttcttctctcaataatcagcttttcaacaaaccgtctcctattacttcaatttattccctttttattgcttcaatttcttcctttttcaatttttcttatctctatccttttttcgtcgtgactttttctcctattgaatttatttcattttttctgctcaactttcttctcgaaaaatgtctcgcttttgccctctcgttgaaaccaaagaattgggacgtctttccgttatgaagggaaaattttgtgagtttgagatctctttaacttcagcacaagatttacaaatcttttacttgaattttaggcttttttatgccctcgaattatctcgtaattaccaactgatcgataatggaatctctaggaaggctttccgttattttatggaaacagagaaaaaacaacgtgaaatgactttcaaactgatggaaaaggcggggataaatggggaggaaaaaacttttggtctccaacatcttgaaatgatccaaatcttttgggacaaggaattccctgacatgtttcgcattgtggcctttgatatggtaaaaaaactacatactttgaaaaattttttattttccagagaacgggaatcaaaccaattttcaagggagagggaattcgtaaaaacgaagtatgcgtgataaaagaaggagaccactgggatgggatcaaatcagtgacgcagttcttgtgtgttagaaattattgtgccagctgtgaagtgacttgcgaaaggccggagagacatcgattggaatgtaaggaaagatgcaagaagtgctgtagaatggggttcgggtttccatgtgcggatgtgtgtgctgggatttattgcgcggagtgtaatcgcaacttctacaatacggaatgttttgagtctcacaagaagactgcttgtagggagtacaaaaaatgcgaaaagtgtggagagacacacaacacaaggaacaaacacacatgtggggagaaattctgccgaatttgtaaaatttatcatccaaagcggggctgtttcatccagaagttaaaaattcgttcaacgaggaaatacagaattgttgcatatgaccttgagacaacattgtataacggagtccatgcaccgaatctcgtttgcgcggcgttgacatgcagtngagtgcgtggaagagaaaaggaaatgtgagattngtgaggaaccgaggatgctgacttggtcggcagaaaatgtggagaccctatttgcgaattatcgattgaatatgggttcaacaatttgaaacggt

SEQ ID NO: 26722 - DNA, 1582 bp, Heterodera glycines
caagggagtgccaggtgaaaaaattaattattacttattttaaaataaacataccgtatttcctgaaataaagcccccaagggctttatttttcaaccaccttcaaaagagggcttttttctggggtggggcactattcggggagggaggggactgtattatcggaaatacggtaagtaaataataaattaattaatgaaatataattaaaaattataaataaacaaataaaactattttacattttactaataaactatatttttacagaactgttctcagattaacgacgaaaatgttggagaagctggtgcatacaaggaaaagcataacgaaagttcggatattttctcaaaagtttatggaattgctgtaagtttattttaataaaattaatataatttaattgataaaatttttctttttaaggatcaaaaattcaaggaccttttcaaggacaatgcatttcctactctggaaaaattgttcggagatgcaaaagctttgttcgtcaacacaacgcctttattggattatgacattggcagtttgccaaaacgcgtcaaattcattggtggcattgatctgatgcagcccgatcacaaggatgtaataccattcagtagtaaaacagtatacacagattaagaaaatcccatatgaaacatttgaaaaattgaaatccgagtctattccttatttctcttaaattaaaagcaaataatttttaagaaattgaaaacagtctcataataaaaatgatttgaaatttcgaaaattttcggcaaatcacgcgatgccgaaaactcagaaaaacgatattataattgtaatatttaaataatttccctaaaaattaaggctttaccgcaagtttttgggcaacaaaaaccggtgatcgtgttcagcatgagttctttattagaaccatccaaaatgccattggacaaatttgagacggttattcaaggacttggaatgtgtaaagaaaaggaagtgaaaaaatgccacggcatggttgggctaatccaccacggcccaagcaaaattcaaaaatttggaatttaaatttaccatttttattggcaaatttaatgaaaaatttcaaaaaattttccgatgggcttgggccaaccgattctttacgttttttcagtttttagcccccccccccacccccccgtaaaatacagtatggctggcctctgtctacggtatcatattgtaaaagtgtgccaccattttcaggcaatgaaaagacggaattggtgatcagcgaatgcgatattcgtatcgtaatggatgcgttaagcagtggaaaagcattgctttgtctgccgaacagttttatgtgtcggaaaagctgcgacgcatgggcgctgcggttgtgcttgatccgcgcagtgacagtttcaccaaggaggggattttcaaaagtatcggcgaagcattgacaaagcggtaatgtgcacgcaaaatccttataatgatactttataggggagttgctcgagttttcggctccaaagtcgaggaatttctcggctttttagggtcgagagtcgcgactctcggggtcaat

SEQ ID NO: 26723 - DNA, 978 bp, Heterodera glycines
aaatgaataaataaaatgtaattcaaacaataacaaacagacagtaaattggcaaaaatggccttttccctcaagcaaaccaaaatttcgattttgtcaagcaaatattttattccttgtaaattttggaatatataaaatgaaacatttggtcaattgcaatgggattcttttcctccccgccttcgttcactgcatgtcagcacgctgctcgtagaaatctatgaccaatttggggaatttttcagaggcgattcgggacgagaagaactgagccaaggaatcgcccttcaacttgacgagatagaagctgaaaatggaatcaataggaaatcgagatttttgaaaaattcttttgaatattttcggccgtagtgcacttcaggcatccaatgaccatcccatttttacaattaagccaaacttttttcatacttaatcatgcctaaaaagcttggtctatagtttttaatataaatactgcgctaaaaataataaacaaaaaattgttcctggacaaaaaagcagaatttcgtctcattgtatttttcttaatgtcaatatttaatcatttttcgcatttacaaattccgagactttgagctatcgtttgatatcaagatagacattcatcaaggaaaaaggttgaacttaagaaacgaaaatggtcattgactggacgcctcaagtgcaatagagccgtattttctctaaggcttttttttataacgaacatttcgctattcatccgcgctgcccccaaaatctcttcgacttcgtcctgggagggtgcgccctccacatccatcggttcgactttttgattttgcgtgttgaatttggccatcaagtcagcacagttcagattctgctccggttccctgagtaaagtcgtaaattgaaagggctgtatggaaaagaaaggttaaaaatgccataaaatgggagaatgctgcgggaaacaaaaaaaaaaaatca

SEQ ID NO: 26724 - DNA, 987 bp, Heterodera glycines
cgattttgacatcaattctattccacgtgaccagcggcactacaccattgaaagcaattctgttcatttctctttcaattattttttatgtaacaaaaattattaaatcaaaacatgagatgaaattttttaaaatgcaaatattttaatcaaatttatctttgttaaaccttttttatatctttgaacttatgattctaacagagacttaaattttggaaatacggaacgggaaatccgcgaaatcccgcggcgaccccgtctccgtccgggctctatcgaataaatttttttttattctccaaattggcacagattctctatacgctgtgcatcactgcgttatgggggcacgaaaatgagaacgcctgctacacattgttgtttttcattggcattactgatctgtcggtgttgtgggtgatcgggctgttccacggagtattggcgctggagggagccatgttttgttcacatccgaccctcatttatttgcttggcattttaggagtgggtatgtgggagaacaaagttttttcatattatttaaattaattattttaattttgcttgaaacgtaatgcaaatttaatcaattttcagcattttggtttgccgaaagcagtgcaaatatggtaaaaattgttttaattagtaaattattttttgtcgaaagtcagcttttggctattaatcgttgttttgaaacaatttcgcctaatatttgtaaaatgatccaattttggctgttcctggtctgtttgtacagtatctactgggttttcttccagaagccttgtttgttcaacggtatatttttttcttgttactttaatctaaagaatttaagaatgttcacatttttaaacaagtatgctagtttttgctttatttgtttttttgcataagtttgcggataagagcctaaacagtttttcaaattcatcggagaacatacatagaaaaaaaagaagaaaaaaattctgt

SEQ ID NO: 26725 - DNA, 950 bp, Heterodera glycines
  misc_feature (914)..(914): n is a, c, g, or t
  misc_feature (932)..(932): n is a, c, g, or t
atttatttgttgtatcgctcgcttacacccacaatgatgcctccttttttgtttcagccgatggcaattgcgtcttttgcactgtccatcgcgtgtccaggaccggccctcaccgcacagcagcggattgtccgtacacattttgtgcatgtgttcaggtgaatgcagaaaactaacaaaaattgggcacttgtaaaaaagagcgaaagtcgtcgttttgaaagcattttattttatttattttttttgttttcctatttaattatcattttttgcagtgttttgtggctgagaagtgtcctttgcttcggggtaatcaatggcgaattttaaagtttttacaaaaccaattttccaatttctcagattaggcaatgcgacactttgtgccgatggattggccaacgaagcaattcgtgccctgcaaaattattgccccttttcattatttatttacaactggcaaacaattttttcttaaattttttttcatttattttgaataaataaaaaggagttttttaatggacatgtgtcagagacgaattactatcaaacgaaggcctaagtgttatgacaaaaataagcaatggggctagtcgatcattcattgttgtcatggtattttggcaatttttcggttcgttttgcagtagttatgagtagggacgcgacttttagtgacgaaaaatcccgaaatagttaactaaaatagtgacgaaaaagtgccaaaaaagtgacaaaatagtgaaaaaagtccgaaatagtgacgaatagtgacataatttttagccaaaaattgagcaaaaaataatttttattcactgattgcagtcccaaatgagctacatttcctttataaaattctcttagcaaatattgacattttttaatcaaaaattttgtcagaaaanattttgggggaggaattntttgaaaaattttcaatt

SEQ ID NO: 26726 - DNA, 894 bp, Heterodera glycines
atatttcacagggacctgccggatccgacggacagcccggaaaccccggggagaacggacagccaggatcgcccggacagctcagccagggcccgcccgtcgttggtccacccggcccatcaggaccccctggccagcccggacagcccggcgagaacggacagcccggccagcctggcaaccccggcccgcaaggacagcccggcgacaacggaggccccggacagcccggcagccccggaggcaacggcgagcccggacagcccggcgggcagggagccggcggacagtgcggtcagtggggcttacaattgcgaaaattcattttgaattaaattttgaattttacgcaaaatttcagatcactgcccaccgccccgtaccgcccccggctactgatcagagtgatcagcagattttctgcggatgtcggatgctttcatcgatattgcttgatggcaatatcgtggcattgaatgaggcatgttcgtcgaccattgaagaatctcggcattagcttatttaaaggaatttttgtatatgatgtgccacattctctctctcttctttctcttttccagggctaatcataagccttcccaaaatggcacataatgttacctttttcggcatttttttgtccaagatttttacgtcttacgatttatgagatgtctctctcgatgatatatactagaatcgtctgcttataaccaagcgattaatccgttgtttaaagtacagagtgataacgtgttatcatcgcatctccatcttttctctataggactttaaaattgcgaaacaggataaaactaggcatccatattcgaccaagatttaaaaaaattaaaattaaaattatttttaaaaatattaattgactctcttttc

SEQ ID NO: 26727 - DNA, 772 bp, Heterodera glycines
caacacagaaaatgtttttcaattacagacattaaggtcaattcacctatcaaagagaaggggccaaacgaagcgatggacacaacgccaacaacagcagcgagcgaaaaaaagcggcgcaaaaattggcgacccatcggaaacaaaaaacggaagagataaaaggcgacaaatgcaggtgaataatacaaataaatgtgcttgaaattgagttaacggcgaagagaaaagcgcccttaaaaaacaaaattaattttaattgaatagaaaaacgaatgaatgccaattagggaaggggggggggtaattagcggacaaaaattgtttggccctcttgaatttattttcaaattgtgcaaaaatccattccaaataagcaaaaataggcggatagtccaacgtccattgggacaaatcggagcgatgccaatcggacattggcaaatggtaagccaaagccatccaattgcggtggaccttcaaacctcagcatttcgaaccttttttcaaatgttaaatgccacctcaaaatcagtggaatggtagcaccgaattaacaaacattttactgcgacaataattaggcaaaaaatgggcacgaaaggatgccgaaacagagagacatctttgttggccattttgcatctcacgatcagcaatactatgcatggacggtaaaaaaagaaaaaagttggaaaaaacgttggcgaaaaaacaaaatgccaattcaaatataaaataaaatatgtaaccataaccaaacgtgttaaag

SEQ ID NO: 26728 - DNA, 981 bp, Heterodera glycines
tggttttggagccccaaatttgggcgatgggaaggtgggccaggcaaaaaacatttagtgggattttaatgagtcatttatttttccaaaaaaatgatcaaaaattattaaggccaaaatcaccacgttatttggaagacgatgtgttcgtgtgcgaatatcagatcgatcggaaccagcgcagctttgagaaaatcccgccgaagaatcgctactacatcaacactgagccatttgtgttcaactttttcgagaagaaattgacgatgaaaagggattttacggtaggtgggtggtggatcggaaagagtacggtagattgacagttatgttgttcaaacattgtaaggattacggtaattaaccgatacggtaaggggttcatgcagcggcgggtgttcacattttcactatgctagcatatgttgtgttcatttagctgacttttccaattgttacagcctttcaaaatcaccgcttcttccaccgaaaacaaaacttcgtcctcatcaactgctagcaggacagactgctgctgcacaacaacatcgccgctgttcaccaacagtctgatcagacaacggattttgcagcagaatttggagtccgtttgctcaaagatcagtgcccaaaaaattgcggttggcattggcaccagcaaaagcattgcttaaccatcatcactgatcagcagcagcagtggccattgatcgactgatcgccctctccggtgtttattctcctcactgtctcctctctcattgcgctctcccaaaaattcttcaactttgcgtgatcctcatcaattctcactctctcacatggcacttttctcgtccatcagtacgtttcgtaattctcccctattgattaatttgatgatcattcctccctttttgatcacttttccccatttttacttcaccaaatctcttttctatcatcgctttttaaacgcattttattcatcccaaagaattg

SEQ ID NO: 26729 - DNA, 912 bp, Heterodera glycines
ttccgagtcccgaaaaaaaatcgaggtcccggtcccggcttctcaggtcccggcaagtcccggtcccggttttgcccaaaattcccggtcccggcttctcaggtcccagcaagtcccggtcccggttttgcccaaaattcccggtcccggcttctcaggtcccggttttgcccaaaattcccggtcccggcttctaaggtcccggcaagtcccggtcccggttttgcccaaaattcccggtcccggcttctcaggtcccggcaagtcccggtctcggttttgcccaaaattcccggtcccggcttctcaggtcccggcaagtcccggtcccggttttgcccaaaattcccggtcccggcttctcaggtcccggttttgcccaaaattcccggtcccggcttctaaggtcccggcaagtcccggtcccggttttgcccaaaattcccggtcccggcttctcaggtcccggcaagtcccggtcccggttttgcccaaaattcccggtcccggcttctcaggtcccggcaagtcccggtcccggttttgcccaaaattcccggtcccggcttctcaggtcccggcaagtccggtcccggttttgcccaaaattcccggtcccgctgcactctacaaaatacaaaaattatgttctttcaaaaatttcttattacaaaattccattttttttttcaaaacatagagaaatgttagcaaaatcactaaatttttggttgaaaataaaaaaagaataatgtgtttcagatttttagatactcgaaatactgattttttgggtgtagataaacttttgaccatgaccgtatccgtacataatgatcgatcatttttggttagcaaaaattcgttcacttttcttccacagggctcgggatttattttacaatcgtctaa

SEQ ID NO: 26730 - DNA, 877 bp, Heterodera glycines
  misc_feature (838)..(838): n is a, c, g, or t
  misc_feature (852)..(852): n is a, c, g, or t
aagcctaattacagagtgtgtttttgctcttttatcaaacacaattaccaaaactttgttacgaccgggggcaccccaaaacgtcgccggccggaacgtcgccggaagactttttggaccataactttgttcattgtaaatcaaattaagcattcttggtgttgttcgatagctttatgtgtttactattaataggctaaatttaaaaaattttcgttaagtttcaaaaaagttatggccagaaggaactcaaaaacctagtatttcgaacttttttgctctgattttttttgtacattaataaaaaaaattttgaaaaatttgtagattaatagagtttttcataaactttggaacaataccaagaatatttaatatggttgagtaggaaaaaagttatggtccaaaaattcgcccgacgacgtttcggctggcgacgttttttcctgatccggttacgaccatgaatagaaaaaacagtaatttcccccgttgttctagcctcgcgctgtctacgccaatgacgaattcagagcgacgacggttctatatacatcaccgttttcgtttttggtggcgtcccagaaggaacagaagtgaagacgaacgtccagaaacagacgtttacagtgacccacgcttatggaataaagaagacggagaagcaatacgaattgtccagcgaattttgccatcccaatatgaagtgagttcttttcaggttataaaccacgcttatggaataaagaagacggagaagcaatacgaattgtccagcgaattttgccatcccaatatgaagtgagttcttttcaggttataaacaaaagtggatggngaaacccctactcnaaaaaaaaatttttaaaacaagaca

SEQ ID NO: 26731 - DNA, 979 bp, Heterodera glycines
  misc_feature (840)..(840): n is a, c, g, or t
  misc_feature (882)..(883): n is a, c, g, or t
ccggggatctcgggttccggggggagtatggtcgcaaggctgaaacttaaaggaattgacggaagggcaccaccaggagtggagcctgcggcttaatttgactcaacacggggaaacttaccaggtccagacatagtaaggattgacagattgagagctctttcttgattctatgggtggtggtgcatggccgttcttagttggtggagtgatttgtctggttaattccgttaacgaacgagacctccgcgtgctaaatagtctcgcttacaattttttgtaggttttgagacttcttagagggacttttgggtaatcaaaccaaaggaagttggaggcaataacaggtctgtgatgcccttagatgtccggggctgcacgcgcgctacactgatgcgttcaacgagtttacaaccttgatcgataggtctgggtaatcttttgaatgcgcatcgtgctagggatagattgttgcaattttcaatcttgaacgaggaattcctagtaaacgcaagtcatcagcttgcattgattacgtccctgccctttgtacacaccgcccgtcgcacctaccgattgaatgactcggtgaaaaattgggactgtgaactcgtttgcttcattgcgaatgaattcgtgggaactttttttaacctcgccatttagaggaaggtgaagtcgtaacaaggtttccgtaggtgaacctgcggaaggatcattaccacacctaaaaaacttccatgtgaaccgttctacttgttttgtgcgcgactgcgaaagcagaagtgctgaacgaaggttaatgttggcgcaagctagcattggctgatgaacttttanacccctttatacctaattactgataaatactctaggaacgannagtcttagttttaattagacaaacactttcagcagtggatgtctaggctcgcacatcgatgaagaacgctgcgaactgcgatacgtaatgcgaatt

SEQ ID NO: 26732 - DNA, 951 bp, Heterodera glycines
  misc_feature (829)..(829): n is a, c, g, or t
tttcagtaaattaaacgaaatttaaatggccaaataaataattacaaaaatgaagaccccacggctttcctagaatttagagatgcattcaaaatttggcgtttgctttatcctcctttttgtcatcgcttgggcaattgctgctccgaaaaagggctcacaagttgaaaacacatggcgtagaggtgtaactgcaaagaaaacatcagcaaaaagtgccagcgaaatgtccgaccgacgacgggcggcgaatgcgccagcagaaacgtctcgtaggccaacagaaaatgatgacaccgcttcaaagcagcggctggcgggcaaaagtgccagtcagcgagcagcggctaacagttttatgagtttatccgaggaaagggatgaagccgaacagagtgggcaccaatcgcagacgccgagcaaaaggcaacgcttggtcaaagcggtgaataagcagcagaaacaaccgaagaagccggagacgccacgccggaagctgatactttacagcagcgatgaggaggacgagcagatgccgcagaggacactttctgctacagggagcacaccaaacaatttgtcatccgccgccaatgcttcggtgccgttgtcttcccgtcgcatggacaactcatcgtcggcacaaaaggaggaccagcagcaaatgggagatgatcatattaggttgttgaatatgttctgtggtagtgactaaaaactttacatataaaatcataactattaaagtaataataatcattattaataataataataataatttaatttgtcagattatttttaaaaatatttctctatcttttcgcanagttaccagtttcttctcatagttgccaataaaattgatgaacaaacattattcgaaccctaattgtttaattgaagaaaataaaaagcaaacttgatgaataatttagcatggaatgaaat

SEQ ID NO: 26733 - DNA, 611 bp, Heterodera glycines
attcagaaggcatccttcctagtttgtgcatttgaaccggtttcttgcatatttcgtaatttttcgaaaattgaattttcgaatttttattcgaatccgggtcaggggttcgaaatgggccgaaatagatgttcgaatcgtattctacgacccagaaagtccattaaacggtactcattgggtttgggtccgcttttttggtcgaaatttttcaaagtgtatacatgaacaggataaacagtggactatgtccctgctgacactccttgatacttaactggcgagctaggacaagaacgggccctaccgcgtcggctcatcacggccacggatgtagcagcaagtacaaacacaccgctagttacggcacgtaagaccgtgaacgaaaccaccatccccaggcatgaggtatgtgcctgctacaacaaccgctcaacgacgcacagatgccagcacaggcggtaggacgccccacgagcgtgtatcccacattggcgcagtgaaccaaccaagcgaggtggtccgccaccgacacattgcctacctggcagccatacacaggctttcacatgtgcagcactgagcggtataccacagctccaacgtatgga

SEQ ID NO: 26734 - DNA, 316 bp, Heterodera glycines
gtttgttcatcccattcaaattgcaattaatttaggccgctgtctctaccatcagatcaaagcgacggaaaagtgttctcgagtctcgccgggcccagtgatcagcggaagaagaagaagtgaccattcgagaaatgaccgatcattatgaattttatgctgattaatgttgactattcttttgttctttgagctgttctctttctttgattttttgcgtccaaatgctttttttgaagaaaaaaaattctgatatcaatttattatggaaatacaaatttttttggaatatgtatgggcacaagggcgtaggcag

SEQ ID NO: 26735 - DNA, 877 bp, Heterodera glycines
acggactgacgatgattttgtattaggaaaatttgagaaattttggtcgaagtttttccgttttcaaaaattgccggcagaaaatccggcatatgccgagaaaataaaacccagattccggacagagctccggaaaaattggcgatcggaatttggcttaaatgcatttttagtgccatttttgcaaaaataaagcgtcgccggctttttagcagcccatttttgaacagaaattggctccaaaaatgaaaatttctataatttttgatcaaatcaaccgcattaaagagaaataaaattcagaaaattatgcatcgcgacgtgaagccgtccaacattctgttggactggctgggaaacgtcaaactgtgcgactttggcatcagtggcaaactgatcgagtcaaaaggtagggaacatttttgttcgtcattccccgccatcacttttctccaaattctttctttagcatctacaaagacaggctgtaccggctatttggcggtgcgtttattttttttaatttaaaaaatcatctaatttaagcccgaacgtgtgaacatctacagcgactcgtccggccaatacgatgtgcgggccgatgtttggtcagttggttgattgaaacaacagaattatgctcctaataaagcatcttcccattttcgccaaatatttcttcaaatattttttgttccaattttttattagctgcagcaaattgagcagtttcggtgatcaaaaacataattaaaatgaataataataaatttattttcatttttaaatggttgtacaatttcaaatcggtttctaccagggcccagggctaaaaatgcagcaaaaaaaaagttaaaaactaaaaatccgggcccta

SEQ ID NO: 26736 - DNA, 1009 bp, Heterodera glycines
  misc_feature (803)..(803): n is a, c, g, or t
  misc_feature (807)..(807): n is a, c, g, or t
  misc_feature (949)..(949): n is a, c, g, or t
  misc_feature (967)..(967): n is a, c, g, or t
cgaaaattgtgaagatcaccgaatggcggtagggaatggcaaacattattgtctgagctaataatgagctatattaacccaatgccccacttaaaattcaaatcatcaatttgtattttttaaatatagatataatttatatatcaaaaatattttattttttcattttttaaaaataattcaacttttatatggcctagtggataattctggcccagtatagaaatttcgtcgttccgggccagggattgacgaaatttcgtttcgttttcgtttcgtactatattttaggcactttttgagtttcgttttcgtgttttcttttcgtccaccaaagagcttttggaagatttttttaaattttctaacgaactatttatccctcggtgctcctgtctttgtcattttctggaccaattctagcagagtcattattttcccagctcttttttgtgcccctttctcgagtcagttttattggtttttcttcgctgatttatagggtatcgctctcgggaatgcgaatgcctattcccggctcaattccccggcaaaaaattattcctcgcacatccctcttctcttcggcggacaatcacaagacaaacccgggggttggtgttaaggcgccgatggcgaaggtgaccacgttagtcaactgcaaaaatgaaaaatgagtaaattttaaatagcatatttcctaaaatagagccgacccccctaaattagagtccccgtgaaatagagccccagggggtttgaaaaattgagtcctacccccaccaagctttatcccccattanaggngattgaacatttgtgccccctgttatccaattaatttctcgctgtttatgctgtcttggatcgaaaaacgtggcatttgaaacaaattttgggcaacacccaaaatgccgggggaaacggtgccaaaaccgtacccatcacnaagtattggaccagaggnataattgtggattttgagcaatagaaatttatttatttttta

SEQ ID NO: 26737 - DNA, 1133 bp, Heterodera glycines
aaagaatcatttaaaaaattgtacacgtttatggaaattttttaaattgtaaataaaatttttaatgccatttttaattgaaggtgtgccctcctcaatggacactttcattggactgatcgacgcagtggcaagcgtaaaacggcacattgagaacgagacgaagcagcaacagcaacaacagcagcacaaacagaagcaatcggtggtcaccaaatccaattcgaacgcatccaaagagagcagcagcttaagcgtggtaaaagcggcgcaaaatttaattaaaaaatatttaaatttttattttaaaaaactttaaaaattatttaatttaaaagatttattttaaagtaattagaaatgcacagtaaaaacattttattttcaactgataataataaaaagatgaattttttttttctcgaattttagactttaaatatttttttttggtttttactttttatcaacaaattttcgactttcgactaattgtatattttttcaagttttaatcgctcaatatctttagactaaacatacatacataagagatacgaaaaaaagacaataaaaactaaagccaaataaattttactcccatttgagaattttttgtaattttgtttaaatttgccaaaaaaatattagtaaaataatcgaatcttttcctcttgcatattatcttatctatcctattgtttagtgtgcttatgttcactttaaaaagaattattgtattttatatacagatacatattttggtgattaaaatttgttaaaaaataaacaaaaatatttaattaatgtaggaaaaatttaaaaaattaaaaatggcaattttcaaaaacagttaaaaatgtttcagtccagcgacacttcaaaaagggatcggacacaatcggcgaacagtgaaaatgggtggacaaagaaattgcgatttgaatcgcacaacaacaacgagaacaacaacaaggaacagaaacaacaacagcgccagtcctccgcctcttcttcatgttcatcgacggaagggtgggaaaaatgaatggaaattattgaaaattaaatttgaaattatatgacaaaaaacaattaaaaggtgggtctgtgaaattaggaaaaaatctgat

SEQ ID NO: 26738 - DNA, 872 bp, Heterodera glycines
cgcaacagtaacgtacagatttggctgttgtcccgcttgtcccacacccgaaagctgctcgggtagccgacaaacagacgcccgccggcaatcttcaagcattgcggttggcccggcattgccatctcgcgcagcggtttgtgacgtcgctctttccgattgatttggaacaccatcacacttttgaggatggcacaggcaaagtagtgttggccaagctgtgctccatgcggcgcggtgctcggcgaatggccgcgtcctgcgcgaattggcataatttaatttaaaaaattaaatttgctaattacgcgaaaaacgcgagactttcaaagtttgtgacaaggtcccgcgaacatagaagaaaataataaatatttttttaaagattttaaaagaattataagatttgaaatcatatgaagagaaaatagtgattttactgttttttaataatttctagggtttttctgagtttttgaaaaattttagattttttgggttagataaaaaatccttaagtccccttttctgaaaaattcattagttttggtgtttttataatgaattctcagaggaaaacgatgtgggggtgggggtgggggaaggaacgtcctgctccgcccatggacgacgataccgggtccccgtggaccgatcatttttgagaggggggagggaaccaagacatggagggatctggataaaccgaaatatttatcaaatcaaagcatcactttccaatgtggcttacaattaaatgattttaaatcaattttcttggcaataaacaacacccaccccaacaaagcaaatggcatcccctggtctcggccactttgatccacttcaggtcacgcccgtccagcgcagcg

SEQ ID NO: 26739 - DNA, 917 bp, Heterodera glycines
  misc_feature (25)..(25): n is a, c, g, or t
  misc_feature (872)..(872): n is a, c, g, or t
tcataaaataatcgcatatttttancaatttggattaaaattaaataaatatttaggctaaggaaaatttggtggatgcagtgattgatgggatgaaagttcgtgtggattattcggtgacgcgcggcggtggaccacagtaagttgggggaaatgggtactgtaaataggcacaaaccaaccaaacccattgttgacaaaatttgatgtctttttggtcagtcctaaccaccaaaactccttggctttccaatttgatcccaacccaatttattgtccccaaattccatggggttttctaacaaagccaaaacccaataataattgtatgtgtcgcgatggaaatgaaattccgtcgcattgcgttaaataataataatttgctctcccccctccttctcccctttttgtagccgtcatgtgcgcaaaagcttctcgcgcagtccggtgcgcaacaaccgtagccgcacgcgcagccgttcccggtccgagtcgcggtcggtgtcgcgttagaatggtgaaaagtgctaatggtttggagaaatgaatgaatgatggaggaggatgaattgattgattgacaatgattttgatccgctttttgtggtttatttattattggtctgtcgaatcataaagaacacataacgtatgcacagaataattgtcgtctgataatttttgtttattctcccttcacttttaaatatttaataattttacccgatacttttgggttttctatgaagttttggttattatcttgggcatggcttcattttactagcattttcaagctaaaaatgggtctgttctgcagttcacaagatttttcctcgatttactagtgacaaagtacttttaaaatttgngagaaaccaataatgatcttatgcaaaaatcaatacaattgcacg

SEQ ID NO: 26740 - DNA, 696 bp, Heterodera glycines
aaatttcaaaaatttcgttaagtttcaaaaaagttaccgttcgaggaactcaaaaaaccttgattttcgaacatttttggccataactttttttaaacttaacatttagatctatcgaatgatagcaaggattaaaaatttggtctttttagagcaaagttataagcaaaaattttcattatgatggttttttaagtaacgcccattatgatggtttttaagtaatgacatagcaccctaataaagtactgcgcttctattttggtctcgtcaaaaattagtgttaatttccctgtgttggaaaaatgtggttggtgattctggaaaaatctggccttaattatgggatgatttttgccgtttttaatgaacattttgactcagtttttagtgtttcacattctttttttatttataagaatggaaaaaagcaaattatttttatactttccttcatttagaaatttgacgtttccctcttttgaaaagtagattttctaagttttaagggcttatttggaactcgagcttgaagaaattgtactctttaaaaactatttttggtctttgcatacaacgtgttcgactttcgaaaaagataaaagtgagcatgaaaagtggatccgccgcattcttaccatatctttcttggaactatttttaagaggctttttggctcccctaggtaaatatttt

SEQ ID NO: 26741 - DNA, 1006 bp, Heterodera glycines
tctcctccgagtaaaattgtagggctattgaaacctctattgaacggtgtactacttactatatataggttgtgagaataataatttaaaaaggcagccaaaaaacatgtgtttgctccttgattctaaaaaaccccagattagttttggcgaattggtgctttttttgcgttttttccgaaaaattccattaaaaattcaatgaaatcgggaaaataaacacctaagaaatgctctaaaaaatttttagaaaatataccattaagaattgaaaaattttctcaaaaattgttcgccaaaattcattttttttcttcataaaaacttttaggtttataaacttcctattgaaaatcattataaaatattaatattcatttaaatgatcaaaattccggcggtgccgataggcgccgccgggaaatttttttgtaattttaatgctatttgttagcagattttgtctaaaaaataccaaattttgagattttgggctaatttttttaagaaaagataggttttggtggggggccggcggtgccgataggcgccgccgtgggaaaattttaagaatttttaatgaattttgttaaaaaatggccaactgatttttcataaaagtcggtcgattgtttcggttttttgattatttcggtcgaacggtttcggttaaaaatcgaaaaaaaccgaaaccgaaaaaaaaccgaaaaactaaaaaatttctcggtcggtttttttcggtcaaaaaccgaaaccgaaaatcgaaaaataccgaaaaacccgaaaaaaacccgaccggtccgatctctaccaaaaattcgtccgtgacgtttcggccgacgattttttgtcctgctccgtggtttttagtgatatatcttaaattaaatttgatacccaattgttggcattaaaatattgaatattgacaaaattctttgaaattttacaggctaataaaaaatttgttaaggctaccatatgatatcatgaatttaaaatttta

SEQ ID NO: 26742 - DNA, 286 bp, Heterodera glycines
tataataacgctgcggacatctacatttttgaattgaaaaaaaattggtaattactctttctttttctccatattgaccatcatactcatactccccccacccttttcttcttccgccacccacctcccccgctacgcgccgctcccctccccttcgtgctcctctctgtaccgatgaatggggcgaggaaacgacaatctgatccccatcaagctagcttctgcaggtcctgctcgagcggccgcccggggatcgatccccgatctagtaacatagatgacaccg

SEQ ID NO: 26743 - DNA, 755 bp, Heterodera glycines
aaaaatatccatagttcttaaatcacatatgtgcagcactcatagcatagaaatcttatctcagcaactcataatatctttagagatgggcatatgaataaaagtgcatacatttatatatttataaatatacattgacacataataattttctccttaaatatacacattagaaggaatatgcaaaaaatatccatattcttaaaaatacacatatgtgtaggcagcaaacgtatgcatagaaatcttatcttagtaactcataatattcatagagatgggcatatgaataaaagtgcatacatttatatatttataaatatacaaagtgcaccttcataaatatacacatgcgcaggaatatgtataaaaatatcatattcttaaatatacatatatgtgtaggaatacatatgcatagaaatcttatcttagtaactcataatattcatagagatggaaatatgaataaaagtgcatacatttctatatttataaatatacatttacaaatgaggggtcaatttcgtaaatcgtacggggtccgaggcaatttcgtaaaaatttcggctaaaatcaaaaaagctctggtaaagatgggaaaattttacgaaattgaaaaaaaaaatttaaatttgtgccaaaaacccaaaatttttacgattttgaattgcatttcgttaaaattttttcgaaattctatttcctttttcgtaaattttttacgaatgaatttcgttttcctttttcgtaaa

SEQ ID NO: 26744 - DNA, 715 bp, Heterodera glycines
  misc_feature (651)..(651): n is a, c, g, or t
  misc_feature (672)..(672): n is a, c, g, or t
  misc_feature (696)..(696): n is a, c, g, or t
atttccaattgttcaaatgaaagatcggttaagtctttattgtgtatataagctaaaaaaacaattttccatcaaattttttccaatttgttctttttgcttccatcttttgacccgtccactttctattgcggtttcggttttcccttgccgcttttctttttctttccaaataactgaggcagcgagaagcgagaagtactgctttcggcggtcttaaacttcaatttatatttgcaaaattaaaattttttgttgtttacgacggcagatgtcttcgagacagtgcgagcgcggctggtatcgccgggagaagaacgacgtgcggcgggcttaaactccagtttacatacgtaaattaagcattttatttttacgccagcagatttcttcgagacagtgcgagcgcggctggctccgccgggaggagaacgacgctcagcgggcttaaactccagtttacatacgtaaattaagcattttattttcacgctggcggatttctccgagacagtgcgagcgcggctggctccgccgggaggagaacgacgctcagcgggcttaaactccagtttaatatgtaaattaagcattttattttcacgctggcagatgtcttcgagacagtgcgagcgcggctggctccgccgngaggagaacgacgctcagcgngcttaactccagtttacatacgtnaattaagcattttattttt

SEQ ID NO: 26745 - DNA, 1188 bp, Heterodera glycines
agaacgctttaaagcagattttgcccactaaaaggaaatacatgcttttcataatctttttatttaaattaataaaaaaatttcgaaatgttctgattttttgcattaactgtcccaactttagtctttttttgcggggggcgggggcgggggagaattagagttgctccagagcagaaaatctatatttcaaaaacgaaatccgaaaaaatccatgtatttgcattttttttataaaagtaaacatatgtatatgcatgtccacaaagtaagcggatttcaccgttttattttatttattgacgaaaaaaaaattattcattttgtctgtcattttgttataatgtataattaaattccatattttttgaataatattaattaaataatttccaaatttttttgaaacacaattttaaatgcctcattttaatatgtgtcgtttagctgacctttaattaaaagttttaggcttttgcctaaaaatgtaatccctagttgctatggtgtaactcagagctgtgatctcaaaattttgaaaatcctcatttcagccgtaaaaatcctcatttgccactaaaatacctcaaaaaaatcatcatttggcatgaaaaattctcattttttaaaacatcataaaatgcatacaaaatcagttagctgtcatatttttcatttgaaacaatcaaattcatcaatttcttgtcatttataagcattttatggaagtctgagcacgaaaaatcgaagttgcacttcacttgggccaatgctttcactgtgtccatgtgtaatgaattctgtttatctgtccactgagacccacaaaaaaattgtttttttttgtggcacggttttccaaaaaactttttggaaacattgggggagggagtccggacagtgccgataggcactgccggaaaaaatttggaattttgagtgcgatttgttaacaaattttgtcaaaaaaaaatgattttgactgaggatttttcgaaaaaatgtttaaagatttgaagaaaaagttcgaagattttgccaaatatgcctaatttttcaaaaaattatgcgtttttgtcacttttttatcaaaagaccacaaaaatacgcaaatcctcatttttcaaaaaaatcctctttgaccctctaaaagacgaccacaaaatgtgtaaaaatactcagatatca

SEQ ID NO: 26746 - DNA, 420 bp, Heterodera glycines
ccttttgttttgcaaaattttttttgtgatagtcataaaaatttattctttggggtttttggggtccccgatcacgaatccttcaattattttgatcaattccgatttcctaatctaaatttgaacaaaaaatcataattttaaaaattcaaaatttcgatttctattcgagttcgggttagggattagaaattagtcaaaatacatgtcagattcgtgattagcgacctttaaaaccccggataaaaaattatcatggttttttatcttaaaaaaattttgcaaaacaaaagggtccccccttttgtttcaaaaactgtcactttccatatagtgccgaaatcattatcaatgaatgacttttgattgataaacctaatgaatgcaaattcagcgcggacaacaggtggaggcgcattg

SEQ ID NO: 26747 - DNA, 1373 bp, Heterodera glycines
  misc_feature (1342)..(1342): n is a, c, g, or t
  misc_feature (1365)..(1365): n is a, c, g, or t
catatgctttaccttgttcgtctgctgttgtgacgactgtgcactggcggtgttcacatgtccgccatggcacaaataaagcgacgaggcgaggctggccgagcagtccaacgggcatttgtcccgcttctccagtgacagcaaatttggacacgcgtccagccgaataagcaactgaaatgatgcttttcaattgtcaacaatctgctgtataataatgctatgtgagaccctttctaaaagcaaatttgttgaaaacatttaatattttttaattttctgtgccgcaccgttctcagccatcctgggaattgcgcggcacgttcgcatgcctccacactgaagcgcacccgtcggttggtatatttgaatttgagcagcatctgcagcggcactttgctgttccgatcggcgcccaccaacaggttgatcaactcgcggacgccacgcgtgccgaggccggccgcgcacgcgagcaagtccttgaccagcgtactgatcgcatgcggcaacggagaggacgcgtaaaaggcggggagcgcgcgcactttgtccgcgatgagaaatggaccgcaaaagcaattggcactcaaataaatggggggcagccacaggtcagctgcaaaatgggtacaacaagcataaattatgaaattattccatttcctcatctaaattcaacccaaaaattacggtaaacactatttttagtgctgcttagccggggagcagttcatttatcccctcccataaaaagtttcctaaaaatttttcaaactttgaaagattaaaagatcatagaaaattctaatataagaaaaatcaagaaattttttaaattttttttttagtttttatgattctcttatgcaaaaattctatggtttttaaaaattttccaagtttgaaacttttaaaaaaaattcggggtgggatgtagtacggcttacaattttccacctttgtcaaccattttcatccctttgaatgcccatttttaattgcgactttggccacttgcctttgagccacatttcgctgagaaatggcttttgccgaggcagaaacaccggcgtccgttgggaagtgaacgtccggaggaggttgcgaccacaattggcactcagtgcggtgggaatgcgaattggcatagtgaaatagcgcaggagggcggcggcggcagcaaatggggcggcgccggacgcacttttggcagtgccgcaacggaacaattggggagaactgaagacggaatggaccggtaaacgtcaaaaaggttttcattttttaattttgaagcaaaaaacggctctaaactttcaaatttctcggcggcgcctanaaatttggatgccacggcatcanatctgact

SEQ ID NO: 26748 - DNA, 950 bp, Heterodera glycines
accaagaagaggagcattcaaaacgattgagcgaagaggttgaacttgtcaaaatgttgatgaatccggttgcagccacaagcagtgaaaatagcaaaactgcggttggcttcaaacggaatcaaaaaaccacacaaatttcaaggcattgtcaaaaggatgcaaaacaacgaaatttaacgctgatgagaataaatgtaatgacaaagatggagagcaaaacaacgattacggtagtgaagcggaaaaaggcggtgatactgtagaggaaaatcaaatcgaaacggaacaacaaattgaaaatgacgatgacaaacagcagcaaatggaagcagtaaatggagaacatattgcaacacaagtgtgtgttgaatgcgttgggaaaatcctaaattatttttgtcttaccatgtaaatttgttcgaaaaatatttaagaaaaaattttgtttgcaagcattatgatgggatgaaaattgaaaaagctttgacattaacgaaaaaaaatcttacagagtcctcctcctcctcctcctcctggtgttgatgaaaatacacccgaacctccacaaatcgacccaagtgattgtgccaaaaattatgatggcatttcactctcagaacaatttggggagcagaatggtggacaaatggaaaaggaaaatggtgagtgagctttaacatttataaccaaacaaaaaatatttatgttttaaattctaattacaattattatatttaatagtccagtcaacgtcgtcacctacaactagcagccatccacaacgtacaaatgaagttgattcattaacaataatcgatgatggacaatttattgcattggtatgttagccgttggggataattattgtagattttttcattatgttttgtcctagaaatgcaaagccaaatgttttattgttcttcgaaaaatcatcaatttaaatt

SEQ ID NO: 26749 - DNA, 847 bp, Heterodera glycines
ttttacagaaaagttttcctaaccttctaggatttttttcgaaaattttcctgatttcaagccatttttggcttttcagatcaccatgaaggagtgatctgaccaagttggtgtaaaagactttttttgatcagtagcaaaagttagcttagcaagaatttctcagaattgtttctctgcataaaatgatttttcatcgattaaaaattattttccatacttttgcacctgactgtataattttaactagtgacaggacaggatcggaatgacgcggattaaattcgggattcgtccttttttaaatttatcgggatccctcccggacatttgccaattggtacttatgtagcttaaagggcacttcccacatggattttaaataccctataagtatactttatgcctaattttcgtttaccattaaaaatatatttattattttttttaattcgatttttagaaagattcaaatacagagaacagtaccgaaatgctcaaatataattaattttatgagctgcttgtgtgaaagacagtatttttttatgacaacaaataatttcaaaaatttcaacttgcaatgaatgaaatttttaccttttaattgtttgttcttttcttatttcggatttcctgataatttaggtatgacaaaaccattacataaaacatccatgagctgatcagcagacatttccttctcacttttcgtccgtcgtcagcgatcattcaaaacgtgacaaaaagacgggggggggcgaggaaatgggcgagagatgaaaatgatcgaacgaaaaacaaacaaaatgaaaaaactaattaactgtccaacactcaaaaagca

SEQ ID NO: 26750 - DNA, 1241 bp, Heterodera glycines
aacgaactgattttatggccactttctataaaggcgatgtgcggtcgctgtatgaccgtaaacccagttttttgtatagaaaagggttgtcctaattgcaaatggatacagtatctgatttatttcacaacgccaacacgccgttgaaaataaaaacacaagttgcatgcgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaaaggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttaactgttttgaagctaagtcgggcatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttaattcacaacgccaacacgccgtttaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgtttaaatagaacacaagttgcatgtgatggcaaaagttgtgaaatcaaacgcatgttacggccatgaattgccgggaagtgaggcgatcaaattcataatga

SEQ ID NO: 26751 - DNA, 1023 bp, Heterodera glycines
  misc_feature (1011)..(1011): n is a, c, g, or t
caagaaaacccgcataaagtaggccaatttttgtcttttatgaaattcactaacgcaaaaagtcgtcaaaaactaataaaacggagatttaattttgttccagaattttcgttctttgccctatttttaaggttgtattcaaaaaaagttgctcataataaaggccatttcttttgctttatgaaagtttatatttgcaattatacatgcacttttgctccataattttataacgattatataatttagagctctaaatttcaagaaaaccgcataaagtaggcaaatttttttttgacttttatgaaattcactaacgcaaaagtcgtacaaaaactaataaaacggagatttaattttgttccagaattttcgttctttgccctatttttaaggtttgtatttcaaaaaagttgctcataataaaggccatttcttttgctttatgaaagtttatatttgcaatttacatgcacttttgctccataatttataacggttatataatttatagctctaaatttcaagaaaaccgcataaagtaggccaatttttgacttttatgaaattcactaacgcaaaagtcgtacaaaaactaataaaacggagatttaattttgttccagaattttcgttctttgccctatttttaaggtttgtatttcaaaaaagttgctcataataaaggccatttcttttgctttatgaaagtttatatttgcaattatacatgcacttttgctccataattttataacgattatataatttagagctctaaatttcaagaaaaccgcataaagtaggccaatttttgacttttattaaattcactaacgcaaaagtcgtacaaaaactaataaaacggagatttaattttgttccagaattttcgttctttgccctatttttaaggtttgtatttcaaaaaagttgctcataataaaggccatttcttttgctttatgaaagtttatatttgcaattatacatgcacttttgctccataanttaattttataa

SEQ ID NO: 26752 - DNA, 862 bp, Heterodera glycines
caactctatggatgcaaatagtcgaatttattacacaaatatatcactagcatagaagctataaaatttattgttctcttatcgtataaatatgcaaataatacagtctgttttttaattcggagctcaactctatggctgaaaatagtcgaatttattacacaaatatatcactagcataaaagctataaaatttatttgttctcttatcgtataaatatgcaaataatacagtcagttttttaattcggctcaactctatggctgaaaatagtcgcatttattacacaaatatatcactagcatagaagctataaaatttattttttctcttatcgtataaatatgcaaatcatacagtctgttttttaattcggagctcaaatggctgtaaatagtcgcatttattacacaaatatgccactagcatagaagctataaaatttatttgttctcttatcgtataaatatgcaaatcatacagtttttttaataaggagccaactctatggctgaaaatagtcgaatttattacacaaatatatcactagcatagaagctataaaatttatttgttctcttatcgtataaataagcaaatcatacagtctgttttttaattcggagctcaactctatggatgaaaatagtcgaatttattacacaaatatgccactagcatagaagctataaaatttatttgttctcttatcgtataaatatgcaaatcatacagtagttttttaattcggggcccaactctatgtgtgaaaatagtcaaatttattacacaaatatatcactaacatagaagctataaaatttatgtgctctcatatcgtataaatatgcaaatcataca

SEQ ID NO: 26753 - DNA, 891 bp, Heterodera glycines
  misc_feature (853)..(853): n is a, c, g, or t
  misc_feature (886)..(886): n is a, c, g, or t
tattttcactggggagtcagttgtcccagtgcctagatggtatcggttcgaatttataccttgttttttagacttatctgatcaagggctttcgaatgataccaaatttatccgaatttgaccgttttaaagggtcaagggccccccttttcacccaatttttcgagttttaaaccggttcaaaaaccggttttttggcatttccgcaactcgagagatatttttccgtgcttagcttctcgagacgaatcgattggtatatcatttgaccctttttttcacggggcgttcactacattttatccaaaattttaaatcctaaataaacttttaaaaattccttgaaaataaggcttgatttgaattatatagctagaaattttattgattggtttagatgtttgcaattactaaaacagcgaaaggcgccgacctgcttattcatcataatggctacaattattataaatcacgttgcgtgggaaatttcaatgggaaaagctcagggacatcacttaaatttggatgggaataatgctgataaatgctgatcacttcttcaattgttaacacaccagttggaactgaaatttgattgaaatggataattaattaattagcaaattaattcattatgaaatggatcattagtagagatatgtcttgatctggggcctttttgaaaactattaacgatatatttgtcgttaggatatgtcgtttatgaagaaattttttaaataaaaatataaagaaatgttgtttagcattaaatgtaacaaacaaatcaggtaaaaaaaagttttagaattagatagtacaaatacaggttagatttttattccattctganatttttattttttagatttaagaataatggtanatata

SEQ ID NO: 26754 - DNA, 1641 bp, Heterodera glycines
acgaaaaatgaaattgaaattttgcagaagttaaaaaaaagtgagtcaatggagaaaaaagcgaaaacgaaatatttttgaattttgcactgactgttaaaaattaaaaagtcaattaaataaataccgttttttaacaaagcaaagaatgggtccaatggatggccaatgtttgcggaaaaagttaagacgcaaagacaaatattcttaatgaatgaactttggcctcggccaatcaaagggccaaaaatgaaatgcctttttatccgattggccaattgaaattcgaacgttaaaaaagtggggggggggaaatcggcggcgacggattggccaattcgagtggcatttgccattgagagaaggcaaaggaacggacaaatgagcagctttcgtccgtttcgctatttgtcccttccgtttgccttccccgaggtgccactcgacggagtgcaaagatcgttcattcatttctttcgctttgcttttgtttgcccaattctttgtgccattgctttgtttttcaaaatgaattggattttgaaattaatcttttcataaattggccgcaaaattttgtttcttttaattttttcgttattttaagaatttatacgcaaatgaatggtcattttcaatttgctattttaattaattacttccgcacaaaaattgacagaaaaagggagggggaaaattaattatttttttttgtttactcaaaaagggaaacttttttatggtcataaattctgtcggtgtcaaaataaatttccatccgtcgctttttttacgttttgtgaaaataattccctttaaaccaatttattgtttaatatactctatttttgtttatattcgttgtaaaagtgaggaagatttttgatgtttttcattagaaagaatttggggcaaatgaaaaaaaattataaattgaaaatgataacatttattatgtatattaattaataattaagtaacatttagtcgaattcaaatgcattaattaattgaaattaatttaataaatcaattaaattctcatttcaccattttccatttctttttttcacctttaatccgcagaaaacagctgaaaaaagtgagcaaaaacgacttcagcaaatgaacagaaaaagtgaaaacttttggcatttcttttggcatttcgttggtttggccttctgaacattttcatttttattatattacaaaaaatttgaccaaagcaaaaaaagagggaaaataaaagaaaatttgtaatggaaaaagaaagaattatccgggaaaatatggccaatttcgccgaaaggaaagggacaattgtaaatgagggcaataaaagggccaatttgggcgaaggattggcaattaaaagaaacggcagacaataaaaggcacaacatttgcacaaaaagtgataatttatcaaacaaacaaaaatatcaccaaaaaataatttaaaaattcgtttattaaaaagaaaaaataaaacgaacaaaagaaaatgaagaaaagaagaaaggaaggaaaaggaagataaaagaaaggactagggaaaagtgatcagtgaaaaggccgaagagcgatcagtgcggcgacggaaggatttacaaaagagactccgacaaagtctgaaag

SEQ ID NO: 26755 - DNA, 1252 bp, Heterodera glycines
actattggctggagaccagccgtgagcgaaagcccgggctcggctaccttcaagaatcccgctggaaggtctgtacagcaaatgacctttaaacacacttcaattctttgcttgttatcaggtaaaggtcagagtgccgaagggtccgcttgccgacctcctcctggagcaactcagcacgccagaacaagtgcaaagaataatggtggagcacgaatttgtggagcccgattctgcagtggacaaccggaggaaaagggcgttggatgccgccagaaagattgtgtgtgttgagaagggcggtgtggcgtggaaaatggtagatgaaggcaaggaagagagtgaggagaaggaagaggaaaagcagcagcaggaaaaggatgagaatggatggccaactgaaaacaggacatgggagcagcagcatgccgtgttgggtaaagtgtcaatctggcgcgactacttccgcaacggcacgaacagcacgtccgccttcgtctatggtgccggacagcaaatcaaccaacaagatgggtcccttcgcagcagaatggccaaatttttgatgcgagacaaccaaagttggggcagtgatggtgcttttgaccgcgaaggacgtgatgcccacggcaggagacgcacacacctgcgccgcaaaaacgttgttagcacacttgagcgtcgatttgacaaaggggtgagcaatctatggcgttgaaaaaattgcatttgataaaaaaacaaaaactgaaaataaactggatgaaaaatccgaaaaattgtcctaagattttcatactatcaaaaaatgtaagtttttaaaaattcagtgaaaacagcgacttttcatctaaattttgatttaagcaaaaaataaatgtaaaataaccgttaaaaaatgcaattaaacactggaaatgagaggactaattgaatgtctaattttagagttggtcaagcaatatggaaaaagggaggcgattagagacactgtggacgagctcaagtaactgttttgcagagtttttggcaaagtcctatgaggaggacccagtacttctacagcgggtattggaagaaaatgaggaggacgaagaggaagcaattgagggaatttgaaatgaaggagggcatggttttagttcttgtgatgatgtgtgatggggaagggtgggggcggggtgtgaagctggtggggtaccgtttcggccagggccgacagtaccccaccgtggatcattccaaacccgtt

SEQ ID NO: 26756 - DNA, 1182 bp, Heterodera glycines
ttatttttttttaatcgaattatagaaaataatttgaaaattattttaccaataaattttcaggtgagtctcgcgacgatgaagacgaattgttggttgacaatgaagaaacggaggatgagcctgagaagtgcttttgttgtgatctgtcgaacaatttaccttaaaaagaatattatttttttttatttaatattttatacaaaaatttgtttaattatttttaggtgaaataataaaacaattttaaagtcggcacttacgtgccacaattatgccatggtcttgctcatttggtagaagtatgtcatgttcatcaagccgacatgaacaatttttacaaatttttctaaaaaacaattttaaggcataatttgtaaaaaattgtttttccaaccgccaaaagtgcaggtccaacccgggacaatcacaccgattgcacagcgacccgttgccaaattcatgcgatagaatatgctaaaatttttgattattaatattttttaaaattttaattcatttggattaatcaaaaataaacaaatgctgaaactataattataatataattttatttaattagttttaaaaattaacaatgcctttaatggtcgttccaattttggcacattttcgtccaccaccttcttctgttgttgaaaatcagatgaaaatgattcaatagacatatttacgaaaatgcttaaaaagaacaaacattaaaaacggaattaaaattaattaataattaaataaagagcaaaaataaaaaaatttaaaagaattttttatgatatgaaaagggaaagttcattcattcaaagttaaaaattcaaatttctattaaaatttaaaaattaaaagtaaataattttgaaattaaaaaaaaaattattttaaattaaattaaatgttaaaaaattgtttttaaattattttccaaatggatttgtgtgctggtgtgaataacagaagttcaatcaaactcataaaattggcgacgatttgaatggacgacaaaacgataagaatcgacgactcttcaagaatggagagagaacaaataaacatacacattaataatttgtacgcacaaaatcttgtacatattgtaacaataataatcaaaattaattaataattgaattatttagtttatttattaatattatttatatttaa

SEQ ID NO: 26757 - DNA, 1340 bp, Heterodera glycines
  misc_feature (88)..(88): n is a, c, g, or t
  misc_feature (1308)..(1308): n is a, c, g, or t
  misc_feature (1318)..(1318): n is a, c, g, or t
  misc_feature (1328)..(1328): n is a, c, g, or t
caatttggtcacaatattttcttagattgtgacgtccaatgatgctaattgactgcaaagtgtttaaattgttttatttcaattaatntaatttatcatactaaatattcaagattaagtgccgtagaaaatgaacaggtaagcaacattgagcgagtaatcacccaagagtggtcatagtttatcgtgttcatcaatgcgatggtaaacttaaaaatgaaataatttaaaatatttttaacaatttaaaaaggtacggttcatttcaatagggcttttgactcaaagcttctaaagcattggtccattctaatgtgaattgtattttcaaatttttttcttttgaattttgcgccgcatttagtgactaccgtaactcaatttgtgtttgcgagcaaaaatcgggacttttatggggtttttctacatatttacatatttcgagatttttttacatatttgtacatattttggacttttttcttgtatattttcatttttttttacatattttgaggattttttactatttttggaaatcctcaaaaaaaattcaaaatttcagcaaattttttgttcatattttcattttttttacatatttgagaagtgaaaaaataatttttttttttgtttgaaaatgtacccctgaaaaatagcaaaaagtaattttttaaatactaaagggtgggtgacctatttaagtcactttttaaggcattttgttccctatttcactttacgaggaatttttttttccaaaaaataaccatttttaaaaattttatttacatatttggggttttttgtacatatttatgtacatattttgaccacattttgtacatatttttggcagccctatttatatgaatttgacaccgttttatattagttaagtttagtcaaacaataacggaacctaccgtaatgccaaaccaagataaattgaaaaacacagagaaatttccatgtgaatttttgcgtactgtcgcaataaatcgttcgatgatcagcgcatgtccaagcaatcgacgaaatattgcagaaaaaagaacagtagactatgagtgaaaaaattcatattgccttgggcaaatatgtccttggaaaagaatttctggacaagcatcactgatcggactactaaataaagcacaaagagcatactttgagtgatcagaatgcttttcaggttggcatgcagcagtttggtgggcacaattatggccaaattcagaaaagtaatgaacaaagcagttaaatcggagatcagttcgaacgaagagaagatatgtgagcaaaaangggggacaantgtctgacgngggagacctgca

SEQ ID NO: 26758 - DNA, 366 bp, Heterodera glycines
  misc_feature (329)..(329): n is a, c, g, or t
actgatggccacgttttcgtacctgctgctggtcgtggccgagttgtgacaatggcacgccatgcgggagggcgttgcgtcgcgcgggaggccgaagtcctccgccaattgcgccgtgccaaatgccatcggacggtccgtcgccgcccattcgctgtgttccgtttccaattccgcgctttttgggttcataaaaacggccattgtgcagctggtgaacgacgaatgagttaaaagcggagaagaaagggagtaaaagcaaagtgaggcggcggggaatggccaatgacgacagagggcggctggaaaatggggaagggggggggggngagaggggggggaagttttccataaattggcataaag

SEQ ID NO: 26759 - DNA, 1087 bp, Heterodera glycines
  misc_feature (1063)..(1063): n is a, c, g, or t
tgaaaaactatctttttaacaagcctgtgcattgattttggctgcccagcaaaatgaaaaaatgggcaaaaataataataattaattcagacataattaattattgtttaaaattaattttcacggggaaatttacaataatattgtttttatagaaaagaaaatgaatttaaaaaagaattagaaattaaaatgatgcaattaggtaggcaattacaaaaaaaatgacaaaaacaaaaaaatcaattcataaaattgtttccgggaagaacacaaaaaaataataataaaagcaaataattatttttcgagatttttgaatgcatttttccaaaatcagttttaaattttggccatgaaaaacaaattaaaaaaaaaattgaaaaaaactttttaaaaaaattagaatgaaataagtttcgggaaaatttttttggacaaatcaccaaaaaatgtgttcgcatcaaaaaaaaaaaatcatttttgttaaagaatttccaaacttttctaaccgaccttgaaatacaaaagtttatttgaaaaaatcaaaaaatatataaataaaagcagtgcgattggattaaattgatgaaatacataaaaacaatcaaaaaaataagacatttttaaggatgagagaaccttatacaaggacaattcataaaaaaaggacaacagttggcagtcctaaaaagagagtctcctcaatttgaaggtgtgaaagatgggtgagacaaatgaaaaaaaaaagtaaaatgaaaatcgaaacaaaaaaaattgctgaaaaacaatgtcccattaacatccgcaaagggatttaagctgtttaacttcggcttttagaggcattaaaaatgtaaccatttttaggctcgttgaagacaaaaaatgttattgtaggttgtttgaatagaaaaaaaaaattttttttttataggtaggttgggtagacatgaaaaggcctgaaaatttttagaatttttcctctttttaatggaataaattgggcctcagattttaaatccgccgcctcgttacgactctgttttttttgttacagaantataaatgggctgacaatgagcaa

SEQ ID NO: 26760 - DNA, 844 bp, Heterodera glycines
gagccattggaccaatggaacttctgaaagggacaaaggcatttttaaacaaaatttaagtgattttaaattaaaaaaaattattttattttatgaaaattttttataaataaatttatgaaatttttttataagaaatttcaagaaaaaaattagtaatttatcataaaaagatttttttcttgaagaatctctaatttgaaaattaaaaaaaaatttcggcggtttttgtcccggaaagatttgtcccatctccttgtcctcacctctcccccgacggtcattgagcagtgctcggccgatttgccttcgggcacgcgtacgccgaagtgaacgcgcagccgcgcgttggtcagcccgcggtgctccgcaattgtggcgccagcgggaagcagagaaatgaaaacattgccgaacagacagtcagtgagcagagaagcagaggaacagtcagacacagcacgaggcgaagaaactgaagggcaaatttggaaaattgggtaatttatttaatcacagcaaggacgatgtgatttttgaaaacaaatttgggttgggaaagtattgttgcagttttgaaaaaatcagtccaatttcctctccctatcacccataaattaaaattgagtaattttcaatgggtttctaaatttgtctccactttttttttttggttgttgttaggaatgtcataaggaattgccaaaaagaggctgttgttcgcccagcccacgtcacttcacactgaaaatgattcttgaagaaaagcctccagaatttgagcgaaaaaatgcactttgagcaaattgcaaaaaaaaaaaattcttcggttcccccctcccgt

SEQ ID NO: 26761 - DNA, 969 bp, Heterodera glycines
  misc_feature (828)..(828): n is a, c, g, or t
  misc_feature (874)..(875): n is a, c, g, or t
tttagtcctttttcttttttaaattggttttatccttcactcgccgtcttttgacccaattaattcattctaaaaacaatgcgaaaattcggtttgatcaaattgagaaacaaattagcccaaagtatgtaaaattttaaaaaattgattatgcttcaaaaaaagttatccatgaagtttttcaaatgaattccaaaaaccaacccttgccccccccccctccggcggttaggggtgctttctctctctgttttctctctctctctctctctgtgttgtctctctgtctatcgctctctcccatccgctcgctctttattgtgatcgcttctcgcctcaaccagctctacttcacccaattggacatactgcgggctctcccaccgattttttaattttcaaaatacagtattatctacaacgagtatcgtatctttttatatgaaattattatttttgatgaaatcacatttcctattcattcgttgttaattttgtcctcggaaatgtctttttgtccactaacaattgagcatttctgtgattttattaattttgcagaaaggttgacactttgacagtttaataaacaaattttaatttatggtcaaaataatcgccatacttttgaatttattttttatacataatattttgcaaaactaaaataatttctcaaataaaatgaaaatatttaaatttcgggaaaagtaaaacaaagtattttcaaaggaattaaaaagggagagagagagagatgtagagaaaagagagtgaactaaaagagagagagggagggagagaaaatcggatgagagagtggactanaagagagagagggagggagagaaaatcggatgagagagtggactannagagagagagggagggagagaaaatcggatgagagagtggactaaaagagagagagggagggagagagagtggactagtgagaatgtttgactt

SEQ ID NO: 26762 - DNA, 1000 bp, Heterodera glycines
  misc_feature (834)..(834): n is a, c, g, or t
  misc_feature (878)..(878): n is a, c, g, or t
  misc_feature (964)..(964): n is a, c, g, or t
atatttttaaattgtcacgaaaaaatgatcttcacttaaatgctaaatgataattggacaataatgcttaaagaaatacagtatttgcaaatcaatttacgagttatttatttacttttcacgagttcagtaattacggattacggattgtccttaatcgaaatccatttaggccccgcttttgacgggagccgtaaatttcacggcggggggagcaggaggcaaagcaaaggtttggcacttcatttatttttcaatgccatttttgcttttgaaaataaatatgcaataatttcagtaccttcccccacccgtccatttttctcttttctttcattgtttgtgtattgtgtgctgtttattgttcaaatttctaacaacaaaaattctccccccccccccccctaagagattgggcccccttcgcctcccccgcgggggggggggggggggaaggatttcttcgacgttttgacggcggaaacaatgggcgcgatgggagaacaaaaatggggaacaaaaaagcaaaaaagcgcggcgatggcgacggcggcactatgtgaaaatgaatggggggggggatggacacgacgggggggacgaaattgtgacaaaaggtgcgattttgggggatttccaccgcctcccccctccgacgcctccattaaaattcttttattttcattcgccattctttttttgtttggctattgtcctacgaagaaaataaatggaaaagaaaattttgaatgggatttttcattctttttttttgaattgtcaaaacattaaaaacatccaaaataaaataatttgtgtgaagatggaggagancgatgatgatgatgatgaaatgaatgaatgggagcagcaaaagncaaaactttttgaaatgtaagggcaaatgggaagaaaatgatttgttaaattgggcgagaatttgggaatttttaagcaattaatncagagaaaatcactgataacctcagccatgcaagct

SEQ ID NO: 26763 - DNA, 836 bp, Heterodera glycines
  misc_feature (10)..(10): n is a, c, g, or t
  misc_feature (19)..(19): n is a, c, g, or t
atctaatttntgatcaccncaatttgaaaaaaagtcagttcaattcagaaatagtggtcagcaaatgtcagctaaattttcttcaaaaatttattttatttttctaaataaatgtttataaaataacaattttgttgatgaaagtatcaaatttcctctttttgtggttaagaaaagtcaataaattcagtaaaaaattcaatcgtgaaaaatggactaatgtgaactgagttcaaattgaacaactgctgttcatgattaagctaatgtgactgatttatggtcctaattttcaaagaacagatgagttcaattaaatatttgggttaaaatagacaatttaaatttatcattttatgaaaattctttaattaggaaaagattactttaaaaaatatataataataaaaatattaaattgtgaatttcaaagaaagtgtaaaacaattaatttgtaatgcttaaaatggccatgttttaatttaaatcccgcaaattatttaagaaataaatgaaaaaattgtaaatataagaatatgtgatttacgcatacattaaaaaaaatattgaatgtttttcgaaaaataacttttgcactaatacttttcagttccggccaacaaataaaaacatatttatttccgattgggaaatataatgatttttttttattgatggactctttttatgcctatgattgtctataaatacacgtatatcttttaaaagaaatgtgtattttataaattttagaaaatataataatattttccaatgattctttttccatattttttgtctatattttttataatcaacgaatttcattattatta

SEQ ID NO: 26764 - DNA, 1156 bp, Heterodera glycines
aatttttaacttaattgacattttttgccatttttctgtcccatttcccccgcccccttttttccgttttaatttcgttttccctttcccttaggatcgtcccccgttcgttcccccgcagcaattcgtcggaagtgtcggccccgaacagatggccaaactccgttccgagttggacattgtgcaggtcaatttgacggtgctgcgtgaattggtggcgcaaatgaaaccgacgaacgacggcggcgtcactgaagcgccggaggactttcattttgtcagagtaaggagaaaaccgcggacatttcccaccgatggccaaccgacaaatttatttatccatttatagggatgagtagcaaagaaacaaaagggtaattaatcaaaatacacaaaggcccctataaatttagtattatccattttagtaaacttttgccatccaactaaacccaacttcattaataataaatgcttagatttgataatctaaataaaaacaacgacaatttgagcatgaaattctaacggtggtggcatttcaggaattgcactcgacttgcaaagagatgcaaaagcgcattttggagctgattccgtccgtctccaacgaggaagtgacttgtgagtgggcggcaattgacaccatttttaagtgcctttcttccccacatttgaggcacttacactttaatgtgctttgtccggatatattccatttgaatttcctaacatgcaaaaagaggtacaccccaaaacgtcgccgcaaaaaacattaaaaattttcaacagtttttaaaaaaagatttttaatttttaagaaaactttggtgttactgaaaaagaaatttgctgagtttccaggggaaaaaaacaaataaattcgagaataattttttggttcctgaattttcttaatatttttttcgagttgggcttgaatttttgcgtattaggctagataacaaaaattttaggtatttttttatttttttctaaaattaaaaaaaattgcgccgtacgccgaccttatgtcccggcggcgcttcggcgagacgttttgtcctgctcccgcaaaaagtgatcttttgtttattacactttttcactgtaaaacaagaacaatttgtttgacttatttaattcctgaccgcta

SEQ ID NO: 26765 - DNA, 791 bp, Heterodera glycines
atatttcaatgtccatatatgtatactaattacaaaattctgaattttgagcgcattggcaatgttggcaggggtgagtgaccaaaaaaaaagatggattggtgggattgaaaaggaaatttaaaaaatgaaatttttaaattttcggggggggggctgtccaggcaaattggttgcattgtgtcggtcactcggcacaacagttcggcagccaatgcgagcacttgtgccattgtgttggcttcgttgcggcggcacagttggatcagcatggcaccgtaaaacaattcttaattgtaggacacattttaatgagccatcactgccatttggtgccggtaatttcatgagtgagggtgtaaatgcatttatttttcaaaatgatttaatttgactcggtggatttgcaaaatgcaaaaagaaaaggatagacgctttgtctcgacccctttatttgtcatgccgtccactatcacctcaccttggctccaatcgcgcagctcaaccgccgtaatacacccctaagaatcgacctaaaaaattttcaaaaatacacccctaagaatcgacctaaaaaattttcaaaaatacacccctaagaatcgacctaaaaattttcaaaaatacacccctaagaatcgacctaaaaattttcaaaaatacacccctaagaatcgacctaaaaattttcaaaaatacacacacccctaagaattggaaaattttctcaaaaattcttcccccaatttttttttcttgcccagtatttgctaagaaaatatttgtaactg

SEQ ID NO: 26766 - DNA, 1191 bp, Heterodera glycines
  misc_feature (6)..(6): n is a, c, g, or t
  misc_feature (1153)..(1153): n is a, c, g, or t
aaatantggaaaattattaggcacaaatcgccaaaaatatacaaattaaaaaagaaatgaatttaaataaaagcaaaaaaatgaaaaagagtttttatgttaacaaaaagaaagttttcattgaacgatttaatgaatttaaagtttacctgcccaatgcaaacagaaagaatttgtgaaggaattgggtatttctatagaaacatttttaaaatggaaaaaacaattggtgcaaaaattatcataaaagtgagagaatttttggattttatttacattttatatttaaacacaaaataaatattccaatgatgaaaaattagcaaagctgaaacaatatttcaaaattaaagaaggaaatccaaaaattaacaataaaataattgctaagaaattgtgaatcgaaactgcaacactgaaaaggtggagaacggaattttcataagtttagggccctgtaaattttactcctgacaattacaaaatcattttaatatttccatcataatttttttaatgtttatttatgattttggtgatcaaagactttgatttgtttgatacttttttattagttttttcagcatttatttacgttattttttaacaaaatgctaactccatttaaatgtatgaattaatcaagaaaatcgcattatgtaaaatattcaaatcatttattgacatttatccaagatgaaaaaaaacatttttaaacaataaaaccatattcgcattgatttgcaaattacattattgaattattaattaattatctgacaccaattttttacaaaaaaagaaaaaaaaattattttcttggcatggtttaattcaaattatttgtcccacaacaccgtgacaatgccttgggctggtattgtcagcggaattgtccgcttcccgtcatggattttcactttggttgtctgagtgacggacgagaacaacaccatgacaagctgcttgttgtccgggctacggaatgccacaaattcaatgggtttattgttggcattgtacgacaatgacgacaaatggccaccaaattcggaaccaatgcgcacagcatttggcgtaatgaagcgactgaaatatttgagaattttctttattttccaaaggatatgagtcacatccctaggaatattanaaagtttacacagcgatttaaaataatcattaagtcac

SEQ ID NO: 26767 - DNA, 1085 bp, Heterodera glycines
ttcaatcggtctcgacattctccaattcttggtctcgaacagacattagttattggaccaacttgaactcctaacgcgaatccctcgagaacagaatggaaagacattgcgatggcgaaggtcagtgatcggagaatggtgctttccatttggtcatggtggtggtccgccttgctcatgtatttcaatgattcgtcgatcacaattctgccaaaggcaaagggatacaattaaaaatgttttattctttttcatctcagatttcaaaaaaaaaaaattcgttaacatggaaaataattaataaagaatgacttctttgaaaaaataaaattaaatttcatatttcggagttttttggtcggaaaagggtgtgcgaaatttcgttttcgtggttccgtcgttttcggctccttttgagtttcatttcgtgttaggtgtccgttcgttgagagaggacggggttggtggcggtagtcaagtcgagagtattggtctcgaactactctcgaatcgagcaatatacaaattttcgtttttgattttataatttaaatttcgcttccggtatcgtgggaaaacccaccatgatcattaccccgactccctgggccgtcttaatccttggcctatctatcccttggtctgtcagcggtatgacaggaccacgacacggttcgcaaccgtaacaaattggacccggagtacgctttctatccctgatccataccccgacttattggactctttaatcttggttcgtgcatatccttgtcatcccccccccccctctgtttgccccgttccctccgtcccacccactcatgtgtcagcacactcatcgaccgttgcttgaagggtgacacggagtgtgccgatgagtcggagtcgtcgccattgacacccaacggcgctgccgccgatgcgttaccgcccctaattagttttgattgataaatattttggcgctacttgcaaagagcactattttgaaaattttttcaactttttttttggtcaaaatttttttttgtttaaaaagtcctgaaaccaaatacccgggggttttaaaggtcgctgattacgaa

SEQ ID NO: 26768 - DNA, 1156 bp, Heterodera glycines
atttcttaatcaattttcccatattttaggcatttttcaatgcttcatctcccgtcaatttcattgtcacctttgctttccattgccttttgctgattcagttgtgccatttgttctgatcaacgaatttactcgcgaacaattggcattgaaaatacagaagagtcaataccagtagtcacctttggacatttatgaaaaaaaagaagtgaatatttcatggggtgcgccttttaaaaaattactctcgtcgtttaccatcccccttgactttttgctcgaattcgggttcggaattagacataggtatatttgacgttcttttaccaatttctgcctatggtttaaaaatagttttaacgattttgaggacccataacatgcgtcggttttgcatattttgaattttgtcgagaattaatttccttttttttgtaagagtccgggtttagaatttggtcaaatggatgtcatattttcagcgacctcgaaaatccccaaaaatatgttttcattgtaatttatgaatttcgaatttttgttcgaattcaggttcgggattcggaattttgaaaaataaatgtcatattcgtgatcagcgccccaaattaccatagaaatgactttttatttgaaaatttcagaggggggtcacaaaaccgaaaagtaccaaaaaaatttttttttattgcatttttgttcaagaatttgtgaattttatatgaaaaatttttaaaaatcgcgaaataagggcgaaaagccaaaataagggcaaaaacttattttaagggcgaacacccaaaataaggatttctaaggtcgaataagtgcgttaaaacgcaaaattttcgaacaaataatgtgtttttcgtgcatttctcgtcgcgttaaagccgcagaaaaaaataaggaaaaacttataaatccgggccctagtgaggagttactgtattctacatttttaatgtgttatttcatgaatagatttatccccaccctccaaaaaaaaaattagttcatttgtgattgtttaatttaattaggtggaaaacagagaaaaggaaaaggaaagcgaagaaaataatttttgaaaaaaatcattaaaaaattaaaatatttaatttttatttttgagaatttttacagcgtgccattt

SEQ ID NO: 26769 - DNA, 773 bp, Heterodera glycines
tcagagtgcctaaactaacatgtaaataaaatttgggtgcgtttcagaacccttttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccaggaaaattatgaaaaaagtgtcctgtttgttcagcaacagttgcaccgacgacaaatcgcgaacataatcagcggaacgaacgtggggttctttgtcaccgatccaactctccaccacatcgcatttccacatgaactgaaaaattggaccattgggttacggcatttcgaaatccggtttggtgacataagaaatgcgaataattgaaggcggacaataattattcgaatcccgcttcatttaaggggagtttcaacatgaagaaggctcgaataaatacaagttgtcattcaaacaattagatgccatgtatctgaatcgaataatgccggattatattaatgactgttcagtctccttgcaaaatttacaataatcacaaaaatttcc

SEQ ID NO: 26770 - DNA, 636 bp, Heterodera glycines
  misc_feature (27)..(27): n is a, c, g, or t
tagttaaaaactttttactgaataccntgacaaaaaaaaatagtttttctcttagttattaggacaactattaccatgagaccagggatggcacggaattccgatttccgaaaatttttggggcctcagaatgccatccccgccatggacacaaaatgtcatgggacgcgtaaaatgccatgggacgcgtaaagtgttgttgggacgcgtaaaatgtgatgggacgcgtaaaatgtcatgggacgcgtaaaatgtcatgggacgcgtaaaatgccatgggacgcgtaaaatgtcatgggacgcgtaaaatgccatgggacgcgtaaaaccgactagaaccaacttttttcttatattagttgaatttctgttgacatcattaagtgtgcttagagttgcttttgcacatttcgatgatcaaagtatacaaacaagaacaattagactattcggaaggtataaagtttccgattgacggttcgaaaaacattttttgacgcgtaaaatatgatgggacgcgtaaagtgttgttgggacgcgtaaaatgtgatgtgacgcgtaaagtgttgctgggacgcgtaaaatgtgatgggacgcgtaaaatgtcatgggacgcgtaaagtgtcatgggacgcg

SEQ ID NO: 26771 - DNA, 852 bp, Heterodera glycines
  misc_feature (28)..(28): n is a, c, g, or t
ttgtgataatctgggaacggatttatantgtgctaaaaaatgccaaatatgtacatattatgtagcaaaatcccccaaaatatgtaccaaaaaaaattcaaaaaaagagcaaaatacatgccaatatatgccaaaaattgaaacaaaactgcttaaaaatatttgagtttcccaaaaattcaattattttatcagtttcggtagcataattgaaaatcaaaatcataaatgcctttaggcgttaattttaatttcaacgtgtcacaggtgatgataggaggcgacagaaaaattttgaacatttattagcattttgcatgaatttgaaagccaaaaaggaactttcaaaaaaattttttttaatcgccaagtagtgacaaaaactgccaaaacccaaaatatttttatgagctaaaaaatcgctctgattgaaaagcaaaacaggtaaaaatgctatttgtgagcttttcatgtgataatctattcgcaacaaataatttaaaacataaaatttcgttcctgacgataataaaatataaaattatttaaaacatatacataataaatcaaaattttcagttttatcaacaaaccgagaacagagaaaaaacattttgcaatttttgacattggaccatgtcaaaattttgttcaagaagcttgacattaaattttataacaaagattttttagaaaaaaataataaacaaattgaaaatcatacgaaaaatgatgacgaaaattttgaagaaaaagctaaaggtatattttttaattttcttaaaaataaaattcgagagctcgacattttgaaaaaagcatcgatttatacctggttttttcatttgacat

SEQ ID NO: 26772 - DNA, 900 bp, Heterodera glycines
aaaaaattaagatttttccgataaattttcgttttttaactaattaaattatcatgatttactcaaggaaaatttgaactccgattttttaaaaattttttcttgcggcatatttttccaaaaaaacttgatgaatgtgcgaggggagaggtccggcggtgacgataggcgccgccgagaaaattttttaaatttcaatgcaatttgttaacaaattttgtacaaaaaatgagcaaaatttgcgatcttgggctaatttttaagaaaaaaataggaattttgggggcctgcggtgccgataggcgccgccggggaaaaattttaaatgttgaagcactaaccagtaacccacaaatttatttaaaaacgaaaataaaatttagttgtttcataaaatttgtcaaaatggttaatgaaggtcacgggggcgggggttgcgggggtctgagtcgcgggggcacgggcgggggtgaggccaaaaaatctgtcccgcccacggcggggggcgggggtgacgggggcggggctcgaaccctaatttaaaggtacttttttactttacgccacataaaaaataaaattattttgtatttttctagacttttcaggggcgctgatcagtgatcacgaatattacattcatttcggctagacttgggtttaaggcaggggtgtgatctgttcttatttataagaaatgttctgatttggagggttcaaatcttacaaaataaaaatgttcttaattgtaagaaatgttctgatttcgggctattgttcttattttgttcttatttcttaaatatattcaaaattttgaaattttatggcagaatgtcactattttatcaagaaaatataaggtttgcgcaaaatttggttattttttgacaaaaaact

SEQ ID NO: 26773 - DNA, 1454 bp, Heterodera glycines
  misc_feature (1257)..(1257): n is a, c, g, or t
  misc_feature (1332)..(1332): n is a, c, g, or t
  misc_feature (1397)..(1397): n is a, c, g, or t
aaatgatttattgggcttttataaaagttagtgtttttgttccctatgatattaaaattcctccattaccatcgaaattaaatcttgataaattagaaataaaacaaatatataaaacaggatatttattagaaacatatacaagaattgaattaattaactcattaaaatacggtgttattattttaaaaatttttagtttatgtttatttaataaatcagaagttttagataagtataccacttataatttaatacaaaaagatttttataaaataaaagaagatttatcaatgactaatatatttaaattattgaataattcattatatggtaaatttggtagaaaaaattatgattcatatgtaaatattttaaattctgaagactttataaatacaaaaattaaacatgttattcaaaatgtgggtgatttttatttttgtagaattgataaggatattaaaatattaaatgatggaactacaattaatatttcattagcgtcaatgattactagatatggtcgtacaatattatacgaaagtataatgtatgctttaaataataatgatgttgaaatcttatattgtgacactgattcattattttttggaagtaatgataattctattaaaatattagataatttcataggtgtttccattaaatgagatgaaaaattatatactgatgaatctttatcgctccaaaaatatatggacttaaatgtttagatgatagtgaaattataaaaattaaaggtttgaaaagtgggagaagaataaatattgaagatttaaataaatttattttaaaagattatattaatgaaaaaattgaacaaaaaattataaaacgtagaaatctaatattagaaattactttatctcataaaacatttcgtccttgtttaagacctaaacatgaaataatttttattgatcaaattattgataataaaatagttaaagtttgaaattttgaaactattccatttattaacaaacaaattaaaaatattattcagacgactttatttcaatggatataattataagaagatcttgtgatgaatataatttacaaattgtgatatacaatcaaacaaatattattagtaaacttaatgaaaaagataatattaatataattaaaaaattagatgacccgttaattaagatctaataattttatttctttgcttgaagaattaaaaataattttattatattcatattaatatattaaaatatnggagttgtttttataaattttcatctccttaaaaatgaaaaattaattaatagttcaattagaacattttattanaagattattaattttttaattttaataaccatttttataccttttgttttattatttaaaggaantagtattaataactattctttaatatactattaaatcctttaatataccattaaatc

SEQ ID NO: 26774 - DNA, 1171 bp, Heterodera glycines
cctatctacatattaaagaaaagagagagaaagataatgtgaatggcaaatagccgcaaaagatataaacctatgcattcctcatttatgaatgaatagaaaagacatatcgcaaaaaaaaaacttcaaaatatgaaaaagtttaaaatttcaccaaaaaacaaatcgtaaaaattctctcaaaaattttctcttaatgcaatacatcaaaaaagacgtcaaatgacattgacatgccacttttctgggaccgagtcaaaagggcagcagcaggagaagagccatcataagataaatgggtcattcatcggacagaaacggacaacacaacgaaggatgaggatggcattggcatggacggcaggcacaacacacacacacacacaaatagcccaactctgaggggacggacgtcgtttgtccatcggcggagagataagcgtaggaaaaaaggatggaaattgggatgccggaagaatcccaagtgaaaaaaaagtcaaaaagtcacaaaaacagtgagtgttgggcacaacggaagactttaagatattttgggcgaggaccgagggcaagtgagcatttcgtacaattgacgcttaaatggacgataagtggggacaagggacgaaaagaaaaggaagcggcgataggaaacagcagaggagagaagaaaatttgactgattgatgatgaagcagaaatggatgaggaaaagccatattgacggatgatgataatgatgatgaaaagcatattggtcggaaagaggaaaagcctggactttttgccaaggacgaaaagcataagtggctcccgcattatgccgaatccatctccctctcctcgaaatggtttattatgacaaggataggccgatgggggagggtgaaaagattgtgaggaagctgtggggacaatttgtttgttgttttgaagaagtgaatgtatggttggatgagtgtggagaagccgcttcttctcttctcctccattcatatttgggggaaaagccaaatttgacagctaaccaaactctgtctgttttggttagctagctgtttgtgggtgacgggaaggagtgtatgatgagggaaggaggggggggggagcaaaggaagaatttttgtgacagagaaacggcacaggcacattttttattcttatttgtata

SEQ ID NO: 26775 - DNA, 1595 bp, Heterodera glycines
tggttttttctaatcaattataatgtcatcatttaattgattttttagcattggcatgaataaaatcaaaaaatttatataatatatttatttttttgttttactaatatttttgttttcatatttgaagcatttgcaataaatgggtccaaaacagtttcttgtgctgtccattttcattattatggcaactttttctacaattttggccaacaaaaatacaaatcggcgacaaaaacgaatggacaattcccaggaaaacaatgtgccaatttaaataattaataataataataattttaaattaaaaccatttaaacacagagtacggtagtccgaaaaaggaagacgaccgtgactacaaatagcggtggtgaaaatgccggtgaaaatgttgctgtgaattaccaccaccagcagcagcaacaattaggcaagtaaattgaggagaggcggaaaaatgagacactaattagtctattaatcattttctcacacttttttggtaataagcattgatttcctcgttaaaatcagttttcaaatcgctttttctatttttttcatatgtaatctaattcgctgaaataatttaaaaaattgtgccagagttcttcgagccagcaaaagcctttggtaaatcagcggctacggcactttcggccaaaaccgtgccaaagcgcaaaacacagccacaacaaatgggcacgtcactgaattcgaaacgaaacgtggaagaagccggtcaaaaccaacagcagtcaccgaagtatgctgttactttggatggcatcaaagaaatgctaatgagcattaattgggctgctacttcacgcccattaacggatgatcatgatcagttgggggcccaacatatgggagaacaacaaatggacaacaatgttcagcaaaatttgaatgatgcagatgaccaatttggtctttcaaatattggaatgcaaccgattgatgtcatcggcatgctcatggaagatgaacccgacaaagaaaatgttgaaatatttgtcaaacttttaaatcagtgccatttaattttggccatagcaacggaacacattcagcacaaaagcaccaatgtgccgaacctaccaatggtattgtgggacgaaaattgggaggcgatgtccaattttattcaacaaaatggtggacatgtggtcggatgtgcgttgttaaacaatgcaaacgatttgacacgtgaagttgcggatgttatcgaaaatggtaaaacataaaattgaaaaatatattttgaattgtgacattaaattatgaattattaaaaagtttgttttatagctaaaagcagtgtagccagattaaaattttcaaaagcctcatttggcatgcaaaaaaacctcattttgggtcaaaaagcctcatttttacaaaatttattctaaacacgtttaaaatgttcaaatgttatatttttgattgtccatgatcaatttgagcatttttttttgttagaaataagcattttttgggattctgaacatgaaaaacgaagttgatttttttgcggcgctttttccaaaaaaacttttgggaaacaagggggggccggcggt

SEQ ID NO: 26776 - DNA, 801 bp, Heterodera glycines
  misc_feature (641)..(641): n is a, c, g, or t
  misc_feature (659)..(659): n is a, c, g, or t
  misc_feature (753)..(753): n is a, c, g, or t
  misc_feature (772)..(772): n is a, c, g, or t
ccccttttcggccgatccctgtggaaattacgaagccctaacccaccaattcttcgaccacatttacgaacataaccatgacaaaatgcgtgcgttgatcgcctcgctaagcaccgacaaattggtcaatttgctgaacattgaatacgcgccggaaggcacggagaaacagctgacgccgctgatgctcgccacggtgttgggagacgcgcaaatggcccatatttttgtgagttaattcaacggcattctccgccaatttatccattgctacaaagctcattgtcggcagaaattaatttttaaatgtttaaaatttaaataaaatccatttttatttcagctggagaaaggggccgacccccacagaatgtgcctaaggaaaatcaacaccgatgacaatttgatcagtgagttgagagaggaaaagccaaaaatgaaaaaagtgacatttgaaaaataatttagaaaatacacgaaatacacagacattttgaataatattaatgtgatttgaataagttcaaaaaattatgagttcgttcttaaatgtgctttaagtccaaaactcagggcccaattaactctttctgatcacttattttttgatttgattttttactctcgtaaaatattcctanacctttttggcccttcgnttaatgtgcttttccccaccacttagacggctctcccctttgggtcgccgcttcgtttggccatttggaggtgtgccgtgtgctgcttgcgcancgtgcccatgtcgaattgngcctggaaattggcatcacccccttgatg

SEQ ID NO: 26777 - DNA, 1478 bp, Heterodera glycines
  misc_feature (10)..(10): n is a, c, g, or t
cacaaacctntacgtcagggattttggctgccccattggccactgcctcggcattttttccggccacgagcagcgaaatttggtggcccaattttttggcggccgtcaccgcattcagcgtgatctggctcaacttttgttcattgtgctccgccaacaccaaagtgctcgccaaacaatgggcctgaaatttaaaaaatgggaaattttagagggacggaaaaaaaaatattttttcgctattttaaaaaggaataaaaaaaattcgagaaaattggcttttagtgtttttcgccaaaaaatgaatatttggggttttttgacttaaaattacaagtgggaaattttgcaaattttaataaaatttattataaaaaacatttttccctaaaaatcgttttttttctcactcacattcaatcgacgaaaaattggtgcatttattaaaattcggttgccagcagccgaacctgtcgaacaaaatgccgcgagcattgtgatgggaggcaagaaaatttacaatcagcttaaatgttattcaaaattttaaaatatttttagagatcggaccgggccgggcccagaaaccggagatttttggaaaaatccggtttgaccagtttttgagagaccggacccggaaacaggtcgttttttaaaatgcaacccggcccggaaaccggccttttggaccggttttataatcaagccaaaaatgtttctttttgttcatttttctttgaaaatgtctttttggcataatgtttttgatttttttttgtcatttttccagttgaattttttaattcactagcggggtcagcgggattgtgcccgtgaagttgccagagagaaaacgggtgatttcggggataaggcattcaaaatcggcactgactcacgtgccgaccatctaaagcatggaagtaaaatttagaaggaaccgaaataaaatactccgaaagtggggagaaatatgaatcaaaatctcaaattggaacagaaactatccagagataggagaaagagccacacctataacttccgcactttgttgagcgcgcttattcccatgcaacaccgtccttggagtttgttgggcgtcccatgaaatttccacccataaggaccaagcatgatgaagtgaaggagcccttgctatttgaccaattcctaagaggaatttttggataagtaaacatgaaatttgtgccaacttcgcacgcctcggacaccctcattatgcccgattggagtcctccagaggcttcggaccaacacagtttgagatggatggcctccagacacagcgtctgaaccactgatggacgaaaggatggcgacaaactgacgaccaggagacaatagttagaatgatgattttggagaactagcagtttttcaaaccaatcgctgtcttagtgtccaaattgttcccctgatcccctactgactccctctgcattgcgacatccgtg

SEQ ID NO: 26778 - DNA, 898 bp, Heterodera glycines
cacagtagtgtgcatctcttacaatacattttaaaaacttggacaaaatttcacacttatgtaggtttttcaaaacttttagtgtacatcgcaaaacaattcactaacaaagaattcttttgacaaaagttcacactctgtgggtttctaaaacttggtaggcacattagtgtggatcttaaaacaattctaataattacatataacaggtaatgtgattgactaacataagccacacaccacactaatggattttctaaccaataataacaaataatttatttaataaattcaacatttttctgacaaatcaacaattttaaagcgcaattacaaaatgaaaattatatccgtatttgataatgtgtgaggatcacaaatataattaaataacaataacaaacaaaatatcaaaaatcaaacataaaatacgtaatcgaaaaggtatgagtcacaaatcaaatccaagcaacggacaacaaacgaaatactacccatttttttgcgacttcttaattggctccaaagtttccgaactacgacgtttaattggtgtcgtcaaaatcgcctcaagattaacgcgcccagcaccaattttgacggatgaaatctcgcaatggagctgaaggcattcatctatgataataaaaaaacttgaaaactcaaattaaaaccaaaggtaatgccaacaattacaattaccttcaactttcacaaaaaaattttgaagttcgatctgtgtgttcttaacgcatgaaccaagacgttctaccaattcttcgccattgacgtacaaatcaggcctcattcctttcttgtccgcgaccactgcagcgaaatgtttcccgactggcgaaaacgatgaagcgagagcacaattcattgctttaaaaaataa

SEQ ID NO: 26779 - DNA, 770 bp, Heterodera glycines
cccccctccccgctggataaccctttcaggatgtgcacaattttcatgagttcattatggaagatttcagtcgttccaaatattaatccaaacaaactgtattttataaagcattaaagtaatataaatcagccaaatgtgaaatggacttgttttttactaaattacttgacccacaagcattttgactttttcattttgttaaattctgtctgctaatatttcaaaatttcttgaccttttatttgaattttggaaaaacggaaatattgtgaatattgtggtcaaactctatctgattaattataatttcaaacacagattactacaatacagatcatattggataaaactttgatggaattgataaagaaagttttgctacatttttctgtcagaaatagataaaatgaacgatgcctttattgataaaaaaaatggcatttttgtaagtttgtacaatattagttgattccgatgagatatgaacgcaattttaaaaagaaaatttctcccgacggaattaattttcgaattaattaattttctgccacccaaaaggcgttgggcaacaataagggtttcggcaaaattcgacaattttgtcttacgaaggcaagccaactggcacacaatgtgtttatttatagtatgcgattaatttaaatattttacttaaatataaattggatcgtccataatttattttgagtgtccgttcaatttatttaaaattaatttaggccggccaatttgatgctgctgttgag

SEQ ID NO: 26780 - DNA, 1045 bp, Heterodera glycines
aatttaccatcactgcacccattattatcattaatcatttgataattaccaaattaaaagctaactgataaaataaaataataatttgccattatcatacaaaaaactctcgggtgaactatagtgaacgccccagtgaaaaaatgggtcaaatgatataccagtcaattcgtctcaaggagctaagcatggaaaaatatgtctcgagttgcggaaatgccaaaaaaccggtccccgccaatcagtcaaccgcctgcggatcacgcgcggacttcttccgtagcccgtagtctcgccccacctactggccgccgtagtcgagtgtgcggcggttttttagcgcaatactcgatattcaaggctaaatgatttacgtgcattatataagaacttttattttttggtactgaagtgtcaattttcactgggactcagttgtcccagtgcctagatggcattggttcgacttcatttcctgatctttacatctacctcaaatggagatataatgtgaaacataatgactaaccaccttaatagtgtcaaaaaagtattttacccgtcaacttcaaaataatttattttagtggcgaagctccaaaataatgattcctagtgatgaatagaggcgttaaaacaaagaatttccgagctacacatgtgatttccgtgcatttctcgtcgtaactaagtcgcagaaaaaatagttttaaaaactaagaatcctcgccctacatataactagggttgtaaaattatatggattaacatatttttttctgcccatatgctatgaacacaggggcttaaaaatataatttctgcgttaaaattttttgatttggtgaaggttttaaaccatataaatccatattttggggttttcggaataaaccatatttcgccatttttgggtttttatcccatattttggcacttttttggaaatttccccaaaaaaaaaaaaaaaacgaaaaaacccccctaaagaacaacttttttggaaatttttaaaaatttcccccccaaaaaaaaaaaaaaattt

SEQ ID NO: 26781 - DNA, 924 bp, Heterodera glycines
cagcagactgctgctgcacagcagcacgcgtctgttcactgtctacccctcccacccgccactgcccgcatcaacagacagtcagacagtgcactatttcccacctttccctccctctacttttttcaaatacatttttaacgcaaaaaacaaacaaaacgccacacaaacacaacgccatggaacatacatacacacagacgttcatctttattatataggattattgcctatagatatttggggttactgtatcttttttagcactttttatatgcattttttcttactcaccgcccttgtgctcctggtgctgttccaacagcgcttcggcgcccgcaacatctttggccaactccgacgattgaatgagtgccttttgaacagaacaaattattttgaaaaatttaaactttttttttgtaagaagcagatcataataattgcattttttaagccaaatatatcgctcaacaaattactttacattatgccatttttatccaaaaaccataaaatcctgcggtaaaaatcaaatttggcacggactgtgcccgatcacctggccattggtccactcgaccaactcgcggtagtcggccatgaagcggtgccggttgtaagatcggtcaagaccccgcttgcgctgctccacgctcagctttagcgcctcccaccggccgcgtgcttcgtccaccttcgctgcaatatcttccgacttttccgggtacaattggcacaatcggttggtctccgtgccaagtttgtccatcttgggtaaaagtgggtaaaattctgttttttaaattactttgccctttcctaaaaccttttggtgccatcttttgtagttactcccacatcctatataatacgggagatggttctaattacctcattgatctgtttctgatcatcgcgctg

SEQ ID NO: 26782 - DNA, 929 bp, Heterodera glycines
tctagagtcgtgaaatatgtacaaatatgcaaaatatgcatatggaaagtcatcctagaagcttcaaaccgagctaaaacatgtttttcgtacgtttcaggcctcccacagtcaaggaaaaaaatatgcatgtgcatataattccgagccctagtaattaggcaatccgtcttaaagttttttaaatgaaatttaaaaaaaaaagaaaaagttataaaaatttgcacctaaagatagtttgttgcacctaaaaatcctgtccctcctaattaattaattaattacccaatgtctccgtaatgcccgtctgttgggccagctgctgcttcatggccagattcgggctttcatctttcatataatgctcattaagcattgccatctgcacaaatgggaaatttgttccccttgaattcatttgccaaatgtttttaccgctttttccttatagcagcgacgtgttgatttgagcttcaaatgccgttctatcggcgggaacgggtgcctcttgcgcactctgtgcttgtccaatgggttaagtgggcttagaaattttatttttaaatttgaatttcaaaattcctccccccccccccatttctgtgactggacaattggactgtggacaatccgacagaggtggacgatcggacagtaaaatataccaaaagataagaaaatgccatccccgaaggagaccgattgtgccataatacacaggacggcattcgtgtgcgaggaatggcaagaaaaaagcgcttatatttaacaaatgtgcaacttcgcttacaaaatgccaaacacaacgaaataatattttcgactgcattcgccctttgctatttgcctattttccttttttcttgttatggcacaatcggcccccttcggcgaagggattttattatccttttgtgtattttagtgtc

SEQ ID NO: 26783 - DNA, 629 bp, Heterodera glycines
agtttatgacaccgtactttcaacgtccgttggaacttggcgctgatgttgtgatgcattcgttgaccaagtacatcaacgggcacaccgatgtgctgatgggtgctatggtgaccaacaatgaccaacttgatcagcatcttaaatcacagcaaattagtaagccttttacattttgcttacaggaatattagagtctactctcatccttggacatttccgaaaattttaagctgctggtgccgtcccgtcaccgtttgacgtctatttggtgatccgtggcatcaaaacgctccatttgcgaatgcgacagcacatggaaaatgcattggcagttgcacgatggcttgaaaaggacccacgagtggaaaaagtaattaaaattcagcaaatcattgaattaattaatataattaattagtaaatatttatttatttgatttttttaattcgatttttgaatttaatttctattattattagtgatttttaggtgctttatcccgagctcgagtcgcacccgcagcacaaaatccataagaaacagagcagcggaatgtccggcatggtctctttttacatgcgcgccgatgccgacggggcacgcaaattcctcgccaatttgaagg

SEQ ID NO: 26784 - DNA, 1407 bp, Heterodera glycines
acagtatcgtctcccgtcgtggtgtccggccatcaactgtttgccgtcgaagtgccagctgaccgcggtcaccggactgttcggttgatcatccaacctgaaccggtcaacctcgcgggtctgaatattccacagcacaagttgaccacggtagaacacaattaacagcttggtcgggtcgatgggagagacctgtccaaattagagaacatcaattaattggaattaatccgatcattttattatatcattaataataatttttatttgtatttaatttaaaatatattagtcatttggataactagattaaataattattattctttacttaaataaaattaaattattagtctataaactaataaaaatattagtctattcgataaataaattaaaaaattattttttaaattaaatttaaaaatatttagtcaatctgacaattaaattctgttaatagcttaaaaaacctttaaaagcatctattcaattttagtaatttagaaataaataataatattattttgttttgtttggcaaaatacctcgagggatttaatggcaccaggatgagtccgacagcttctaaatttaaaaaatttaaattattaatatatttatttaaaataattttgtcatacatatcaactgctttgttccattgaattacataagtggagagttcaaaagtggccaaacaaacaaaataaacgttgccctaaatttaaaaaatataatattatgtttttttaatatttttaaaataaaataattttattattatcattttgtatgcttttttaaataattaaaaatatttgccaaattcaatattcatttatattaaattgaacattaaaattttataataaaaatttaattaaaaatccgaaaatatgatgcaaaaatgccacaaataccttttccgtgccaacatacaaccatcgactttggaatggcaaataaatcgtcgaaattcgttcctttgacatgcgcaacgaatgggcaatttcgggaattcgttgtctttaaaaaaatgtttttttaaaattatttttagatgtaatgatcataaattttggttggtaaaaagggtaataattaaaaaaagtaatgatcagaaattattttggcccattagacacaatagcatgaaaaaattaatttaggacaaagccaaggagagaaatgatcggaccataatggataccagcagataaaaggtttggcaaaatgccaaaagcaaaagactctcggaaaatgtgtttttaaaaaaagcaataatttttttaattttatcaaaataatgaataaatttggcaccatattttgcacctaaaattccataagtgtaaagtgtcgtcctgaagtgcactaacaaggccaccctaaaaataaaaaata

SEQ ID NO: 26785 - DNA, 907 bp, Heterodera glycines
tttggtcggcgtcattcggtgcgatgaatgtgatggatcagtctgagttagccgactgatcactgatcggagcgcgttcccatttgatttcaatttctgcttttgtttttgcttgctgctttggtgtccatttatccgattgttcagcagatgactcattacgagcagtaccaccatttggtggccaattcccatgtgtctgcccatctcaacggccaacatggccctgtccatgccaccgcctctttgccactgccgctctttccgcccgcccaatcgcacggcactgtcccctcttcgttttaccctttcgaacccctccagggccaacttttgcaccctccttatcccctccagcaccatcaacagcacagcaacgacttggcaagcttcgcagcgcttcattcgcaaggccaacagaacggaggaaacaatgtgcagcaaattgtgtcggattttgcattgcttagcgacacaaaggttatacaaattcattccttggcattgttttgattatccaaaagcattcattcgttaagccggaactgtacgccccgggcacttcttccctttggcagccaacatctgacagttttaagagagttggtcaattgggagagggcgaacaaatcattttggtggacagaagggacaaaattgagaagagcgaaggagggaaaaagcggaggaaggcagcaggacgagttgaagaagtacaaacagtggaagaagacgaagaaaatgggaggagagcgaacggagaagcgatgggagagggggaagcagagacaacgacggaaggtggattaagcaaaagcagggaaaagccaggggaaaagccaggggaaaagccaaggaaatagccaaggggcagccagggaaaaagccaaggcaaaaccaagaaaat

SEQ ID NO: 26786 - DNA, 992 bp, Heterodera glycines
tagccctatatatgatatgatcttcttacaatttacttaggactgataaataaattttcaggtaacaaaacgaatgaaaatttaaactttaaaaaagtgacaaaaaatcaaaatcacaatggtaaaagcgtatcgtcggcactttcacgtggttcacaaaaggcacgagaggagaagcaaaaatttgctaactttatcaacaaattaaagaaaaaaggtatgtttaaaaaatcaaaaaaaaaatcccaataattaattattcaaatgttctcaaatagcatttaattaaataagagtgcgcttgaattttttcaaaaaaaggaaaagactaacagagaaaatgttttgattgccaaaaagggcaattaaaaagatgattcgaaatttaattttaagaaaagacaagcttcatggtgagtatccataaaacttttggcctatttcgtagggacctgttttttaaattatgaatgaaattctcaatttaggttcttttttcgccaccaaaaaaagccaataatgttgggttttaggaaaaggtaatatattttgggatgggtaggatgtgccgatgaatctgccctggaaaattttgtttaggtttttttaaaatgggaaagtttataaaaatttaagctgaaattatttttttaaaaagacaaatctttaaaaaaaagaattttcatttttaaagattcgacctctccaaaaaggtttaatgcgcattctaatttgaatatccgttaatttataatccaaatggaagaatttaaatatttcaatataaaatttcaaatgtttagttttttgtgccttgggttactgaaaggaaaaatcatcgaaaggaaaaccgttggaagatgtcagcaaaatcaactgaaaaaataaacagaataatgcataattatgtactaattactgtttttttcatttttgtatttgtggttatcaatggggagtttattttactttttctttttttaatgtttttt

SEQ ID NO: 26787 - DNA, 1471 bp, Heterodera glycines
  misc_feature (30)..(30): n is a, c, g, or t
  misc_feature (34)..(34): n is a, c, g, or t
  misc_feature (56)..(56): n is a, c, g, or t
tgagagtaaaaaatgagacgggtgaaaatntacnaaatgggaaaagcatttttgcncacccaataatttaccaaatcaccggctaaaattgttttgctaatggcacttcattattgataattcaaaaatacatagaagcaagaaaaaaaattcagcatgataagataaatattttttatttcaaattccatcaattaaaaccatttttgtttgtgaaacaatcaattaaagttaaatgacgccatttaaattttgcagtgatcaaaatgtattcatcgcaattttatatgactttcccacgcttgcagcagcatagcaaaatgttcgtccgattttggttgatcaatgatcagtgccttgccgctgatcaaatccctctgagcaatcccaacagcagcagtatttttatttgaagcagcaactattctattatcgaaattagcaacggcagttgcagtttgatcagcaattctgcgattgttggggcacagcagaaacatttttccaaaattattccaaatttggcacatatctctcctcaaaaatgggtggcatcttaattggatggccaattaaaaaaacaaaattgtataaaataaatttttacgtgattatgaacagttcgatcagaaaaccggtgaccgcgttcaaagttgataacaaattgtacatctgatagtaatgcggccactgaaaatagctccacgagataatcacagtagaggtaactattgttagcaaatggagcaataacggagggacaagctgttttccaatgcgtatgttttcagaaagctaaaaatgaatgtcattgtttaaaaaaattaattttgaagaaacattgccacaattttcttcatattttttgattttataaaaacccgaactataattttttattattattatttttatgtgaatatcatccactagtatttagaacaaatttaaaaaactggaggcataagcttccaattgtgcgcaaaaacctcatgtaatttattaacatttataataaagcttagctattttaaaactagaatcaaaatatttttcatgctggtcactactacctagcaaccgtaccaaaaaatttatgtcaatttaaaataatacctgatatcgcaatgacaggctatggtacccctgtttttgcataattttctgatagatttttgagttatattggcacaactggtaaaacatggcaaactccacgattccaaccaccaattgaatgactatcgtgattacatttgttagcggtcgagaactttgaggagacgtggagaaggcaataaaaacggtaattgtcatcttaaaaaataatttaattaaatgcgaatttgattttaagcttgtttattttgcattttttgtaacgtttcgctttgaatttaattttcactaaaaacccatttatatttgcatataaattccagtaattttcaaaaatttttgttccccctaa

SEQ ID NO: 26788 - DNA, 1469 bp, Heterodera glycines
agtctcaaataaattttgaaatgaaagggaaacaaaatttgacaaattggcgatggatttccatttccttttgcctttgtctgtcgctcttttctttctttccgttccctttcatttattcccattcaaattcattgtgtccatgtgatcctccttctgcccattgagtctttcccccccccccatttccataaaaaactgtccatcgtccgtcgattgtctgtccattcgctttcgctggcgttagggacggacgacggctgaactgttttcttccgctgttttatgacctcccacggccgtttcccacttcttctctcatcactccgactttccgccacttaaacaaattcatttccttcttttctcctccctttcccattcctaaaacatttccttaaaatttgctgctttttatgttgccaaatgaaaaataaatagtcaaacaaagcgatggttagtcgaaattgccggactttgctcttcattatttttattaaggattgaattcgccttttttcgtgacattttaccgttgttttcgcctgttcgaattaataggttcccataggaaattgagcgccacagtcgaccaatttatttaaatttatttgccctctggcacttggttcatcccttggggatttgcaatcttcgatcaatcatccggcccgtgggtcagcggaatacgggcgaccaaagagtagtgagtgcatagttttgtccactctctctctctctctccttcctttcgctctctctctctctctgcactctttctactttctctctatccctctcctcttctctccccttctatttcccctactgtctcccctccccctcgcgtcatcttccgttgctttttctttcgtcgtcccgcgagtgtcggcggttgtttgtcctcttcctctgctcttctaagggttaaaatttcctccttcctttttgtccattcgttcatttctctctcttccctttcctttcctttccaatgcattaaattttcatccttttcctttctttccttccttccttttatctgtcaccgtctcttttttatttgttgtcccaattttccatttttgacattctcttagcatttacctcaccgtttaaattaaatgtcattcactgtcaaaaaccctaaattattttgagtgttaacataaaaaaaataattttaatttttgctttacttctaagattattcaactgtgaattgtaatttgttcctcttttagcatatatgtttggcatttttgaggtttaaattatgtataatttgtgccatttgtgcataatctcagattggcacaactgacgccccgctgtgtatttaatactcagtgtcaagcataaatttaacgcacattttgtgcttcccgaaataaataatcctccttaatccccgattgccgccatgaaaaagcgttcgttcatttgcccacccttctcagcaggggcag

SEQ ID NO: 26789 - DNA, 1255 bp, Heterodera glycines
agcggtgtgttagtgcttgctgatacgtccgtggccgtgatgagacgacgtggtagggaccgtgcttggcctagcacgtggcttaagtctcaatgagtgtcagatcgggcaccgccagctttttcttgtttgtcattagttttttttccacttctgcagaagaatgaattctagtcttatcggtggatcactcgggtcgtggatggatgaagaacgcagccacctgcgataattagtgcgatcggcagaaacttgcactcagtccattcgcctccccatagcctcaacggagaaagaatcttgcctctagcagcattaggagcggtacattaccgacgcctcgcccctcgcgcaccccaagacttacgcagcaaaactcgcgcaccccttgaccgattgacttcaaatgttaaactcgcgcaccccttgtccgattgacttcaaattttacgggcagtcaacccaccaccccataaactgaacggcaaaagaattttgcctctagcaccattttgagcggtacattcccgacgccccgcccctcgcgcaccccaagacttacgcagcaaaactcgcgcaccccttgtccgattgacttcaaattttacgggcagtcaacccaccacccccttaagctgaacggcgaaagaattttgcctctagcaccattttgagcggtagattcccgacgccccgccccctcgcgcaccccaagacttgcgcagcaaaactcgcgcaccccttgtccgattgacttcaaattttacgggcagtcaacccaccaccccataaactgaacggcgaaagaatttcgcctctagcaccattttgagcggtacattcccgacgccccgccccttcgcgcaccccaagacttgcgcagcaaaactcgcgcaccccttgaccgatttacttcaaattttacgagccgtcagttcaccacgccctaagctgaatgaggggggtccgcgccgacggacggcggaatgatgggggggggggggtccgtcgaagagaggggtcccgccgccctggtggggtggggtccgcgacgatggcgagagagggtctgcgccgcccgaacggcggaatggtggggaggagtccgtagaagagagcgggtccgcgccgcccggacggcgtaatggtagggaggggtccgcggcagtggaaaagagggggtccgtgaaagagaggggggtccgcgccgacggaaagagggggtccgcggaagaaagggggaccgcgccgcccg

SEQ ID NO: 26790 - DNA, 631 bp, Heterodera glycines
tcgcccccgtctccccagcagggcttaatctgaaaatcccgtgaatcgcccccgtctccccagcaaggcttaatctgaaaatcccgttaatcgcccccgtctccccagcagggcttaatctgaaaatcccgttaatcgcccccgtctccccagcagggcttaatctgaaaatcccgtgaatcgccccccgtctccccagcagggcttaatctgaaaatcccgtgaatcgcccccgtctccccagcaaggcttaatctgaaaatcccgttaatcgcccccgtctccccagcagggcttaatctgaaaatcccgttaatcgcccccgtctccccagcagggcttaatctgaaaatcccgttaatcgcccccgtctccccagcagggccttaatctgaaaatcccgttaatcgcccccgtctccccagcaggacttaatctgaaaatcccgttaatcgcccccgtctccccagcagggcttaatctgaaaatcccgttaatcgccccgtctccccagcagggcttaatctgaaaatcccgttaatcgcccccgtctccccagcagtgcttaatctgaaaatcccgtgaatcgtccccattctccccagcagggcttaatctgaaaatcccgtga

SEQ ID NO: 26791 - DNA, 762 bp, Heterodera glycines
ctccccttctctcttctctccccctcaccccccttatcgttttgctctcgccttcgtctgaccaaagtctcgggatgtcaaaggttggataggaagtttagcgcatcccgcagattcggcggatgttgtccatgtgattagcagtcgttcaactcattatcaaatgtctttcgcgggctcatccgaaatgccacgacatcccaaaagacttgacgaaattttcaggtctaaacggccaatttcaatccactgtgccgatcgattgggcttacattttatttccgcctttatatttaatcggttaatatttgcattgccatcatcacgcacagctttccgctcttccccctcagttaagcactgctcaccctgtacaatttagaaaaatgggcatattcattcttatgagaatgatgaaaattttcgtatattcgtcagatctttaacggctttatcttttgttcggcgcacatgaagtcaagggcttttacgatattttatttgcaagggcaccattataagactatccgatttttgagtattttccaaggtaaatctaaaccagggctccggatctgtccttattagaaagatttgtccttattccggactattgttcatattttgttcttatttctgaaatatattcataattttgaaattttatggcggaatttcaatattttataaagaaaatataagattttttgcccttgatgttcttacttttgaaaaatttccgatccgagccctgaactaaac

SEQ ID NO: 26792 - DNA, 925 bp, Heterodera glycines
aaaaaaaagtttttgaaaaaggagaatctttttttctaagtgaatgctaagccaatttgacatttcagaaaaaaatttgtgggagtttcaaaattttcattacgttataactcaagtcattgactgaagattttaaccaaaatgctaaatttattcttttttttattgattctaaatgttcaaagtgattttgtaaccttataaccaaaattattataattttcgaatttatgttttttcatgtgttagagacatgaaaatagtacgccaaaacgagagaaaaaagaaatacgttattataattatttataacttttgagtttgagcacagacaataataattgagcatagaataatgcagaatttttttctctatcgctatgcaaaatttagcaaagatttaacataacgaaaaaaagctacacatagaaaagtaaaagttgtttttcacatcattaaaccgaggagatagtacgccaaagtgagagaaattacaaagaaaaagagaaacgacgagatagtactaggcttttctctgcacagtggcgcgtacccatagtgagttggcattgtccgtacaccgtcgtagagacatacggtttttgtatttttgtaataaattttgtgctctctgtccgtgtatcattttccgtaaaaaaattttcggtaatagtaccgatggtagtccccctttttcaaaaaataaaatttttgaaatttttttcgagaaaagattgtattaggggttttaagggtaggagaatccgaatccggcatcaatttcgacctatgtagaaccccggacccgaattcgagcaaaaagtagaaaatttaaattttccaatttctcttttttgccaaaaaaaggattatatgatttttattaatgaattatcgagttttagtttgataccctatatgtaag

SEQ ID NO: 26793 - DNA, 856 bp, Heterodera glycines
cttcatttgcgcttaatccaatccattaatccaaggcttttccgccttcactcgcctttcaccgaacgcttccctccgattctcatccatcgctttgctaccggccaaaaaactcagcgcgtcaaaaaaacgccacggcggttttacgttgacttcgcccatttgaatgcgtcggttcatttccttgagcctcttgtagaatatatccttcaaatttcgccattgtgaagccaaatcgtcgactgaaccgaatgaaattgccaaatcagtcgaattattggccaaatgtcaacccgtaaatccgtcctccaaaaagtgctgtcgaatttgttcgaatgcagcccgacgacaggccgaaattttgcttttgtccgttgcgcctaccggcaaccaaatgatttcgaattgcctcaccaattggatcagtcgcgcccgctgattcacattccattcgcaacgcccaagcggaggcataagaaactaaaaaagcaattttaccgaaggaaaaagcgcactttaatttccttaaaatttgatcactttttaagcccaacgaatcacttctgacaattagcggattaaactcgaacagattcttttcatatttagaaggaatttgccatcgcagcgaaaggcaaaataaagggaagtgaagtgaaaggggaggactttgttaggcttttgaaatgggggccttaggctgggctgaagggagtcgtggcctttgctttagcgtcgtttcgtcgctgggctttgcttggggaggcgagcgttttcgccgcattcgccgtgtcgtccgttctttctttcgtcgtcagcgtgtgcgggcagagataaacgaaatcgattttggaca

SEQ ID NO: 26794 - DNA, 1324 bp, Heterodera glycines
gaattccgcaatgtacgggcggacagtttgtcgtcgctctgctcgtactcctgcacgcggaataccctcgtgacgatgtagccctcgtccagcgccgcgttgagctcaatcgaagtgcacgtgctcacccatcctcgttgtctgtcattgtgctcacagtggtagttgggattcacaccaccagtcggattctctttggcacaagtgctgcagagcgggaaacaaagccgctctccaactttcaccggcagaacgggcacgtcgacgcgacggggtggcacaacccacactttgagcagtgccaatgggtaggggttgtctgctgcgttgcgccaatccacttgccggttcaacacatgcacttttggatggccaatggggtagcgagtgacgaaactaaatttcaaaattttattatttaaaaacgacgagcaccacacatacttaatatacgggtacaaggacgtgaagtcgtagtaggagatcttctctcctggtcccgctttgcgcagcagtttcagcggtcccgtccgccctcccatgaacgcgtcccggatcacgaacggcccatcatccacataatcagcaaacgacttgcgcatttctctgctccgctccagcatccgatggatatcgcattcccagtgtacgtccacgcggttcacttgccgccgcagaaattccagacgtttggcgtcgcgctcgcgcacctcccccgctgttttccccattctcaccgtttacggggtagtggcgtttggtcccccgcctaggcggaggaatagtgggcatttcttcttcgacggcagaagcaggaaggggttgttgcagcggctgtggctgttgttcaacaatttttggctctcttttcgggatacggtatggtacaggcctctttgtcggctcgggttttggtataattttgggtggaggcaagtatccggcctgcctggatgtggatggccgagggtcaagcgggaattcaggttcttttttcgaccgaggcagcgcgacttttggtcgtgaatcgggctcaaattttgatggttttagttccaactttgttggcttctgaggctctctcttggcggtaggacgcggtggtggttcaatttttgctttcgcacgaggcgggagcgggagtcggggaggtgaaggaggataataaaccctgtattttttgcggtccgaatcatcatatgcttcgtccttttttaatttttctgtatcactttccggtaagggggcagcagctgcttccgcaggaaggtcccgcacaaccggccgccgtcgttgtatatcgtgtcgccttttctcccactgc

SEQ ID NO: 26795 - DNA, 938 bp, Heterodera glycines
  misc_feature (879)..(879): n is a, c, g, or t
tagttcttagggccgcccgcaatgaactcaacgatccgtcggtcggtgtgttcgcgcttcatttggccaagtgcttcgccctctgcgacacagggaccacccatcttgttgacataataaatggagtcggtgtctaaagcatatttgtgtacagaaaacattttgtaacaaacataccgcagtagagcagctccgctccgtcaatcgctaacacctgctcaatgtagtcatacagatggaggcgggcatatgaagtgacgaacgaagcgaccggaagacagttggtcagcggggccttggcaaattccgcccgcttccgcacgacacagcggtccatgtgctcggacacgtggacaaaatccaacttgtccagcgacgggtcttcaagcagctcgtggaattcagccggcgtccgcgtgtagcgaatttcggttcggcccacacgctgcgcgagctttcccctgtaaatttttcgtttaaaaataaattttaatattaataagaccaaagtgagtttgccaaggttttggcgataaggcgcaggccggggttgaattccattttggcagggtccagctggatgccctcggtgcgctcaaagtcttccacaaattgacgctgctcgtccgtgacacatccttcaggccagcccgtcgcctgcactttgagaccgacaaatgtgttgacgtacgagctgaacagcgtgccgtcccactcgtcgtagtcccaaacctaattggtattttgtgcaaaaaaattttaaaaagtgactacctcaaaaaggtcagtgaccacatagccgagctgcagcgccttgttgagttcggcatgcgtgtaggccgtcacccacgaacgcttgtcatcaccgtgacggcacgntcgctgctgtcttcggtcggcacccacccacacagcggaaaggtgaagcgctcatcctt

SEQ ID NO: 26796 - DNA, 1633 bp, Heterodera glycines
aagtccgggaagctcggatgcctggccagcgctgtgtcattaccacttgctctgtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggcccctacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctccgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacg

SEQ ID NO: 26797 - DNA, 1356 bp, Heterodera glycines
ttacccattaaagcttaatttgcgtatcttaatgtttttatttactggaatattcgaattaaataaaaagttaaaatttttacaatcaggaatttaaaatcaatgattataaggggttaaaatattgcatggaattacaaattttacaaatagataatataaaataatccatacttcagaagaagctaacgcaatttaataagtcacgtcaacaagatatgccaaaatttttcttttttggtgcgagagcggttaaataaatttacattataaataacgaagactattttagtattccatgataaaaaagtgaagagaatattagaaatatatcaattattttagtctatggtacaagccaatcttttttatacccaaatattaaatttatacaaaaaatgaaagtcaattacacataaactaaataataacgattctaaagcaatcacgaacaaaggtgtctgtgtacacaattgtatcgaacaacaaaacgttaaatagaaaaaatatgattaagtttaaaagagtatgataaaaattgatcaaaaaatcgtacaaaattttatgttacagtcaaaagtgttgtcgccaaaggaaagcgacaaaaaatcgatccgaagatcaattttgtgatgactaagccccgcccccctctggtcgatataaaaggggctcattttttccattcgttagcattctaccattttttctctgtaatcaatatagtttgttcactctctttccctttttgtaataaagtctctttgaaagagctttgtgcaatttaaaaaggtatattttaaggagaagaattctcataaaatcaaaaggtttatttgtgaagagaagaaattcttctctgtcacaaatagaagcaaaaccaggactcatcctttctaagggtgagccaaggaaaggagaagaagcatctcctcttacctttccatttgctaaaagactccccccttttgccgggtgagtcagcttccccttctgccgggaagtacagattttttgcggcctttcgccgacaccagtaacgaattaatgaagaattcgattttcggtacacgaaataaataaagaaaattttgaaagagcctataaaaatggcaagaaagttgatttttaggggtgcatttttgaattttttgtgtttttcttagatatttttttcaaaaatgccaaaatatgtgccaaaccccgaaatatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaa

SEQ ID NO: 26798 - DNA, 775 bp, Heterodera glycines
tgaaagaacggaattccttttgattttcgttttgcgctttttgaatgacatgacgtcattcttttacctttctgtgttttgtatttatcaaaccgtgacattacaattaatgaaaatttcggtataataataatattcgtcatggtaactaattagtctcatcatacaaactaattgtcctaaaaatgtgatcaatcgattgatttgttcagctaatctatcgctgaatgcttttgggaaatttgtgctcagttgcgccgaacaacggagccctgaagggcacggcaacggcggatcaaagccatgcgcttgcgacgtccgccacatccgccaccgcatcctccgccgcatccaccaccgcatcctccgccgcatccaccaccgcatccggatggagcaggcgcttgaggcggaggcccttcgcatccgagcgtcagtttgatggcaccgccaccgcttggtggaggagcaccgcaccctccgccgcatccgcaaccgccgccgcatccgccaccgcatccactaccgcatccgcatggagcaggcgcttgaggcggaggcccttcgcatccgagagtcagtttgatcgcaccgccaccgcttggcggaggggcaccacatcctccgccgtatccgccaccgcaaccgccgccgcatcctccgccgcatccgcatggggcaggcgcttgaggcggaggcccttcgcatccgagcgtcagtttgatggcaccgccaccgcttggtggaggagcaccgcaccctccgccgcatccgc

SEQ ID NO: 26799 - DNA, 739 bp, Heterodera glycines
actaaattgtgattataaaaattaatgtttgagattatctttataaatttttttagtgacacggcaaaaagttgacctaaaaaattgagaaaggatgggaaaaacgatgcaaatgaagaaaaattttcagagtgtagcaaaacaaaaagcttttttttaataaatttctactaatttgcatttattgacctctctaaaacgcctcattcccgaaaattccttatcgatgaataattaattatttaattcattaattaatgggacggaatgggctgaggcaaaagtgaaaaatataacgccaaatagcgatgcttatagaagggatgtgatttttagttatttaactttttatgctgctttgtttcgctgagaaatgcacgaaaaacacattttttgcccagaaattctcatgttaatggcattttattcgtaactaggaatcattattttgcacttttcgccactaaataattacactatttgcactttgtcattatttatgccatgtttttttttagaatttcataataaaaatgggtacttttccgttttggggatttaaattaactacgtcaacaaaaagcgcgcgccatgcctatccattcgattatattttggcccaaattgttgcttctatgactcccaaatagttgaaccgctgtttttcattattcgtcgcactttttgttgacattttttaattcaaataaatgtggggcccccaaacggaaaagtacct

SEQ ID NO: 26800 - DNA, 187 bp, Heterodera glycines
aggcggaaggcaacccgcccggtcgggcccggcgccagggactcactgatgcgggccagaggtcgcatgagacgcaggagcaagtccgacatgacgctgacctcgatttgttcaatgctgaacgagtatgttcaatggtgaacaaaaagcaagaggctgcggcgccggggccggtggctcccgtgcg

SEQ ID NO: 26801 - DNA, 1500 bp, Heterodera glycines
acaattcattctgaaagggaaaaacgattaatgatgcccgaaagccttccattgcctctaatttgggcttcaattcgtttttgatcagtttgtgagccgcttcttggaagtccaatgacgattggatggtcaaataaacgttgcgtcgaaatgccacctgaaaatgccttcgattgttaaaccgtgatatgctccaggctgaccatgtcctgttccgtcatgtccaaaatttccatgccggtggtcgctaaacgcaaatttgtgttcccttttcaaaatgtcctccgtttggcactcactttccgctggctgttgctcgtccccctcctcctcttcgtcggccccttcgccctcagattcgtcagcatcgccgatgatttccttccgaatctcttcatagtccgcctcattcttctcaaagtcggggtcgtacttgaacacatctgaattgaaccaaggcaatgagtaaaaaatctatttcccaaggttttgcttcctttaattgaaaatgtcgtacttaaatttatttcggggtcatagggccttccgtcttcgggatttagctgaaccaaatgcgcaatttggtcgtcttcgtcgatcaaatccaactcttccaacattgtcggatagttctaaattgattttatggcttttgttaactaatttcaatttccaacctcaaatttggtcttccgaatatggaacattgtttcgatcatgtactgagtacgttcatggattgagtcgcaatcgttgagcacggcacgaagacgctcaaagacagctgaatagaacggcattatcggaaacaaataaatggccaagacaaatgatagtccaaggttttaaattttggggaggagtgctgatttgaacatgaatttgtccgactattcaattctccataatttatttttttataaagtgcgaactgtgccaaaaaacagatgaaacaattttattaccgattgagcctttcggcgtcaccttcagaagcattgccccacattccttcagcaaagtcacagtcacttcaatcgaatcgtcggtcggccgttgcatcagcaaaacgagcatttccagcacaataatttcgtgcgcctttaattttgtggcaattgtaaggttccgtccgctgtccacccaccactctttggttggccaaatgggcgatgaatcggcacgccgtcacacaagtcattttatcatttcgacgaaaggaccgtttgaattggatgatcagacgacgcagcaccaactcgccaatgtttgggaatttggagttgacaatggcaacgagggcggcgaacacgtgggaaaaggaaggcgaaaaggcctgcgcttggataatcgaacgggcgaacaaacccctggggaatgattggtgaattattaaacatcgggtaaaaaacgaaaagcggcttttagccgagggtggtcattcattggatttactcataagaaccgacattccactgcttgtgaccgtctcgcatatcg

SEQ ID NO: 26802 - DNA, 1706 bp, Heterodera glycines
tgtcccctgtaagggtcgtcgggaccgatggcgaattcatgcgcttgagcctttttgaaataaggaagacagttcctgaaggtatttaaaggctcggaccaatactgggatgactttgttcacttgtgtgcccagcccttcgccccctctctctcccatcggtcgtaatctttcggatgcccacggatgtaaaccattgcattcagcgaacttgaaccaccccaaactcgtcctctcggccagtaaagcactcgtccgttcatgttctcctgaggcatcgtgaaatacatcctggaatgtggaatcaacaaactccaagctcaaaatgcagcgactcccaaccaattgtatttgtcgttgcataaattatacatcagtgccgctggcatatgaatctgagtgtattttgtttatttgtcagtgctaacctctcacaaatcagaattcaccttccaattccaccaattatcttggggaccggcctcgacgagcaaaacgcgattgtccggattctcagtgagacgattggcctaattgttaggtaaactattctttctatttgttggtaccttcccaccaaaacacagcctgctgagcctgcgcccacaacgatgtgcgtcggtttaacgccctcggggagatggcgaacaaactttccatacttgaaaaatccttctctccaacttcggttgtgatacaaattagacgtataatacctcaaagaggaaaccaaaattgaattttgaataaaaggcgaagcaccacaaataagcaaacgcattacttaaatgaatgtttaaaaaaaatcttattcaaacaaagggaaataataactgacagtgtcaaacacttaaagaggaaaacttcagaacaaaagcattttatcgcgcagaaatatacatatgcatatgtgactcctattaaaaaccagaatctcacgatatatctaatctaatcatttcttcacacgatgaccagtcggataggaagtcggagcaccatgaaccgatttcaaatagtcagccaatggttcgaaaatgtgtggcgtttcacctctgagccattttttgaagcgaacatctctgatcttccagaaccgtttattctggagaaattgggttcttattttacaagtccaatcaacaaaaaataaaatattttttcattttcaaaacccaaattagtatcaatcaaaattttaagtctagaccttttagatattttcaagtataatttaaagcataaaggattataacccaaaaaaccgagagtagtccaattgtttggacttatcaaaattacattttaaattatattattaaatcccaccttttttgtgcgcgaaacacattcctgaaggtccctatgctcaaggtcgcaatataaacggcccaattttgcaccaaaagcagtaaaacatctaaccgattgatcttcgaagaatccacaatcatcgccaggaactaagcaagactaactttaaccccaacatttcaagcttcatgaaatcatttactttgtctgttgtctatagattgtcccctcatcaacggaacgaaccaagtttgggcgtaatcattcgttttcttgaaagtgtctcccatgtaatcgtgaccctcataacctcgcgaaactgaacatttaagtcacaacaaaattttgtgtagacttacgttaaatgaggcggattaagtgtcatcttaaaa

SEQ ID NO: 26803 - DNA, 1056 bp, Heterodera glycines
ttgttgacaaacgacacttgggggacccgacaacgctgtgatttatatattttaacttctttagattactcactacagacaaagctgaacttgtccaacagaaattcgggtccagcaggggccaatcacaattacgagccgacaaacaacaaatttggcatttggctttgccatttttgcatcaaagtccatggtttttcaaaatgccgaagtcacagcaacacaacccaaacatttacgaaaatatgccgacctctttgaaaatgttgatccattcatttgttcgtgatgcattatgactccggcaacacaatcgcttcggctgcccgtcttttgtcggagtgtgcaaccatttggacaacatttgggcagaagttgcatttggcccatcatcaccgatcaaatcggggaacaaatgcccggaatcgacggagtaaatgttgagatcagtgagaattgttggcgaagtgaggcgaagcaaaatactcagttgaacaccatcggaaaaggacaaatggcgaatgtttgtcgcaaaaaggggccaaattcgacggacaaaaacattccaaatcggttggacatcgattttgtatgacaacggcaaatacaaatacaaattggtgcctctgtcaaagatttgcttatttgaacggagaaatgcgatgacaaagtgatcaatgtgcctgaagaggaacatgattttttgcataatatctaaatgctttggctctattggctgtttacacgaccataaaaaagacaacaccataaaatatccttataagtttaatgaagggctcccaagtttttttttcaaaataagacaaaatggttgaaaaactaagattcgggtgctcccaaaaataagatttttctaaaactaatctacatagagcgaggaaacgcaataaaaacatgaaaatcgacttaaaacaatattttattagcgtaaaaaaagagctgccaactgaaaattttcaaaatcagcatttggccgacaaaaaccagcattttggaaaatttttattcaaaatgaaaaagtcaataaaagttttt

SEQ ID NO: 26804 - DNA, 1463 bp, Heterodera glycines
  misc_feature (13)..(13): n is a, c, g, or t
cggatggtttttntgggcgaaatgaaattggcctgatgatgggcctggcgcacaactctaaaaaacttctaattaattattttgttaattctttaaataatttcatttataaataattacagatcctcgccagtgaaatttcagtgccaaaaagaaagaattaggacgagaggctgacagctagatgatactatcaacaagttcatatgagaaacgaggaaatttcagaaaggaaattcctcaaaaagtctttttcttcgtaaattatttcgggacttttcgtttatgcgttctaaacaattatttatcttctaatggcttccaagttattctgtgctgatccgcgtttggccaatttggaacatttgattttaagccgcttgcaatattcaaaaatgacaaaaaatttattgactgtggaagagaaatcccattaggacgcatgaacaaattttcgttttctgtccaaatcaccgatttattccattctcgagctcttgtccagtttaggccccataaatttttttttaatttttgcacttaatgcaaaaaacataccagtaataagtttttggagtcgctgatcacgaatctggcattcatttcgaccaagtttaaatgaattttgctgaaaagtgacttttcgatttttttgttcgagttcggctcaggggttcggaagttgtcgagatggatgtgggattagtggttaattacccagaaagcctacataacagggatgtgcctaggtttcgcttttcgcatttcgccttattcgcattttttggcgtttcgcatttcgctttttggcgcgaaacgcgacttttacatccctaagaattggattaaattcccataaaatttttcaaaattttacctataaattggctaattttcagtgaaaaactgtttataaatgatcaaaatttccaatttttttccccggcggcgcctatcggcaccgccgcgcccaaattttaatcaaattttcaaaaattttcccggcggcgcctgccggcgccgcctgcccctcttccaaaaaagtttttttggagcgctttattgatttttaaatttggaataaaatttaaaaaaatgatttttgctttgtgattttaactattaaaaagttgtagaaaaaatttcgctttcgcattttcgcatattttagcttttcgcatttcgcttttttttcatttcgcatttttcagtttcgcaaatttcgcttttcgcatttcgctttttatttttcaatttggcccatccctgctacataaggtgtgtttttttataaatataaaaaaattatggtgcctaaactttgcaagagccccttctctatccccgcacaatgccagactaaaaaatttgtgtactaaccagggctggacgtaactgattttcaattacggaaatccgtaatccgtaattacggcaattttttcagttacggccatccgtaa

SEQ ID NO: 26805 - DNA, 1453 bp, Heterodera glycines
agaaggactgaaaaatgagtaaagtgtgattaaacgatgagataattaattgattcgatcaaacaaattaagcataaataataaattcaaaattatttaatcatttaaaacatattgtaaataaaaacggaaaaacgccgttcaattccaaccgaaggaaacgatccccccaggccgttccggggccaattcgtgtcaatttagaacagaattggacgacgaaatctatgaaaattaatcaatatcaattataatatcattttacaatcataacatttgaacatttaaatagataataaaataattaatttattgtgattaaatataatggcaaaggaaaaggaaggcaattagcattaataaaaggcaattaatatatagtaatgtattgtataaataatatgataagttgaagaagccaactgagttaggaggcagcgaatggcatgcaaaaggaggaaatactgtacaaataaattaatgagtgagcgattaatggcaagggttcgccggagacttgcttttattgccggcctcctctcccctcgggggccaactcagcaactggcgccggacagttcggctgaaagttcaaaccgtgaaatgaaaatgccacagcatgggggtaatttatgcgaggacctttcccaatttggcaatgttcggcttcggcgccaatggcggcgccttctgttgtgttctgctgagggtcgatgaacgtgccgccggccttttgagaagagaagtggcggcagtgtccgtcaaatcggcagtcgttgtcgctgtctttggactgcggtccgaaggcgcaacggacggccgagggatcgacgactgtgagggggtcttcttcagggagaagcgactaaagcacataaatgagtgccacaaatgcttttgaccccctccccctcccctcgcaccttcgttcctcgtcgtccgttttaggacttttggtcgtcccacactccacgaccatccaatgggcagcgaattccgcattcacgtccgcgggcagttcggcagtgactttctgctgctgttccaaaactgcttcttcttcttcttcatccgctgtcaaaaggtcgtccattttttgtccgaatttttgttgatcttttggccttgcaaatgcttttccttccctttttctgttcggatgcggcatcatcaaagcgatgctttcctccaaaaggcgatcatttcccgctgaaattggagacacttaccaagaaactgtggttgtcatttcgttttgtttctccccattttttttacttctgactggcgatttggacggactgttcgaagagattggcgttgtgttcagggcaaaatgcgcatcctccatagcaatgcattggatcggtgcgtgcggtttgggcatgtaatttcggatgacctcatcaagaaaggcattgccaacactgaaaggaggggatacggtcaatta

SEQ ID NO: 26806 - DNA, 893 bp, Heterodera glycines
attaattccaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaatttttgaagagggtctccggaacggattaacatcgggggtacaaaaaaaaaaattggcctaaaaaaaaaaacgccttttttctgaaaattaattcaaaatttccccagctctttggggaagggaaaaaattttgaaaaggctccccggaacggattaacatcgggggttacaaaaaaaaaaatggcccaaaaaaaaaaaaccctttttttggaaattaattccaaattccccccctttttagggaaagggaaaaattttgaaaaaggtttcccggaacggaataatatccggggtaccaaaaaaaaaaaatggcccaaaaaaaaaacacccctttttttgaaaaaaa

SEQ ID NO: 26807 - DNA, 2134 bp, Heterodera glycines
tgggctggggatgagcagatttacggcacaagccgcgaacgaacgaaagaatggcacggagaatggggcagagaatggcagggaatgtccggccgcaacagaatcccgcagagagagagagagagaaagcgaagcaaaaagcaagttttggtgaaaagttgagaatggcatgacatttgacattttggcatgatttgtttcaattgccaaaacaatgtgtgatgacttcaccccactctaattgctgtctgtttgtccatttaaaattgcgtttgttttgccctctcaaagttcatgaccctctcccctcaccccgcccttttgtcggtcactttgttgtcgctcgttgaaagtgtctctcccctcgggcgccttcttttgacacctcttggatttcttttcatgaaagtgtgacggcgttgtgtggaagggatcagcaggaaattgccatttcccaggggggatgtgcacttttcgtaccattcactcgccccccccgtccaaatgtgtccctttgtccccgacaaagctcggatgagtttgggtgagagttattgagagcgggtgagtgaatgagtcgggactaattagagggcgcatccgaacaaaaatcgagcgaatgggagaagaaagggggggtgagggaatggcatcacaaaaaagggcaaaatgatagccatggagaggaaaatgggagaaaatgggaaaaaggaacaaaaatcagagaattgaagcagcaaaaaggcaattttagccaacaatggcaaatccctttttggcatttcgaaatttggtgttaatgaaatgtttgcttcttaggtattttaaaatgtgccttttccttcgaaaatgccagtgttttttcagcggtccgcgaagatcggatgcgcgggggccgcaacaaactcggcactttctacaagcagcacagagccaaccgaaggctttcccagcaccacccccatggcacagccaacggcggcgggacgcgacattcgaatggcattgagcaaacgcagcagcagcacattttatatggcaagtgatcaagcaaaggacaaaatttgaaatctgagtaattgacagaaacgagcggaagactgccatcggtttgtgaagggaacggcagccgattttcgaccaatgaaattaatgccaatggggcgacgacgccggtggcgaaacggcggacaacgtcggcaaagtcagtggggagattggctaccaattaattaatttatttaataccacattaattatttcaaaatgccccatcggcaacatcaaaggggaccattccctttttcccctgccgcccattgcttccatttgtccgtcctttccctccctctctctgctgctgataatcctcggccctcaaaaagcgccttcattctatgatccgatgcgcgaatattttgcctattttaacctccttttgtccgagtgcgatttttatgcataattaacattggcatatgaaagaaaaatcggcggattttgttggaaaaatatgggaaatttattagggaaaggccaaactgaaaaatgaaattgaaagcgaaaacgaaaacgacgaaagccatcccttaaatttatgtgaaattaccaaaaattgggaatttttaaaattatgtcaattatttttttaatgaataattttcgaaagtgcacatttatatacaattctttgcgttgagttttctcctgaaaatgacctccgtcggcgccattctgtggcattttatgacaaaaaaagaatggaaatgaaagggcatttttcaatgagtgcgggtgaaaaaatgttgtgaagatgaaggagatgatgatgatgatgatgaactcgagatttgagagggaaggaccacattattatttgtttgtccatccgttcataattattcgttcgcggacaaatggggaaggcggcatttttgcgcgaaacaaagcaaaaatagtttttcaatgaatgagagagagagagagaaagagtgggggagagagagagcgagagagagaggggggagaagagagagaggggagagagagagagagagggggcagcagagagaaaagagagtagaaagagagtagaaagagagtgagagagagagaagagagaggaataggggga

SEQ ID NO: 26808 - DNA, 624 bp, Heterodera glycines
aaacgggcgcgaagcgcccgttatgaggccgcgaagcggccgaatgttctaaaaaaacgggcgcgaagcgcccgtcatgaggccgcgaagcggccgaatgtccccaaaaaaattaaaaaacgggcgcgaagcgcccgtcctgaggcttaacagccggccgcgaagcggccgaatgaccccataaaattatgaaatgggcgcgaagcgctcgtcctggtggttttatcgacaaaaataactccattaaattgcagttttcgtatcttggtactcatttggctgcatatctgtagtaaggaaaaaatattaatattcctttttttaatatcaaaaaaataatttttattgtatttttaataattcccccagaaaaaatttaatcaaatttcgcagaattttattatgatacaacaaaattcagtggtaattttcagtggttttatcgacaaaaataactccattaaagtgcagttttcgtatcttggtactcatttggctgcatatctgtagtacggaaaaaatattaatattactttttttatatcaaaaaaataatttttattgtatttttaataattccccccagacaaattttatcaaatttcgcaaaatttattatgatac

SEQ ID NO: 26809 - DNA, 924 bp, Heterodera glycines
ggccaccggcagtcgtgtaagccctggcccccggcaatggtgtaggcccggccccccggcaattgtctaagcccgggcccccggcaattgtctaagccctggctcccggcaattgtctaagcccgggcccccggcaattgtctaagcccgggcccccgacaattgtctaagcccgggcccccggcaattgtctaagcccgggcccccggcaattgtctaagcccgggcccccggcaattgtctaagcccgggcccccggcaattgtctaagccctggcccccagcaattgtctaagccctggctcccggcaattgtctaagcctggcccccgacaattgtctaagcctgggcccccggcaattgtctaagcccggcccccggcaattgtctaagcccgggcccccggcaattgtctaagcccgggcccccggcaattgtctaagcccggcccccggcaattgtctaagcccgggcccccggcaattgtctaagcccggcccccggcaattgtctaagcccgggcccccggcaattgtctaagcccggcccccggcaattgtctaagcccgggccccggcaattgtctaagcccgggcccccggcaattgtctaagccctggctcccggcaattgtctaagcccgggcccccggcaattgtctaagccctggctcccggcaattgtctaagcccgggcccccggcaattgtctaagcccgggcccccgacaattgtctaagcccgggcccccggcaattgtctaagcccgggcccccggcaattgtctaagcccgggcccccggcatttgtctaagcccgggcccccggcaattgtctaagccctggcccccagaatttgtctaagccctggctcccggaaattgtctaagcctggcccccgaaaattgtctaagcctgggcccc

SEQ ID NO: 26810 - DNA, 1312 bp, Heterodera glycines
cctcccccaaagacggtcagtgcacaataactgctgcaatttctcattgtccattgtcatgggttttgcgccctccaacggccatcccttcaacatccaaacttccaccagtcgatgaagtgtgaaattgaacaaatgtccgtcctttatccttccctcctcccccctcagtccaccagtcgcgccattctggagccacattagtggaaatgagaagtgcgaagagttgagggacagatgaattggacgaatggagagggggaaaagtaggaaagagtcgatgaaaacattttatagttgaacaaataaaagatgacgatcctttcgcgactgattgtgagctgtcaaagatcgtctaaagctgatttttccgggggcggaccacacggctgaaccatccgacagagcatgttgtacttcgttcgagcacgcgtctcattctcacaaatggccatcatactgtaataaaaggaaaggaatgtaaatgaaatcagacgaacggacacctcaaatggtcgggatggccaatgattgaagcgaaagtgtcacgatgctctgagaaacaaattcaattaacactttgaagtgcaaaagcattgacagtagattagaagccaaacatttaaccgctaattaatgccatcgttaatgcttacggttggtgatccaatcccagcgagaactgtcggcatggcccgtgcctgtgtattttgactgaagatgttccaattgggccagcacatggaatctgagaaagaaaaagcgtaaacaacagcataggacctttgaccgggaatccatcgaggcgaccttttttaactttttttcaatttacgaacataacctcggttcatttgcgccacctgttgtcattgtacgccaaatgaggacacaattaaattctgtagaaattgcaaaacataattttcaaaggaaggataaaaaacttaaaaataaatatgctaatattaaacaagcatcagtaaatatcaaacagaccgacagaatacattatttacactcggaaatgaacaatcgtttcgaaataaattatcttcttggactagacaaaaaaagtgaataaggcaaatgtttggggaaacggcaaagaataacgaaaataaaacagcaaatgaaaaaacttgtcaccacccatcattgattcattggttgcgcctgctgttcgaatgttccaatccagcaatctcttccaatctgaaaaattcgaaattcaaataaacaatttaaaattgttgtacgtatgtccgtatttcaagtgcacaaagatgaaaaccacgccaagacaagcaca

SEQ ID NO: 26811 - DNA, 247 bp, Heterodera glycines
agaaatatgagaagaattcgtgaaaatgttgcgcactcgccctttaaaggaaaggcaattctcaaccttacagcccgtccacttggacagaaactcaattttgacgaggaaagtgaaacccatcgtggccagcataattagtgcgaagcacacccaacttggaggagggagaggagaggggtaaacgctgcaggtcctgctcgagcggccgcccggggatcgatccccgattagtaacatagatgac

SEQ ID NO: 26812 - DNA, 962 bp, Heterodera glycines
  misc_feature (947)..(947): n is a, c, g, or t
ccccccccccccccgcaggtgaattaaaggaaagtcaacagatggagggcaataataataaggacaaattgagacgataaagcatccaacgagaaaaacaaaagccgtcaaaactaattaaatgacagtcattagtcactcattaattcactgttctttcccagcaccaccaaagcgcacttagtcatcacaaaaggggcaaaaacattgacagatgtttgagaaaggggcagaaattggccaaaaaaatgcggggaggggtggcaccgcaagggattttagtcacccggacgacgcaatgggacggacggacaaaggccgacgaaagaaaggcctttgatcagagagggccaaattcttagtcaataaagcggtaattttacctttgactttccatttttaggctaatgttctgattttgaaaagttgagcaagatacccactccaacgtgaacaaatgccaaagaaagacaaaacgaaagccaaagtaattaatgaagcaattaaagcaaatgacatttattctgtttcctctttatacggtctgaataaacaaatgtataaatgtgttcaaccaaatcacagtgaaaaggcaaaacaaatgccatcgttttgctcaagcggtgcgattcagcgagaaaaaaagcacctgaaattaataacaataagaacacgcttcgaattattgaattcactgaaaatgccggtggcgtctcctcccttctctcctccctcgcgccctcccctccttactctctcctctctattctcccctccccacctaatccctctctcctatcctcccttctctccctctctcttcacctccttactctcctctctcccctcttccctgcctctctcttcccctcccctccctactctctcctctcttttcccctcccctcatactctctcattccatcacctctttgcccgcttcgttngttttctgaactgat

SEQ ID NO: 26813 - DNA, 1506 bp, Heterodera glycines
  misc_feature (1402)..(1402): n is a, c, g, or t
  misc_feature (1413)..(1413): n is a, c, g, or t
aaaaatttaatgggttcattaggtttatttacgtactgcaacgcacctaatctccacgattgtcggctcgacgtacaaatttttccatggtattttaagcaccaaactttgaacataaccaaaactcagcttgaccggcaaatccaattcatcaagcgctgtatctttgatctccaaatgattaagttttacatcgcctccccaaatgccaatgttcagctgggacgcatttaaattgtccacataagtgcccaaaaagcgattaagaagatccgcgacaactgattcaaataccatttcaaatttttctaaaaagtttcatcacaaataatgcgtccgtgagaaacaaaatgagtttttcatattaaatcacaaagttgagattttttctaccaattccgaatctttaacctgaaataataagtgataaaattggtcaaaaaccaaaatgtgaacgcttttcagggtcgcaaatgtttaagttgtaaaaattgcgcaccaaaagggtctctcttttgtttttaaaattagttcagattgatttcgtaattgtgattctttgttttgtgggttagtgagtggcgaaaccaacaaaaaaggaaaacaatcggaggaaaacgatgcgtgtggtatttttaaatatgtataataacaaaacataatgccaaaaagaaaagaaaaaaatgggaacgaaggaaaacggcttacaggaacagcaagaattcaagagaaagtaaagcttgcttactaattgctgccgtaagatttgtcagaatttgcaagtcaacaacaagctttcacttttttctgttgtgtttgtccgacaatttcttttttatttgtctattttaaatttggtttttaggtttgtttattttcaatttttttgtcttcgattgtttttccttttgattccgtttctgttttagaataacactgcaattggcttgtttcgttaattaaaatgtggcctcctcctccgccaatgcgccatccctcccaatttatcaatggccttggtcgtccccctccaccggtgtttccgtctcgtgaacttgctccgatggattatccgccgggtccgtccgctgctcttcctccccattttcatcccccgccgttagctgccgtcggcacttcgtttggacccgatgaacgctcaatgccgccatggcacagacgaatgggtggcgagcaaccgttgctcaacgacagttggaagacggcggcggattcgtcgtggcggcaaccgccgcgacattttgggccatattcaagtgagccgagtccttttagcagttgaattttatatttgttgagacgatttcaggccggtcccttgattttgacattcatcgttttacagctaaattttggctagttttcccgaaaccgtgactanatacctaccanaaatcaatcgatgctaggtatggtaatccttttttcatccaacagatcatgaattttaccgccagcagtacgcccaacttcctctgtctcgcc

SEQ ID NO: 26814 - DNA, 721 bp, Heterodera glycines
tagattattttagtttttagcttataaattagaaaattagatattttccgagattttatgccacgagaatttcggatggggttaaaccaatgatccaggcgtccttatcgcagaattccatgattcgactacaaaactatgggttttcaattcaaagttaaggttgaaatatttttaaaattgtcagggatttaataatgcaacacccaaataaaaatttgcatcaaaatttgaatattgacactgattcactaatctcttccaaatcactccgtcccgccgccagcggctggcgcttttcctttcccgcaaaatccccccagtctcgattctcgaggatgagaccaaaaaagttactgcacaccaccatttaatcccttcctatttgccttcccgatccgtccagagacggacggctcgctgtccataattcctcccacatcgttctgtttgatgtgtgtcccctctcccgccgatctgcccccccccatcccccgccctctcccggcgtccgcgcctttttgctgctgccagctgcctgaagatttcttctgagccaattccagccagccggcccagcatgatgctgtggtgcgcattgtttttctccatcatccacctccaccacctccctatcccccaataattattcttcttccagcctcctgctgtccagtccatttcccctccttctctccctcccccccccctccctcccggt

SEQ ID NO: 26815 - DNA, 869 bp, Heterodera glycines
aaacaaaacaaaaaataataacttttcgcattaataacttattgggccagggattagtaacttttgccaatgggccaatttgttgagattcaaataaaccactaatctgtaatcagggcctacggcccaacatttccccctttgttaattggtgaatttttgggcgctggggaattcgtctcctacctatcacttttttgtgcttcgacgactttatcctctgctttacaaaacccaaaaaacacttatttttcattgcttttccattcgtttttcgttaataaacccttttttgtggtgaagtcttgcctcttggcttttccgctttcgttggcttaaccatttccccctcgttccccattgcttttcgccccccccaccgtttgctttacccattttgctccattggcttacagggactcagtcccaatttgaacttggctttaccatttgttggcttgtcgggacccaaatcggaacccccgggcctttttctccttttcctggttggcaaggcatttacccccttgtccatcacacgaagggtcctgctcactgctgctgtagacgctggacgatcgctaaagggaaagatgaaaattgacgcgaaaaggaaagaaacggaagtggaaaatgagccattgtaacaaggaaaacaaagagtcgatctcatcggaaggatgttacactgacaatacacaaaaaactcaatttcatgcagaaatatgcgaagacaccccttgtacgtgtgtgccaccaccaacggcttactttgcttgctctttcgctgtccactgacgattccttgtcctttccaagtgtcaaatttgccatatcctgcagcaccgcacttccatttgaaggctgat

SEQ ID NO: 26816 - DNA, 876 bp, Heterodera glycines
gattttaaaaattcatttgcttctgttttagattgtcgcgattctcaaatcgtttaaaacgaatgcggaggagcagtggcgcatcagacgaagagacggggaagggaaaatgtaaggggacagaccgatccaagggcgtagccttggaggggctgacaaaggataggtacccaagtaaattttttgagaattttaagcaattctcttaaaaaaatcacaccaaaatcattttttggcgaaaaacggctatagattcccctaaaacacaccccctaattaattttggatttccaaaaaaagaaaaaacaaacctaagaatcgaatttttgaattcagcccccccccccccgaatagtgtttcatattttttcccatctttcagctttctcttcacttcccatgagcatttgtccgaggcgttaaaggtacgtctggtggatgaggtcggcctggacgcggtggcgaacacggaactgcgcgacttggcactcggcaaccgcgtctgtgccaacaaaaccgcacacgcagtgccggcgatgagtgtggccgagtgcgccaacgaaattttagcagatttgttgctgttccaccaatcgttcagtgagtgccttcaatttcaataccactcataaaagaaatattcggagcataactttttttttgatctgcgtatactcgggtttttattgactatctaattcaaaaatgaaagcaaaacaaattctaaaaatttggaactccttttttaaaacatttgtccatgcatattttttccgaattgaaaatttttttaattcctctggataagctctggcctcatcactcattttgtattttttcttaattggcccgttagccaatgttggcccctttgga

SEQ ID NO: 26817 - DNA, 1109 bp, Heterodera glycines
ttcaactcgtttttgccacttctataggataatttatgaaattgacaaaaagcgtcaaaaacctagcaatggtacctaatgtcccacaaagcgatttcgccactgtcgctcccagtcaccaaaacatagtcacggaaacggtcccagcggactgaccaaatgcgttgctgcaaacagcgaatttgttgtgcagtgttacccaatctttaggaagaatgagcggaatgtgaatggaacgaaacgatggataccgcgggtccaacaaaacgacatttgacgaggaagtggcaatggaaataagcgaagagttgcaatcgcacggaacgaaccaatgaaagctggaaatgggctgctcgaatgcaaatttttccaccgacttgagctgatcagcatcccagatcttgtaaataaaagcatcagtataatttagagtccgaaatcttgaaatgtccgggaccaaaactcgaaaatctactggggccccgtcgggaccgggacatattcaaaaataatgaaaagtttgaagaatttgaagagaatgggcggaaataaattaaaccattgtcatattattgtttgacgtgaattaacctttagcaatttgtctcttcctgacgttgcaaaaatgcttgaatcgacgggataccattgacatccattgaccataaattcgtgatgacttttcctattggtgttaattacgacgtaatgcctcgggtaaacttcggcatttgacagagagttggaaaatgactcgaaatcgacgaccgacacattcccccgagcattgccacacagcaaactaaaaaatagatttattgttaatcaagttaataaagttttgaaaaaccagtttcaaggatcaaaaattttttttaatcatttttggtctcaaaatgcatcaatttacgaatacagccctttggcttttaatgatttcaaaagctgtttttaactagcgttgaattatttatgttttaaatccaaaattgggggcaccatctaaaccgttatttaaaagtaattgcgtttatcattgatgaatgagtaaaaattacacaccaatcggggcgcatgcataatcaaaagaccatggccgaggtgccggc

SEQ ID NO: 26818 - DNA, 1474 bp, Heterodera glycines
  misc_feature (24)..(24): n is a, c, g, or t
gatcagtcagtgattgacaaatgnatcattggtgctataactgatcagtgatgaatttgaaaacccaatggctatgacagttataatcaacacttaaaatatgatcaaatgcttaaaaatgcaatcagaaaataaaaattaatattcgcatgtttttgtactgacttaataatgggtcgttttaatgtcagttgtttcgctgatcatttgatcaaatttcttttctcattgtcagttatgcaccgtctcaaacagagaatgtttcgatggcattttcaaaagaatggaaacaatcgccaaaaggcgcgacagaatgttcgccgaatgtttccaagtgacaaattttgattaaattattttaatcatttaaaatcagtcttttgaggtgattgggagcgacggaagccgatgtggttgctgtttttgttgttacaagcgggcgacgatcagcagtgggcgatggaggacagcgaacggcgcgtgccaatgctcgatttgtacctggcacaattggcggcacatggccaaggcaaacggatcctttcggtaggcaaaaggggcggggcaaaagcatttaaaatgaaaacaaaaataggcatttctaattagccaataattggcgataatggcaagcaatttgttattttttgttcaggtggaaagtgttgaagaacagtgccatccgttggaatccgtaaaggtcagaaaatccgaaaaaagcataaatatttattaattgtggcacttttttcgactcattgtcagactgaccaattattgttcgccattaattacactttggcctatttggagtgggcagaaaagcggtgggacggcaaaagccatggggagggggaggaaaagccaaagggggacggatcggcattagcacagctggtggaactgtacaaatgtggagcaatgggtgaagggatggaggaggtaaaaggtttttgttaggaaggctagctttggtgctataatttgaattaagaatttgcgaatattacgtagaatattacggaaattaaagtgttagtacattatacgatttatcggtcaatattttcgaatttttatagacaatttgattatccatacatatccatcgaatcatttcccttctatttataaactttggacgatcaattaacaacagctcattttactaacttataatggtcatattttcttttttaattaatttttcttgataatcacaataaataattatttctacctcccaataaaacaccgttttcttcacggttctttcagacccgaccatgggcaacaaagttgaggcagacattgatgcaaggtcaccgacaatggaaacgcccaaaggacagccaatgatgccgaaacgaccacaaaggtgccgcacgcgtcgtacactgaagctgctgtcgtcgccgctacagtgctatttgacgagaacgattaggttcgcaacgcactcctacagccctac

SEQ ID NO: 26819 - DNA, 1239 bp, Heterodera glycines
  misc_feature (36)..(36): n is a, c, g, or t
  misc_feature (114)..(114): n is a, c, g, or t
tcgaacgctaacggacgacctaatggaaaaaaatcnccgaaggagagaatttaataaatccatccttcgggggaccgtgccgggtgccgcggggtaagcagtgctggttcgttncatcacggcaccgaaccttttggctagtcagcaatcgttgcttacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaatttgggcgcatcggttcggggggactgaccgaaaaaaatatttatgaaacaaaaaaatcgattttttcaagtgtccgtttggggtactcaaacaattatggggagcaaaaatccaaagcagaattaaagtacaggctatagggaagctattcccgagggattcggtctccccataaatctgggcgcatcggttcggggggactgaccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaattggtgcgtttcagagcagtttgtgaaaaaatatttatgaattaattttgctaaaaaaataaaatagtgaagcttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcat

SEQ ID NO: 26820 - DNA, 1114 bp, Heterodera glycines
catttaagagggcaataaaatgattcaaaaccaaaagcaagcttcaaaatgcttttaaattttccctgttcctttttataaatttcatagattagcgatgtgagtattagtttaaatttttgctcagcattaacaaaaaatggatttttaaaataaaatttggttttatattttgtaaagccaaattttaagtcctcatgacataatgactcaattacagaacacccttccattttgagtgtggcccttttagttttttggttcttatatacccatatgctcccaaacaattgtttggagcctattttcataatttaacatttggctctgcaccctccgggactcgaaatgtaatcttcgggcttccattaatgaattttgcgattgttcctcgagctttgttgcctggtcaaaagttttgcatctctcgaaatcacgccacgtagattcggctttttctgactccaaattgattttgtccaggattgtgaagatttcccaaattgaatcggacattttaagatataattctcgaataccattagcgtaaggagccttttctctagattttattgcacgattaagtgtttcgcgagaagatttggcaaaatcgcttacttcatccgttagcgcagctacatcccgccatgctctttctgtctctttttttgcagcttccaataatatggaattagctttttctgatttttcagaattcatttttttatttttcatttattaaatttttcttttatattttataagcaataaattcatccctcaattcttcctgaggtctttgcctttcaaaccgtatttggttttcgcgcattgtttcttttagtttatttgccaagtctccaatgcctaaatcgggctgcgagtaagcggtccgataaatttgcccaatttcttgccgataatttttggctatttcgattgattgtttggcctcttctgctaattcttgacacatagttaaatcttttctgtctagacatttttccataccttttttaatatttttcatatttttttccttctttttttattttggcaaaaagggcatgaatttttaaaactccattttaaaattttgttatgccaaaaattc

SEQ ID NO: 26821 - DNA, 860 bp, Heterodera glycines
cgccgaaacccgaaaagccgcgccgaaggggcgttcccctctccccgtccccctctctctcccgtcccccgtcccctccccctttctccgtctgtcccctggggcgtcgtttgttttatctttttgcgccttccttcataagcctgtccatgtccaaagttacaaaaatgtggtaaaacaatatgagtacaatagattgacgacagtagagataattaattgggtaataattgtggacatgtcgcaatggctgaccattcattttgtctgattgtgttgtgctgtctatgctttatccccctcacattcaatccgtcgcccttcgtccttttttatgcttttatcccacgtaaatcggctccccattcattttcccctcccccaattctcccttaataatttcccccgcgctcacgggccggttcagtcagtcagtcttccgccgctttaccttttgcctttctttgcattgcaccgaaaatcgcttagagaagcgaaaccggcagaggaagaagcaccgaaagggacggaagaaagaaggggaggaaagggagaagaacaaaaagcggagaacattacattgaccctgaaaggagaaaaagcggcgaatggcgaggaaaagcgcaaaaacagaagcagcagcagaagaacaaagggcacggcgaaggcatcgtccgaattcgctttcactccgcagcgcccgccgcccttccgtgccaatggcactcgctgttgttctcccattgtttctgatccttccctccaccgatgcactgatccgcaacaacagagtgattctccacgacgaatatttgcccccgggggaaattggggaggaaatgggcgagacaaatgcgaaa

SEQ ID NO: 26822 - DNA, 279 bp, Heterodera glycines
tataataacgctgcggacatctacattcttgaattgaaaaaaattggtaattactctttctttttctccatattgaccatcatactcatactccccccacccttttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 26823 - DNA, 899 bp, Heterodera glycines
atcaaaaaatcagatttttaagaattttttgcggcgctttttccaaacttttgggaaatgaggcgagggaagagggtccggcggtgccgaaaggcgcggccgtgggaaatttttttgtaatttcgttttgatttgttaacagattttcaccaaaaaaggccgatttttgcaattaaaagctaagcgacgacttttccttgcgtttaaaaaccaaattttgccacaaatcttatattttcttgacaaaaagagtaacattatgccacaaaatttcaaaaatatgagttatctaagaaatcagaacaaattttggtcgctatcccaaaatcagaacatttctgacaaatcagaacatttttattttatcagatttggaccctccaaatcagaacatttctgataaatcagaacagatcgcacccctgtaataattggcattgctaagatggaccataaaaaaatgaaatgtttaattgttcggataggaatgcatgatggaaaatacagactggcgggtcgggtaccggctgaaccggggccggcaaaccggtcggtcgctttttggaacaaaacctgactcgggattggttgttttcgagatttcaacccggcccggtccggctaatttgaaaattggtctttaatgaaaaagcattaatgacatttgcaacaaaataccctgacatcctcatttttgccccttcttgtttagtgcaccttccaaagttgcaacaagcggctgaggaataatgtgatgtttatgcatcacatttgggcccatgtcgccatgcagaaaccgatggaatcggacgaacagttcaccaacttgcacctgctgatgaccgagcatgccaacggctccgacacagccagcgtcgacgaacagcgcagcgatgtca

SEQ ID NO: 26824 - DNA, 723 bp, Heterodera glycines
caacagtctgatggactacgtgttcggcatgttggagcagtacgccagctcattggagcaggaagtggaggagcggaccaaagagttggttgaggaaaagcgcaaaagtgacattttgctctaccgaatgttgccgcgacaggtgggccaaacatttggccaaacatttttttaatttaaataatgtatactcgcggtgcggcaatttgcgggatttcagtccgcaattctgcattttttggaatttgtgggattttgcagagttgatcccgcgggatcaaccctgcaaaaaaaaaaaaaattagttccaatcccacaacggggttcgtaaatttgaaatttccgggcgctaatgtattataccccatagttatttttgcgatggaattttgttgaggaaatgagaatagtttaaaatatatttgcttttttcaaactctgaccggaaaagagtgaaaaaagcgttattatgctctatatatcagaactaatgtgcagaagaaaaggcatatgcctcaaaagtcgagctctaattattatatttttcatcttccattatcggatttaacaattttgtcgaggaaataagcgaatcgaaaatttcagtgcattcgggatcactaaatcagattttaacatttttgcggcacatttttccaaaaaacttgcgaggggagcgagcggatgcatgctatatatttttatttgggtggatatttggga

SEQ ID NO: 26825 - DNA, 907 bp, Heterodera glycines
cccccccccccccccccttcaaaattttgaaaaaaaaataaaataataggagactcagaatttgaaaaattttttataaaacctgatgacaagctaatgtgataaaacaggttaattcttttcctttcagtatcccctgcaaagtttgggcgcttctgatagtttctgaaaaaaagttaagcctaaacttttggcctgttaaaaaaggaattaaaaattttaaaaatttattcatctcccttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcgaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttatgaaacaaaaaaatcgattttttcaagtgtccatttggggtactcgaacatttatggggagcaaaaatccaa

SEQ ID NO: 26826 - DNA, 898 bp, Heterodera glycines
cttgtccgaaaaatacacaaaaaatttaattttgattacacctataaatatattcaaatccgtacgttgaatgtccgccatgaccaccaccaccatagccattgctcaactgctgttgctggtgttgttgctgttgctgcgcgaccgccaacgcggacaacaattgttgctgctgctgctgttggtgttgtgccgccgcatttgctgctccaccaccaccaccattatgagcaccggcagcaccaagcagtgcatgctgttgctgaagtaactgttggacgagctgctgttgttgttgctgttggagtgccgcaacggcggccagcgaatttgcggcgtcggcaccgccgtttccgagcgcggcgagtgttgccaactgttgctggaagtcgccgccagtgacgccgctcgctgccaacaattggtgcagtacagtcgctgatggtttctgatcgccgccgccaacccccgcggcaagtgcagcgaacagcaactgctgctgttgatgctggtgatgggcagcagcgaccaagctgctactactgtttgacgaagtgccactgtcatggtggtggtaaaggtggtgctgaccaccggcgatggtggtggaggccccattgttttgttggttgagcaacagtgtggcagcagcggcggccaactgtataatacagacttagaaatgcatttaattcagcctcgaatgtccaaaaggtatcacaaaatttgcgaaatcccggaaataccggttcatcaccaagtttttgtgaatttttttttttgctttacacacaactttttttggcgcggtttttaaaaaaacttttgcgcaaaaggagggggggggggggaggattaatagatcctgtcaaaaaatgacaaattttctagcccaatt

SEQ ID NO: 26827 - DNA, 660 bp, Heterodera glycines
cataaattgggctgatgatttattcatttatctttgcttgtcgcttatcgcttgacatcccggatatatcccttagcaaaaaattagggttgcaaatgaatggctgtggaattgacgcaatgattggattgggtggtggtggagtgatgggatggaatgaatggacgaagcgcgtaactaaggcggaggaggggagacggaggaggggagggagcgcagggggagacagaggattgggaggggggggatgaagcggtaggagaagcagcccaagaggacactccggtcaagtttcaatttgtggtcaacgctgtgcaaccgttgcacgatgcttcacccctccccacccatgttttaaataaaaaaaaccgaccctaccaatcccgggcctctctcccacccgtccaaccatctgtttatccccctctcccctccccgcctccccaaattctgctgtttgtgagtgcaaattggatttgttcgattactccctcaaataggagaatgattgattccgtgctccctctcccaaagtcccctctcaaaagggttcgcgcgacctattcataaaagtaagctacccccccccctcccctcttaatttttggttttcaacagctatacgagtgtctcgagtcagttccggactcagaatctctc

SEQ ID NO: 26828 - DNA, 681 bp, Heterodera glycines
tctctttttttgttccataaattatcaaatttcattcgctttccggtaatattgtattatttattttcaattttttttctgtcaggataaaaaattgcctttagtttttcagtgttgatgcaaaaaaaaaaaatcaataactaaataaaatttttgaggttttaaaataatgcaatattccttcaaagagtaggaataagcatcgagggggccggtgtaaaagaggtgggggggggggggtcgccggccgaaggggaaaagagaagaaattttaaaactttaaataatttatttagcgaaattctttaaaattccaaataactttcccggcggcgcctgtcggcaccgccggactaccctgttcctgaaaacaaatagctgagcaaaaaacaaatatggaaatccacacatatccagtctctaataatagtaacaaaaagtctttttttgtgtaatttctgcccgttttgtgccttttttggacatactgtacaaaaatgcaaatgcaatttttttctacatatttttgtatatttgataatttttgtaaaaattcatatcatcatttatttaggaaaatcatttttctcatgaaaaaaataagaattgtcaaaaatttcttagaaaatttttttttggcgtttatgagtgtatttttatcgaattttattatgaaaatgc

SEQ ID NO: 26829 - DNA, 990 bp, Heterodera glycines
tgagtttcaaaaaagttttgaacaaccttacttaaagttttttggaatttaatagccataactttttttatactatctcaaaaaattttggatactaatatttggaagacaacacctagaactattgaatgatagcatgaaatatatgatttggttgaatttgggccatattatgagccccgacatttgcgcctatctccaaacccgaattcaaagtttagccgaacagcattaaaattaagaaaacacagtcttctaatttattaggtgcattattctgctgtttgaataattgatgatttttcaaagaatttattaactataaaattatcagacttaagcaatcacttataaaatgctgtttaggcgatcagggattgaaaaaacttatgtttgaagccgatttggacaaaggcgcgcaaatgttgggcgagtgtccgggagaggaaaacgtttacccccctccccccccccccgttcacttaccatattgctttgcgcacaagcactgatcaccatcccggcataatgcgagatcatcgacgaagaagacgacggaacggccatccctgaagcggcacaattctgctgctgttgctggggccccacagtgccgaaagtgttacgcgggacaattccgtgtttagtctgaagcaaagggcatagccaatatcttggcttcagggggggggcgactgacgactttttttttaaatttaaattcgctatttttggggtggagtgggagggattaaagggagaggaagcgcagagaaattttagaaaatttaggcatattcgctaactgaggaccattttcgtaggtttttgggccgaaatttaaaatttaaggaatttgggggtgtgccgcggcgccgacagacggcccgtcggaggatttttgtaattttttatgagatttgttaatgtaaattttcatcccgttttttaatttaaaaaaatatacaggtttccgaagggggggggggg

SEQ ID NO: 26830 - DNA, 1025 bp, Heterodera glycines
agacacaatttgttctggcaatccatggggtccaaatcaattttcgaagtgtgtcgatcgttgcctcggtcgtcgtgcttttcatcattgcaacttctggccattttgtcttggcatcaccgtgatcagccacattttaccaaaaaatgggccgcagaagtcaatgtgaagtcgctgccatggcttttctggcacttcccatgggtgtagagggttaaaatgattccaattttatttttatacttgcaaatttttttatatcttttaattatgttgttcttttatattttatttttttgtaatgaataaacatttttaaatgcttaatattaatatttcgataaacttttaattcattaaataaatcttttccccaatttcttatagaataaactttttgaaaaatttcatggctaatcctcgttttttttcttcgaagatgttgtatttatttgagaattaaaataattaatcatctttaaaattaatgagtttaggtttattgtatttttttgcaacaagcatctttcttttgattgttccattggtaatcattgggatttttattgatattgttagatcatcattttctatgttccattttattaaagaagcttgttaatttttggcatttttcagagctctcaattttctgaatatcattcttagaatttcatgattagaaataaattctcgtaaattcattgaagcaagttggaaaatttctttactccaataatgtttaaatttgccaataattgatcaattactattggaatatgcggaatgccaatctgaaaactttttttgaatccttgtcgagtaaaattattgaatttaaatctgtagtatcattaaaatttaaaattagtgcttcaattgtcattaatattttttcgattttttacttttcaaattgctttgtaattgaaaaaagtttaagtttcatttaatttttcttcattgattagatttagtacgagtttgattgctctaatttgtttcacattattattatttttttt

SEQ ID NO: 26831 - DNA, 946 bp, Heterodera glycines
cgaaaaagtgaatgaacgtcgaagagtctaatggacgcataaaatgcaaaagatggaatcccaaaactctctgggacattacatgtttaagattgtggttgaccacccatttattttacctgtgaaccaacaaatgttccccgtcgtatttgatctccacgtaaaatggccgtccacagaatttaattatctaaaattggaacaaaactttaaatcttctataaaaaaagcaaaaacccaaatgtattgtaaaattgacaataatgacactttttctattattatttggaataaatgcacaccttcggcaagcagtacttatcgaaattcagccgtttgagcagcatcggcctgaagggttttccaatgatgtttccattggccgtcaaaacattttcgcccgattcctcgcccacataactttcgcatatttgacgaaggctgtcacccgactgaaaccataattcaaatactttaatttaaaaaaccacaaaaccaaaaaagcgtcaaacgcctctttgtgaaagcatttcaaaagtgttggcgagcttattccgcccaatcccttctccatcgcgtccaaaatgatgtaaaaaatccagcggagttcgagccgagtgcagcaccggaacagttcgctcatcgctttttcctctgagttttttaatttctttttgagactcacaattaagtaaggtttacaaaaataataatttttacgttggcgtttttctgagggaaattccatccggtcaagcacagaattgagctgcttaatgctgatacttggcgattgcacagaaagacttgcgcacactttgtcagcgagtcgttccacgagaatatccgttgcctgttcaaagaataaattgtaaaatcaaagccaaaaatcagagtttacagtggtcgtaatttccagatgttctgtcatcattgaatcacaaac

SEQ ID NO: 26832 - DNA, 850 bp, Heterodera glycines
  misc_feature (827)..(827): n is a, c, g, or t
atcgaataattttcttcttttttctttaaataaaatttttttatatcaaatttatttaaatatggttatttttattgaacgaataaccttttcttcttttttctttaaataaaattttttatttcaaatttgtttagttttagtgttatgccattaaaatggaattaattatttctaagtaaaataaatgacattttcgttcctttttctttaaataaaaatgattttattaatatgaaattatttaaatttggtgttatgccattaaaatggcattaaaaataaaaatgaaatttttcatgatgattatttaaagcaccaattaaaaaaaaatttgctttgcatattgggtcgcatcttcaaaggaaaagatgtgtgtgaaatgcttcggcatctgtaactggcgggttaaccaaactattcattccttgttgggtttggaccgcacgcacataagtccacgtgtagcctagaaatctcacgggaattaaaaaatatttgtcttttaaaataataaattaaatatatttgtcttttataccgtatgtaattacggtcgcttttttaaagaacatccatgtatgtaagattaccacattcgcatacaaatcaggatcagcaaactcttcgattttttctttcatttgatcaacgagtgttgacaatggctggcttgaattgtaatattgccagcttctacatttagaaagaagaaattattttgattacatagcaacttcctttttgattaaacagcctccaatttaagtataagtattagaataggaccatttattgaaaatgaaaattcgaaatgaggatttaanaaatttaagtcatcttatcttaa

SEQ ID NO: 26833 - DNA, 1367 bp, Heterodera glycines
  misc_feature (1314)..(1314): n is a, c, g, or t
atcaggcagcaaaaggcaatgaatgggtagaggaataatggatgatcatagataaaaaggaagtaaaaatagggcaagaggtgatcagtgatcactgatcagacaaaaaatgatcagaccgagaagagaggagaggtaaataggattaggcaaaaagcgcaaagatgatcactgaaaagcagagaaagtgggtgagcagagtgagaatcataagagaacacagatgaaaaagggagagtgaaaggtgatcagagaagacgagatgagagaagaaaagattgaacagccgatcagagaagggctgagaagaatacgggcagcaaaagtaaactgatcagaccgtggcattggggcggggacacgccggaacagcgcacgggatgaacaaaaacactttttttgttgtcaaggaatcgcatggcccacgtgtgttcttcagtgtccgcaagggcacaaagaatgggtgcacaagcaatgccgcggcacacaaacgcctcgggggaagcgaaaaatacgggggaaagacggcggggaagcgatttgccgaagagcgaacggaatttatagcggaggaagaagagtcggactgatcggacgagaagggatggccgaatatattgaccactttcacatttttgtttatgtatttagacaaatcatatcaatctattttaatttgttagaataaataatgcttttacgggttttttttaaggatcgaaaaaggaaaaaattatacgcaaattgcaatcaaaatcagaaaatgctgtgaaatcttcgtccttatttttcaattagctataatggctttgctgtacattaaatttcatgtttggatcgatcggatgattaaagaaataactttttgatcattgatattttttcatccattgttcattttcagcattgatccaacttcttagcaattaatcattgtcattgatcatattttggcattgttcgctttttgtccattgttcattttcaaccattaatcctacatctagcaactgatcatgaccattaagcattttttgccatcgatcgcttggcacttgatcattacaattctctttttttaattgtcagtttatgcacacaatttttgggcatgactagtgatgagtgttcgtcccaattggccttttcccccgtcagtcgtcccttttgtccacaaatgacgtccgtaccttcttgactgttcatctccccactacaaatgcgtgtccgtatcgtaccaattgcgtcccattgcgccgttcggtctaccgtaaccggcgccggcagtggagccaccattactgtagcgattgntacccgtagtgctactggctgcagttttagaaaataaggtatattaacttgcg

SEQ ID NO: 26834 - DNA, 704 bp, Heterodera glycines
  misc_feature (13)..(13): n is a, c, g, or t
  misc_feature (35)..(35): n is a, c, g, or t
tttttcatttaantttccgaacaacaaatattttntgtccccccaaacatttcatttcatttccgaacaaaaatgtttttactccctaaaattgtttttttcctttttaatgaacaaatatttaaacatttaaattttttttttttttttcaaaaacattttgaccattagggagcaacaatccggggtgacgccaaaggctgactggtgagcttagcaacaaaaaaaataaaatacgagtgccgtactgacgaggcccgctcgtatttttttgaaattcaaaccgtgtctacggctttgaagggccgaaacatttgcatatttggttgacgcggtagtaaacccctataggatgtttgatacgctttttcgaataccctgggggccatccatgaaaaccgtggagtcctgcctggtactgggttttcttcccagttgggtgggcgtgggcgttcgctttccactggtccttttgcgctggtatccagggctgcggcctggacggatggaaccaagttccttcctgagcccgccgggtgtcacagcgatctgaaggaccagccagatagtcggtctggtgtggacggtggcccttcatccctgcgctttggggtgaaggtgagcttgcacctagcagcgggggtggcggttcctagccgtaatgtgccctgccttcgagctgcattcgtaccgcgagggaataa

SEQ ID NO: 26835 - DNA, 925 bp, Heterodera glycines
agaattgagtcccggtgattgcgatgccgaaggaccaggtgaggttaggtcccagtgattggaatgccggagatttgagtcccggtgattggaatgcaggagaacagagtcccagtgactggaatgctggtggattgagtcccagtgattgaaatgctggagggttgagtcccagtgattcaaatgcaagagaatagagtcccagtgattgaaatgccggagatttgaatcccagtgattgaaatgcaggagaattgagtctcggtggttgcgataccgaagaatcaggtgaggttaggtcccagcgattggaatgatggtgagttgagtcccggtgattggaatgccggagaattgagtcccagtgactggaatgtcggagagctgagtcccggtgattggaatgcaggtgtgttgagtcccggtgattgaaatgctggagggttgagtcccagtgattgaaatgcaggagaattgagtctcggtggttgcgataccgaagaatcaggtgaggttaggtcccagcgattggaatgatggtgagttgagtcccggtgattggaatgccggagaattgagttccagtgactggaatgtcggagagctgagtcccggtgattggaatgcaggtgtgttgagtcccggtgattaaaatgctggtgtgttgagtcccagtgattgaaatgcaagagaattgagtcccagtgattgaaatgctggagggttgagtcccagtgattgaaatgcaggagatttgagtaccagtgattgaaatctggtaagttgagtcccagtgattggaatgtcacagaattgagtcccggtgattgcgatgccgaaggaccaggtgaggttatgtcccagtgattggaatgccggagatttgagtcccggtgattggaatgggagaacagagtcccagtga

SEQ ID NO: 26836 - DNA, 1750 bp, Heterodera glycines
  misc_feature (9)..(9): n is a, c, g, or t
aagcataantttttcaaatacataagttcaacaaagatatggctcgcggcgccaaaatgggcggaaaatgaaatttttggtgtttttttgaccgtaacttttatctaaatttttgaaatttggcaggctaataaagagactgtcaagcactttatcaagcttgtttaatggatgcaaatgaaaaatgttatatcatttggagctaaaatagcaggcgcaaaatgggcggttccctgtatgtttacgcagtcttacggtaatttatatggatgctgatgaccgggtgttcaatcggctcccggtcatttggacagggtaagtcattcgggcagaagcggacaattggacagtggacattacgacagtgaatgaatttatttttactttttaatggttttagcggtgtcatggcaattcgtacaaaggcttagactaaatttaggcttaagcctaggcttaggcttacttgagcttaggccaaagcttaggctttattttgtaaactttttattgtatgaattgctattgacccggttttagcaatgaaaaaacaatttgttttttttaatttcttgggacatttggtaattcctccagacaaattactcaaattcataagcgcataaatagcaataaatccttcgcgttttacaattattttctttaagttcctttttttgttaatttaccttgcaaagtagcgccaaaaaaatcagcgtacggttgttgaaacacacctttaaaattggcaattaattaataattattaatatagggttgggcatttttacaaaaggcagcaaaaaaatttaaataaaataggcgaaaaatgacaaaaaataattacgaaaatatttgactaaaaactgaaaaaaccaaacaacaagaaaataaacacatacgtgcaatacatatgcatatggattattcattaatttttaaaaaataaaaatttttctttaaattctaaattttttttcttttaaatgctcaaattttaaaaataccaccaccataccaatgtgcaatgggttccccaaattcatctgattcgttcggtttgtacgttgacttgctgaatttaaaaaaatatattgcccaaaattgtttttaaattaaaataaaaaaattccgaaattttcgaaagtcccaaaattttgtccaaaattccaccaagtcggaggtcgggattccgttctgttaaaattttcaaacaaattcgaagacttgaattgtggctaattttttgattttatagtggaaaaattaattatttcccacattttaaattaaacgatttaaaaagatacctaattttccaaattaaaaaaatctttgaaaatgataaaaaaaatttgtaaaatattcccaccaattccaattgaccatgactgctgtgaatgcgttctgtttgttcgttgacttgctgaagcaaacaaaaaattattgccaaaaaatgtttttgcttttattaatcatttgccattgctctgttggcgaaaaagttcggccaaagttccgcgttttggcaccgacgacgctccttaaattttgatttttgattaaaaaaatgccaaaaatggaaaaataaatgtttaaaatgccattatgttttttttaactttttttctgcgagtcccggaaagtttggcactataataaacaaacaaaataacataaaattttataattataccaaagatcaaaaagaatgattaaaaatcttatgaaaatgtcaaagaaaaaaata

SEQ ID NO: 26837 - DNA, 961 bp, Heterodera glycines
agtccaattacgtaaagtcaaaacaatgacattaatattaaataaataaataaataaaacacaagttcttttcatctgatcattagaattttagtatgtttaattttttttttttccaaaaattaacatggcctatttaagtgccaaacatttatatgcattttaaaaatcacaaaatgttcttatcattaatacctgctgataggcccaattcttttttccatttgttaatcgaagctcggcaaacgcccaattcttttgctattttttcttccatttcataaaccgaattttcacttggaatttccgcacattcaatttttcttgtcataaattttctaagaatttgcagtttttcttctgtcgtgtgagctttattctctaaaattggtttattaatccgattttaaataaatatcgaataaattaattttttattttaattttatgaacttttccatttattttccaacttttttttctcatttttggtcccatttcttcattttctttttctttttcgatttttggctcaatttttactccaatttcttcgtcctctttttttggttcggtttttatttcaattcctttattccaaatcatttcatttggatttaattccgttttttcttctttaatttgtaacagattagatggtttttgctctttggagtgattttcattcgaaaggccctaaaataaatggaaaaaataggaaaatgataaaactttaaaaaactttatttggttgaaatttgtcccatatctcatcaaaaatatcgcctggagctgattgaatcatatttataatagaaaaacaaatacacaaatggtaaaagaaattcatttattccattttaaatttttttttaattactaaaattaaatttttaaaatttattcatatattagcaatactatcaaacaaaaatataatataacaattaatatttataaa

SEQ ID NO: 26838 - DNA, 1134 bp, Heterodera glycines
agagaaatcatattcaatcgaggacatgggaaggaaattaaaaaatggaattggatgagccaccaaacaataccaaaggggactttattttttccaaatacacagtaattttcgaaattttctgtcggaatgccagaaactaaaaacaatttggtcgccaaaattgaaggtttttggcgcaataccgaattttgttccgaattctcaaaatcatcgagcgcctcgcggcacgacacccatttttcagaaaaaagttgtttttttttattgaaaacaagcacaacttcctctgaaggtcgggccaaccactgtttcaccgtttgttgtgaataatgcccacctttttctgcccgcgtcggccaattgttcggtgagtggcatcactccggtgaccaaaaaccagccaatgtttggaccaatcattggcacagtgacgagaaagggtttgttacgacgggccgacttggaggaagcgaacgcacgttggagagagtgggtgaacagagagagacagtggcgggaagtgaaaaaggacagagacggactctgtgggaacaatttaaatttggatgtgaaatttgaatacaattttaatatttactcaaaaattgacaatttttaagttaaaattggctactaaataaactaaaatgtactttttttttctcgagtgtgcgtaatttttgaagggggtcataaaatccataaattcctcgccgattttcaatatttttggcctgcttaccactaatttttccccataattccctccttttttgtcccttttcgtccacctgttgcccaattgtgatgataaagtaattggacgcggaaatcacatggctctgcacgatggaccgcttcaccagctcgttgaccgactgcagtgccaatttgtaattgctaatgccgcggccgagtgagcccaactgacggccgccgggcttgaaaaagtcgcgcagaattcgactgcccgtgttgtaccgctcgcaacagagctgctcctcctcctcaactgtgctgctgttcaccaccgccttaacgcataagccaatcactgcccgtgccgtgccacccacttcctgctgctgctgattgtacgttttgtactccaattggatgctcagcgcccgg

SEQ ID NO: 26839 - DNA, 1549 bp, Heterodera glycines
  misc_feature (36)..(36): n is a, c, g, or t
atcaatttgtttgacgtcacttttttgagacatttnaatgaacgaataaatacaaactttcactaaataaaaatgcgttttcattattaattaaattttttaaaaattgttggagtgatttttgttacgtgacattttgcaatttgagctgacaaatgaacgcggccattgcatttattggaaaagaaagctgccaaacaatggcacttttaatgaatccgtgccagcagagctgggaataattaagcagtgaatgagtagtgaatgatataataatttggaatattttggtggaaaagttatttttgtcaaaaataattattttttaacctttaataaaacaaagacaaaagaatcgaccaaaatggaaattaaaaattaagcacgctttactttttgtacagatttatgttattaatattaataataaaaaacatttacgccaaatgtgcaaattgacactttcgctaattgtctaattgtgagtattcatttcatttatttctcgctgtttcacatttaattggtgcaatttgattctgtgccgtccgagccttcgcctttggcttttatttgcattaacaaaaaccttttttatttggcttttccattgcttattttggtgtttctgttggaaaatttaaaaaaatgcgcaaattgaaaatcaacgaaatgattaaccgaactctgaaagtcgtagtgccaaagattgacgcgccatatgtaagttggcacgcgtcgcacttcccttggtttgttccattgacaggtcaatcatctcaatcacatggtgcatggaccaggtttgatcaaatgcatgagattagctaccttctttcgcgctccgaccaatcaattctatgcccttttctctcattctcggctgatcatccagtctctctcttccttttttctctgatcacctctatttctctgcctttactctctcccctcacttttcaattttccggcatcgcttgggaaatattgcgcgacatggccaagagtctgaatctgagctatgatattgtgtcgatgcagcatgagggatggggcaaaaagggcccattgggcaaatggaacggcgcacttggcatgctggcagaaggggttggaattggcaatatgacccatacaataatttaataattcacattacttcttggctttttactggcgatctgtccgttgtggttgcaataacggggcttaaatccgatccgaagaactgatcaaaaattgatttgggtttgttgaggaagcggaaattctggctggcggcaccattatgaatgatgagcgttacaacatcgccgactttacaatgccaatcggcttccaggagagtgccgtcctcgtccgagttacagaaatggacgtggcacaagttttatttagcgctttccattggcaggttgtggtgggaaatgtgaatgccattctccaacttaaacctggtttagttggcattggttctgctcccttttgtgctcatttcttttggcgctttttctttcattggaaaaatgcggaaagttttgccacggcg

SEQ ID NO: 26840 - DNA, 809 bp, Heterodera glycines
ccaaaaatttcattatcataatcagggatgcaaaaaacatgcaaatgcatatttttttcctggcttctccatgctctaaatagcaggaaaaacactttcttttttgtgtttgcgtataaaaatcgggacttttatttgcatatttttgcatatttcgaggtttttgtgcatatttgcatattttggctttttgtgcatatttatgcatatttcgccattttttggaaaatttgttaacaaaaatgcaataaaaacggaaaatacacccctaagaatcggccctaaaaaattcagaaaaatacacccataagaatcgaccgaaaatttttaaaaacacaccactaagaattggaaatttttttggactttttcttacatattttcatttttttttttacatattttgaggatttttttacggaaaattttgaaaatgctcaaaaaaagccaaaatttgacaaatttttttatacatattttgagttttgaaattttttagaaatttcttgtgaaaaaataaaataactttttttttaaatgtacccctaaaaaataccaaaaatattttttaaatgttaaaagatgattctaaacctatttaggtcatttttctgccattttgtgccaatttaacactttacgaagatttatttccaaaaaataatcattaaagaaaatttatttacatacatattttcgtacatattttggatttttatacatatttcttacatatttcgggatttttttacatatttatgtacatatttttaccaaattttgtacatatttttgacatccctactaat

SEQ ID NO: 26841 - DNA, 990 bp, Heterodera glycines
  misc_feature (804)..(804): n is a, c, g, or t
  misc_feature (810)..(810): n is a, c, g, or t
  misc_feature (816)..(817): n is a, c, g, or t
  misc_feature (825)..(825): n is a, c, g, or t
  misc_feature (829)..(829): n is a, c, g, or t
  misc_feature (831)..(831): n is a, c, g, or t
  misc_feature (844)..(844): n is a, c, g, or t
  misc_feature (847)..(847): n is a, c, g, or t
  misc_feature (854)..(855): n is a, c, g, or t
  misc_feature (858)..(859): n is a, c, g, or t
  misc_feature (868)..(868): n is a, c, g, or t
  misc_feature (872)..(873): n is a, c, g, or t
  misc_feature (880)..(880): n is a, c, g, or t
  misc_feature (883)..(883): n is a, c, g, or t
  misc_feature (886)..(886): n is a, c, g, or t
  misc_feature (894)..(895): n is a, c, g, or t
  misc_feature (907)..(907): n is a, c, g, or t
  misc_feature (914)..(914): n is a, c, g, or t
  misc_feature (925)..(927): n is a, c, g, or t
  misc_feature (931)..(931): n is a, c, g, or t
  misc_feature (933)..(937): n is a, c, g, or t
  misc_feature (939)..(941): n is a, c, g, or t
atttgagggacccgacatttgcggatattcccgacatttgaggacccgacttttgaggacccgaccgttgccttagaatctaccctaagtggagtatttttttacgcccttatataccaccataccttctatttctggcctaagcctgtaaccatagtataatgtccattcgtaatcaatcacagacagaaaatcatagtacagtttaagtttttttttttttctcactcagaatgcagttagtgccaaaattggctatcaaatttcacactcagaatgcaaaatggtcagtgggggagaggtgacaaagggcagaggcatatgaaagtttaaaaaagaaaaaagttaccatgttttatattgactcagtctaaacagaccacccaccctaattcacttttgtaatgtttatctataattgtccttcctataaaagcgctttataatatacacataagttcacaatttgattatcataaatctgctttgtaatctcgactttaaattcactttgcactatttaccataaatccactttttgtaatatttgtcctctcatttaatgaaattgaaatttgagatttttttttttataacggctttaatctagagatcaaaatgcctatctccgagcatattatgaatactatcaacgacataatcgcgcgttatgtcgaactacacatggaggcttacctgaagcacgagagggcggctgcagaacatttgaaggttttcgaaggcaaatacaaaaaaagagaaaaggttttttttacaaaattttaaaaattttatacttttttnttaaancccctnnacactatnactnantataaaagaactnctnccaattnnctnnacaaccacncatnnccaccanctnaanccttcaannacaaattctttnaaagagntaatctccaannngggngnnnnntnnnacaacttagtaagaaactttttccgtttttcagttggaagaacgcaaaa

SEQ ID NO: 26842 - DNA, 1169 bp, Heterodera glycines
caaaacggcggggaactcctaagaaattggaaataaatgaatgaaaaaaagggggatggacatgagcagaaaaaatggtacggattttagggataaaaaatatatttccgagacccatctttgtgtgtgaagtgacaatggaaaagtgattttaaagcatttgagcccaaatccctcaaaacggacttcgaaattccgtgccgccaaagagtcgtatttatgaccatcgtaatttgcgtcgaagaactttttgaacctaaagggaaaaggaacgatcgaatgaatgggaacgagactgaccattgcaaaaactcaaagttgtcctgaaacttggcccggataagactctgcacgggcacaggctgaaatgcaatgggatttgacatccgtttgaattcttttattcgttttggcatcccctcaccccaattttccaacttcccaaatgaattggtcctcccctgcaaattaactccaaatgttgcattttgattcaaactttgtcaattccgatggttttccacgattgctgcaacacgcgccaattgtgcacccaatcgacgtccgatcggctgttccatttcacttttttgagcggcacttgggtcgggaagagaaagtccgtcagttggcaataggccgcgcccgtggccatctcttcgattttggtcaggctggactgaaatggcaaacggaggcctctcaattcgaatttgccgtcgcatttcaaatgtcaatgtttctcacttggagacagtcgttgacccatgacaaaagatcgttgcgcgaaatgttgtcgctggtcaccgaagtcgagtacacattcaccaccggcatttggtctttagtctttgccttggtattccggagataatgaaaaaagcaaattttgtcccaatgatcggtcgatgcgaaaactaaaatactaagaaaaaaggtaggttttatttaaagaattagacaaattttaaatttgaaaaaggtgccaaataatatcggatcctaaaaatttaaccacaatttgcacttgcaaaaaacaatttaaatttcaattgaaaagaacagaaataacatcagccgtcctctttcactcggttttcactgccttgaacaatttgatcagttcattgaccccggaaaagagcacagttattaaactgcgatgcttt

SEQ ID NO: 26843 - DNA, 894 bp, Heterodera glycines
attttgacagggttagttctaaattttgaaaatttttctttattcttacggcgccaaatagccattttatatagggcgccaaaacggccgcgccaaaatggccgcgccaaaatggcccgcgccaaaaaagctcgcgccaaaaaaacctcgcgccaaaatacccgcgccaaagtggccgcgccaaagtgaccccgacccttttttaacggccctttgaccctaaagaccaaaattttcaaaaaatatatttttaggtattttctcgattaataaaaaatgttacttaaaaatagaaattttgagaaattttatcatcattttgaaaaatttatgtgaaaatggaattatttttacactttttgcatttttcaagtgtaaatttttccacaaatattctaaatatttattttcaaataaatgtttgttttctcaagtttatgaatagggcccggattttgcagtcacaaatgaggaacatttcctttccaatattttcttagcaaatattgagcaagaaacaaaaaaatttggggaagaatttttgagaaaattttctaattcttagaggtgtatttttgtaaatttttggcgattcttaggggtgtattttttgaattttttaggtcgattcttagggtgtatttttcgtttttattgaatttttttgggaaattttccaaaaaaatgccaaaatagtggcaaaaaactattttagtggccaacttccaaaataattttttttttaatggcaaagctccaaaatagtgattcctaatgatgaatagtggcgttaaaacgaagaatttccgagttaaaaatgtgttttttgtgcatttctcatcgaaataaagccgcagaaaaaatagttaaaaaactaagaatccgggccctatt

SEQ ID NO: 26844 - DNA, 526 bp, Heterodera glycines
gaatagagatcgacattttgaaaaaagcctggacctggacctggattccatgttggacctggacctggatgtcctggacaaaaatccagaaaatacaggtccaggaaaaatccaggctcttcgagacctggatccaggcctggacctggattttttgaaactcattttaaaaatcaaaaaaatgtttgaaaaaattaattaattgcttatgaacatcttaaaatatctaatttacaataataatgtttttttaaatataattgatcatttttgaaaaatcgaaaaaaacatcggtcatttgaaataataaattctaacattttgtccaggaaaatccaggtttttttttgtgttttgcctggaactggatttttttcacatttgacctggaccctggatttcctggacaaaatccaggaaaatccaggtccaggaaaaatccaggttgtcgaaaaatggcctggacctggacatggatccaggaaaaatccaggtctggatccaggtccaggccgagctctaatta

SEQ ID NO: 26845 - DNA, 992 bp, Heterodera glycines
agtcatttgcttgccggcaagtcgcccaaattggcagagacatttttataggacaaagcgtttttggactctcttttcaaattatcatattcggaggatttaaatgaattttcaaaaaatctgatatgaaatggcactaattttgaattaatttcagatgttcgtcagaggtttcttcaaaaagtcgggcgtttggcactttgccgacaaatggcaccgtttcggctgtttgatggtcagcgctgaatgaaaaaaagaaacagaaaattgcgaagcaaatgtttgattgtttttaagttttcttccgcctcgaagttttctcactggcgaatgttcggtggtgcttttgttgcggctttgaagggcaaaggtgattagtaaacagaaaatcaatattaacatactatcacagtatttctttgcctcccttccctttaattgtctaagtcgcctttttctcgcttgtctttctctccccctctttctcatactcgcattctcatctcgttttctcttcctttttattttctctctttccctcgtcctttctctcttcatttaaaaatgttaacatatgtagaacacaccgtactttgcacccattcactttttaaaaggctcatttgtttgtctatccatccgcagtgcacgcattcgtcacaaactacgtgttgttttcctccgtctcttccccctccgctttgggtgcattggcccctccccttccccctttcccatttggtctctctcattcattccttttgtttatttgttgtttacttctcctaagtgcattggtccctcttttccccgctcgcgtatcttttaattcctttaatagattttcaactaaaaaattaactaaaattaacttaattatgatggaagaagacattggtggtcctcagcgcagttcgactccaaacgaaaataaccaccacaacagcgacggtgccatattgaaaaataatgaacagcataatgatgcttta

SEQ ID NO: 26846 - DNA, 943 bp, Heterodera glycines
aaatgtaaaaacaataaatcaatttaattttttataaataattataaattttaattattatttgaatatttgtttaatctcaaataaattaaaataaattttagaaaacaattatttaataattcaaacaaaaaaatatttttattattttcattttgctataattaaaaatgatttctttcatttattattttcaatagactagcggggtcagcgccttcggcgcatcccccgctaggtagtacgcttgtattataggattatgaatgataaaatcgactggctcggccgcttcgtggcctcgcatcctattcttggctttttctccaatcgccgggactcaacccaccagcatttcaatcactgggactcaatccaccaacattccaatcaacgggactcaatccaccagcatttcaatcactgggactcaattcttctgcatttcaatcactgggactcaacccaccagcattcaatcactgggactcaacccaccaacattccaatcaacgggactcaacccaccagcatttcaatcactgggactcaattcttctgcatttcaatcactgggactcaacccaccagcattcaatcactgggactcaacccaccaacattccaatcaacgggactcaacccaccagcatttcaatcactgggactcaatttttctgcatttcaatcactgggactcaatccaccagcatttcaatcactgggactcaacccaccaacattccaatcaacgggactcaacccaccagcatttcaatcactgggactcaattcttctgcatttcaatcactgggactcaacccaccagcattcaatcactgggactcaaccctccaggatttcaatctctgggactcaaatctccggcattccaaacaatggactcaaatctccggcattctaaaatctctccctttcatt

SEQ ID NO: 26847 - DNA, 238 bp, Heterodera glycines
taaggggggggatgggcaaagagagaggagggggacttagaaaagaggggaaacgggggagggagactttggataagggggggggatgggccaaaaaaaaagaaggggacctaaaaaaaaagggaaaccggggaaggaagactttgataagggggggggatgggccaacacaaaagcaggggacctacaaaacaagggaaaccggggaaggagacgttgggtcaagggggggggatgg

SEQ ID NO: 26848 - DNA, 759 bp, Heterodera glycines
gcgccgcaagtgtcagcgccgcaaatctctgcgccgcaagtgtcagcgccgcaaatctctgcgccgcaagtgtcagcgccgcaaatgcctgcgccgcaactgagcacaaggcgacagaggtggacaatcggacactgaggacaatgcgacagtaaaatgcacaaaaagataagaaaatgccatcgccgaagtgaaccgattgtgccatatcaagaaaaaatggaaaataggcaaagaaaaaagtgcgaatgcagtctaaaacactatttcattgcaaattagttttggtttggcattttgtatggctcgagacaccccttgtatatgtatgaaattcagtccggatgcaattttcgaaccctaaccaatatttttccaaaatacaaaaaaaaaatcaacattacatggtagcaattagtaacttaccctgctgtttctgtgtataaatgcacgtgttcttaatgagctgcttgtccgtggtctgctgtgtgtacagcagcgataaggcgtatttcaacgattggagttcgggcgatttttcgaaaaacgatttttttaggccttgccctccggcatggaaacactgaaaaaacccaacaaccaattaaaaataattatttttaattgttcccacctctgtgattgcgtccaatgccgcgtcgagcaccgcgcactgtttgggcgtcagcgaacattcgctgttgtcccgggccagttcctaaatttttatttttttcaaaagaatttgcactgacaaaa

SEQ ID NO: 26849 - DNA, 924 bp, Heterodera glycines
aatggacaaaatgggaaaaggaagcgattggatggaaattgtttgatcagtggaacagaatcgacattcaaattaatgaggacaaaatcggtgatgggtaagcgaatgctttttcaaaaattattatttattttcatttttaggcttttcgacgcaatgcccggcccaattgatcagcagcagaagtgaatgaatgaattgatgggaagtgatcgatcaatttgaattaaggaattggaaatttttcgtccttataaaaaatgttcttttttgtttgtttgaaatgatcaacatggatttgtattaatgtatgtctcaaggaaaatttatatgatttcttgaaactgggattagcttacgaattttttaagcataaatttttgaggtccgggcattgccaattattactctaacaataaggaatttttaagttttggttgtaatcatttcttcatcgagttgattccacaattttgttgctctcagcaaaagaaattcgacgttacgctaataacccaaaattggacgtttcgcctaaataaccaaaattggacgtttcgcctaaataaccaaaattggacgttccgcctaataagttattcatctaaaaatttgataggaaaaagttgagagaatttatgcaaatttttccgcaattttttttgtttggttgtttgtccttccatttgctactgttggacaaatgctgatgaatgatgaagaattttttttgatttttatgtaattatcttttttgtttgttgttggtacagaattccaaattcttttttgatgaattccttcaatgaaatgccaacggggaacagtgaaaggacaaattgcttcatttgctcaacataatttaattgattatttttcataaattagttaaaaataaaataatttgatttgaattattattac

SEQ ID NO: 26850 - DNA, 964 bp, Heterodera glycines
aaagtgcgattttttctgcatttttctcatattcctctttgcttacatttcccctccaaataatcaaccgccccttgggcagtcattcgcttttccgcatcaatgtttagcatattctaaaaaaaaattaattaaaattggtgaaaattttgaattgttcaaaatatatttacgatttattgaaatctttttgataaaaaatgggttttatttatttttgttaaaaatttattaaattaaaatacacaaatactcataaaactattcactcaacaatttctttatttttgctattcaaaagtctgccccatttcaatacataaatataaacaggggaatcacccaaaagtggatataaatttaagattggaatcagtctatgattgatttgaatgagttttggcatggatcagtttcttgtggaaaataaattctttcaaaattttggaattttttaaaaatataattaagtacattttgccattgcttaccactgaaaggaacacaatttctggcatttctgtccaaatggagagaatgtccgcaattactgcccaataatttttccaccaatttttctctcccggatgaacacattcgactggtagcctcatcagatttaataacagaaccagatcagcagataccacatcatgttcttcctcactgcttgtttctgaagacaatccagcggaactttgctgattggcattggcattttgtccatgcttcgcggataactgcgatatataaatgctcaatttttctgcgtttttaactcaatattatgtattaatagcattttatttgcttacttgtttcatctcattttccgagaccgaatttaattttgcgcatcgaaacaattggccaaccaatgcaactttttcaaaagttaactccaatttgacgccatttggtttttggtattagtaaaatttgaaaaatcgtaattcccgctgac

SEQ ID NO: 26851 - DNA, 1003 bp, Heterodera glycines
tggaaaaaaatccccgaaggagagaatttaattaaatcccccccctcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaatttagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccacgcagaataaagtacaggctatagggaagctattcccgaagattcggcctcccctaaatctgtgggcatcggttcgggggactgcccgaaaaaaaaaaa

SEQ ID NO: 26852 - DNA, 972 bp, Heterodera glycines
ctgaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaatttgggccacattggagaataattctgatttctgaaaaaagtccagaaataactattttttctttccataccttctgtagagctcgagctgctctttcca

SEQ ID NO: 26853 - DNA, 1751 bp, Heterodera glycines
ttttctctgatttaggtggtgtgcctaaggaaaaatttgggtgttcgcccctcaaaaaatcctttaaaattctccagctatccccgtcaaattgctcggcgattttcgccccgggttctggcaattatgtcccccgatggttgaattgggattttagagcggcgggatttattggggatactgcacaggtgatggttgggaaggtggcggatcataaaattgtcacacattttttagcggatgtgggcgggaggattcaccgacggcggtgcattcgtcggtgacgcgttttttcttctcgtcaaaaaattcttgcggggaggcgggggacattctcgggacagatgattgttagggttggtcgtgtccgagagcatcatcacatatccatatttttataccgaaaacaatcaattaggtggagtgtttaactgatcgatcaaagtctgccagcctttcccctcccgccggcaaaagccattaaaagcgtcccgcctccgcagtgatcgccggcggcgacggcggcggtggctggcgggcaatttgggttgtaatcgatcaccatcattcatttattttatatttattttttgtttcgcggagagcgccgcgggcgacggacggcggaaatttttgtgtatataaatgtgatgatggtgctctgataaaaatgttgtgtgtgtttattggggggctgctgtgaggagcagtttattcatctcattgacttgcgttggtgatgagttggaggaaatggcgtaataatggggaaaaaatgtttcgaaaattttaaaatggtaattatgattttaaacagtttttaaaaaaattaaaaatttaacataggtgtgccggggagactagaaaggaggaggacaaatgggcaaatccaggacaaaggggcaaatccaagacaaatggacaaatccggacaaatgagccggacaaataagaaaatctaagataaatgtgaattaacacttaaaaacggaaaataaaaaagaaaaaattttaatttatcacaaaaatggaaacaatgaaaaatagagaggaaaattcgttagaaaatttctgaaaaagttttgttgaatttgctaaatgttaaactatatatatatatagtaagactttttcaattcgtattactaatatttttcgttgttggggataattcgccaaatgagaaaattggggaaaaaattaattgaaattaattttctccggtaaatttgttcaaaaaatcggtgagaatatttttgtacacgattttcaagtcggatatggcgagaaaaaggtgcttttcttcacaaccgtgggaataaaacagagaccgcagcaacgcccgggggaaataatgcaaaaaaaaaatgggaaattaaatttaatgaaaatgaaatgatacaaattgaaagtggcactttttaatggcactggaaaacaaagaaatgccaaagtgtcctcactgttcagatgtggcatgtgatttggagatgattaattgggtaacagaagagatgtactgagaatttggaattgaaaattatgacgggtaggcaaatttttggatttttgtaaatttattcatacccaataaaccttaaaaaagggatggcaaacgagtactgaattttcagatttgcccagatcttctgggcaaaaacgggctttgttcacttgcataaaaattcttaataaaaatttttgaaaaaactcggaaaaatcgtaaaaaatcgcaaaatttcccagtgacc

SEQ ID NO: 26854 - DNA, 652 bp, Heterodera glycines
ctgaaaggaaaagaattaacctcgttttatcacattattcttgtcatcagtttttataaaaaattttcaaaattctgagtctcctattattttatttatttttcaaaattttgaagggcgggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcataattaattcttaaatattttttcagaaaggggtctgaaacgcaccaaattttatttacctggtagtttaagcactctgatgctttttccatcaaaaagggagatgaataaaatttttataaatttttaattcctttttaaacaggccaaaaagtttaggcttatcttttttttcagaaactgatcagaagcgcaccaaactttgcagggatactgaaaggaagagaaat

SEQ ID NO: 26855 - DNA, 1014 bp, Heterodera glycines
aaattaataaaaaattttaaattcagcattactggagttagcatcatagcagtgcttttccttgtctttttgatgccctcgcaaaatctgggttcgcttctgatcagtttataaaaaaaaagttaaagcctaaaatttttcgcaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttgaaaaattttaaaaacaacaa

SEQ ID NO: 26856 - DNA, 886 bp, Heterodera glycines
taaatcattttttgttttttttaattttctctaatcttttctaagttgccaacccacattgtatgatttgtcataataccataaaatattatgtattttaccaggcctaaatatttcaaacgaatacatttttctcagtccaagcgctttttaaataatttttttagattttttgaaatttctcaatttattttatgaggtacatttccttgggtattttgtcatgatgtcaaagatttggtattctataagccctaaaaattaaaaaaaaaccatttttaaaatttttcagtggatgcgtaaaaggccggtaaaaaacattgggaactgctcttcctcctccgcctcctctgcccatggcaccaccactgagacgtcctcgatttcttcatcctcctccattttcacttcgtccagccacaaccaatgccctccggctatcaaagtgttccattgcgaggccatccatttcattgtggcattcacaattgcggttggcgaagtgccgggcccactgtttgactttgaatgtgccaacaactcagtgacggtcagtttcagtcagtgttttggtgcaaaacatggatagatatattggatcaatttggtttgttctacaaaaggtgcgcatcacacaaagggactaaaacgggaacaactcttttcccccgtccgaaaatttacttttaaaaaaaaaaatttaaaaattttccgtggtggagacgtagggcacccttaaaaattgtacaattttttatatgagtgaaaaactgttgcccgttggaacattcactaaaacttaaagaaaaaaaatactctctaaactaattatagtaattgcatccagtatttgcctataggtgtccgcctgagaatttaacaatcg

SEQ ID NO: 26857 - DNA, 1112 bp, Heterodera glycines
  misc_feature (62)..(62): n is a, c, g, or t
  misc_feature (78)..(79): n is a, c, g, or t
  misc_feature (91)..(91): n is a, c, g, or t
aaaattttgcgaatagactcatttttgtcttttgtcggaagaaattaaaatgctgcaattanaatgatgaaatatctnntaaaacaattanggtaataaaaaatcaaaaacaaagctttaggcattcaaaattatatgcagtgaatactgacaccaaagcggaatgattcacgttatcattacattggttagcagttagcctaaatgggttcagcaatttttattctttttttactttatggcgttttatattcatataaaaagaatgagaatttggagtgatcgctttttatgtttgccgcggccgcggcgtttgaaccaataacagttgtatttttgtgatgacagctccaacttcggcagttgtgcgtgagcaacatttggcccttcggggtctgtcaatgtatattacaaaatgttaccgaaatatttttgttttaagtgatgcgactgtccaatcccaaatttcatgagaccatttgcttgggccgcgatccggccgatcctttctcaatggctatttgtgattcgattggcaaattgagtggtcaaagttctgtcgatttgccgcttgattcctacttaattgcaccacatgcgatgagatgagtttataaatttatttttaaatgctttcaagttttagtgatgtttatctcggggaaatgttcactctttacatttcaatcatcaacattagcactgtcatttgcaaagaaatagccattaaggtcagcgaaactccaaagtaggaaaactcgttttgttattttacaaccaaattcagcttaggtcgacattcaaactcagaatcagcgcgtctctctcggagaattggccttcgccggaattgcccttgagccgaaccaacaaattggccaaatttttaaacatgacatccgggaactaggccaacacatgtgagttttgttttgttttttactagatcgttcataacctaaatatcttgttttgttttttaatttcaaaaaaaaaatcaataaaacaaaaatcaatgaaccgttcgaaagctctgatgattcgctataaaattaaaaagtgatattccgttcttaaccagtctaaaaaataatgaattttaatcgaatgat

SEQ ID NO: 26858 - DNA, 1636 bp, Heterodera glycines
  misc_feature (97)..(97): n is a, c, g, or t
  misc_feature (125)..(126): n is a, c, g, or t
tttgtcagttgtcgactttttggtgagatttggtagacgtgtacatcgccttttgctttgatgctggcacaggcaattgctaatattccctaatttnaatatttagcagctcgtcccccccttcnnccgccctccgttcccgcatagaattttttttattaattattaaaattacacaaaaatcccaaagaatcgttgaaagaatttttttccttcaatttcctaaactttctgaggtctctgttgtaatttttttttaatttttacgggtgaaagtctattcgggggggagtaggaaatggcggacgacatccaactttgtactgtttttcgacaaaaattcgtcataacttttgttagagttgaccaaattaaattttttgtatcattcgatagcccttaatgttctccatcgccatgtaaaattcaaaaaattttattggttttcaaaaaagtgtgacaaaaaatcgtaaaaaaaattcgtccataacttttttcaaacttgattaaatgtacgagttggttttaccggaaagtaacggaaagcgggaggaagagaaaccataatgcacccaaaaaattacaatccgtgcaacatcagaaatgatgatattcgcatggtcaagcagtggctctcttcgtcgttcgtaacggaatgaaattttcttcaaaaagcacctgcaatttgagttttaaaatgatttaatcccctaattttgatgcttactcgtattcactttcgctgcgtttttccctctttttcacttgctcaatgtcactggtaaaaaacaattttgaaaagatttttttgagcgcttcgacagaagtgaaattggagaagccgacctttgataaagctaaaaacattgaggataagaaaaaccaattgagtttatcccttatcggcgcgatttacgtgtttttttttatttaaaagcaggcggaaatttttgaaacttaatttttaattttttttttttgataaaaatggcctctttagtattttgttttgttacaataatttatattaaatttaccatttttaatggagacaatccttttttccgctgcttgaaatggcctaacagctgtaagtcgtaccaaaacatctgttgaaaggtaaaatattaattaaaattaaattcaatattcatttcaaggactacaaatttttaaaataagttttaattacgccaaattttagttttttcatatgttccgattaaattggaattttgcgcagttaatttttaactgcgcaaataaaaagcaatggaaatggtaaaagaacacacttatgaatcgagcaaaaataataccctaatacactataaatgttctaaaaaatttttaatcttgtttttctatatttacaaattttttgaatgatcttttgtttttaccggtttacactttttatactcccgagacatcgtaaaatcctcgccgttgtttgtgcttcgtttgctttccacttcttccatcagttgttgtgccctctcgtaaattttgttctccttttttgaaggcaacccgcaatttttgttgacggcgttgttgagccactaaaagtgaaaaattttattttttatatatcgttgagaatatttaaatatcatacgattaataattttaa

SEQ ID NO: 26859 - DNA, 1055 bp, Heterodera glycines
ctgtttttggtcacaaaacacctttttgtcattggcggggcgtatccgccaggcattttgattgtcttcatgaaatcctccctgatgaccgggcttaatcccccggggccggtgtgccattcggaccgaacgacaatgccattgtggcacttttccgtcatttgaaattcatagactggcatggccaattcacaacttgcagagagatgcttttgtgctttgtttttctcttaaccaccctatcaacacaaaaagcgtttggcgtgtgacggcttcccaatttcataacaatttcggcatttgcagtcagtaaaaaatgccctttctctcattacagcagcactctcgcgtaaccaacaacgtcgctattttcgctcggttgccactgcttcgtttggacatcggggcggcccgcaatacattgtcaagtcgcgcagcgctgcggaaccacggctcttcaaccgtcttgtgcaccagacaagccgcggaatccgcgtctcagccttcgagggcggtggttcgcaccaatacggtgccgcgcaccaacacgtgccgggtggcggcggcttccgtgacttcaattctcgtcgcggtgtagggccgggagggtcagcggacccgcgccgttatgacgctggcaatgccgagcgtgaggaaatgctgcgcttgatggaacaacgcgaggaggagcatcgcaagaaggaggaggagttgcgcctggagcgcgagcgggaaaagttgaagtacgagcgtgagaagttggaacgcgagcggctggaggtggagcacatgaagttgaccgcccaaatccaagcgtccgggtggctccaagcagccgcactgcccgccgccggtggttttgttgctgcttcacccgccggttttggtgtccctgccgcaccacagcagtcgtctgcccgggactctcgccagcagcagaattattctcggcaccacagcgaagcggcggtggcactggcacgaaacagcgcgaaggtgaaggaatcgtcatcatcctctaaactgtcggcatcggttgttggtcgaaatgctgt

SEQ ID NO: 26860 - DNA, 978 bp, Heterodera glycines
  misc_feature (954)..(954): n is a, c, g, or t
atccccaagagaaaaaagagatagccattttttcggcaagaatttttttcgtttgcatttcaaatatcgtgtgagtgtttagtagagccagactagagaaggcaaatgttggtaccaagtttgcggtcaaatccccaagagaaaaaagagatagccattttttcggcaagaatttttttcgtttgcatttcaaatatcgtgtgagtgtttagtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatcccccaagagaaaaagagatagccatttttccgcaagaattnttttcgttagcatttcaaatatcg

SEQ ID NO: 26861 - DNA, 930 bp, Heterodera glycines
  misc_feature (35)..(35): n is a, c, g, or t
cttagaatattataaaatcatattaatgtcatcantttgaaataaatctgaaaacatatacagtcatgattagggtcgtgacctttagtgacgaaaaatttcaaaatagttaactaaaatagtgagtaaaaatgccaaaatagtgagtgacaaaatagtggcaaaatagtgacgaatagtgacataattttcagccaaaaattgagcaaaaaaattttttattcattaatttcagttgcaaatgaataggactgggatttttaagggaaaaaacccaaaataggtacctaaaaaaataattttaaaattaaaaattcttgccatgaaaatgaatttttgagaaaattttttcatttcttaggggtgattttgaaattttttaggtcgattcttagggggtgtatttttgggtttgttgtatttttgtagaaaaattatctaaaaaattccgaaatagtgacaaaacgccaaaatagtgatttttattttcaagttgtccaaagcgagttcattgaacaaaaccagttcactttatcgcattgtcaacaaaataatagctcgagttgtgccgatcacactgataacgtatttacgaaatgcgttatccattgctgccggggcgacttttgcaacggcgtgcccgaccgtcgtgtagtccgggggtgggtcgaaagaatagggtattcaacctgaaaattgaaaagtttaggcccactgttgtttacatgttttttgccgtgttgagtgcaacgattttttccggtaaagcaacaataaatgtggcacaattaaatacattagcgtaatcgggttaattaattttaaattttacgaatcataaatcgagcttcaattgacatatcaaaattataaaacaattaaaagtaattatttcatcttcacttttaatccgaatttgtcaaatggttc

SEQ ID NO: 26862 - DNA, 975 bp, Heterodera glycines
  misc_feature (940)..(940): n is a, c, g, or t
gaggaggacagtcccggttgtgtggggcagcggggggaacagcggcggctgtttctggtgctgatttgttttgcggtgatttatgttgttggttgtcgcgccgacgtgcacccagtgaatccgttgttgttgtcgtgcaaagtgaacacatgccgttgctgcgacttttccgttctcgtcggtgagagtttcgactgaaaaaaaaacatttaaccattgaaggcttttttaggtgcacttcattccaccccctctgtcgtttccccatcggaaaatttaaaaaaatttcgaaaaagttttcaacgatttttagaaaatttgccaaacttttttttaattttaagggggaaacgacgcaggggagaacgacctgttccgacaatttttgttgtaatcggttaataatttatctgaaaaaccaaactatgaatttttgattgaaaaaaatgtaaaaaccaggaatggagactttgtcgatcattcaaaaaaatctttaattttctgtcattcgttaattacggcttcgaatttcttaaaattttttcaattaatgagagaaaagcgaattgagaaaaattagtgtttaaaattcgtcttatgccaataaatacctgcttcaaaacattggtctgttggtgctccgccaatgcgtcgttctgctgcagttggtccaaccgtttcttcagcacggctttgtccgccttaacactgccgagcgctgagagaagacgcgcattttcatcacgaagaagacgcatttgcacactgtcagccaactcatcgccaccaattttggaaagagctgaaaaagcattgttttaaattatgtaaaagtgtggggaactttaactgtcagaattatttttttggaattattatttattttttggcaaattcacaattaaccgttgtgccccagacaggattttgttttcttggntaagggtttatttaggcagtaaaaagagcgtaacg

SEQ ID NO: 26863 - DNA, 843 bp, Heterodera glycines
cgctgtccagttttccgcttggtgtccaattttccttcgatgtccaaaattccggcggtgtccagttttccgcttggtgtccaattttccttcggtgtccaaaattccggcgctgtccagttttccgcttggtgtccaattttccttcgatgtccaaaattccggcgctgtccagttttccgcttggtgtccaattttccttcgatgtccaaaattccggcggtgtccagttttccgcttggtgtccaattttccttcgatgtccaaaattccggcgctgtccagttttccgcttggtgtccaattttccttcgatgtccaaaattccggcgctgtccagttttccgcttggtgtccaattttccttcgatgtccaaaattccggcggtgtccagttttccgcttggtgtccaattttccttcggtgtccaaaattccggcgctgtccagttttccgcttggtgtccaattttccttcggtgtccaaaattccggcgctgtccagttttccgcttggtgtccaattttccttcgatgtccaaaattccggcgctgtccagttttccgcttggtgtccaattttccttcggtgtccaaaattccggcgctgtccagttttccgcttggtgtccaattttccttcggtgtccaaaattccggcgctgtccagttttccgcttggtgtccaattttccttcggtgtccaaaattccggcgctgtccagttttccgcttggtgtccaattttccttcggtgtccaaaattccggcgctgtccagttttccgcttggtgtccaattttccttcgatgtccaaaattccggcgctgtccagttttccgc

SEQ ID NO: 26864 - DNA, 1321 bp, Heterodera glycines
aaataaactgagagagagagggagagaaaatgatcgagagaggggagaatggaagagaacgagcgagagagagaaaatcagcgagagagtaagcgagaaagcgagagaaaatgatcgagagagagagagaaaggggagaatgggagaaaatgatcaaaggtcttatttgctgctgctgccctgcaattttcatttgaaagaaagtaggcaaatattctaataacttaatctgagtctgtggttaatagaaatgggaaatgatcacaaatcaaaaaatgcctattttctgctgctgatcagatcaaaatgccaagggcgaaaacgggggtggaaaaaaacgaattttaggacagaattagattcaaaaaagaagatacaaataagattaggggaatggattatgacactgaatttcatgggaatgaaatgccgatgccgacttaaaaacaaaaatgccaaaacgattaagtcgctcttaatgggtcgtcgattatgactgaatttcatgggaatgaaatgccgatgcctgacttaaaaataaaatgccaaaacgatgaagtcgctcttaatgggtcgtcgattaaatatgcataaacaacattaaatatgcataaacaacaacaatgatacgttttgagagtaaaaagatggcttttaaatttgttaaacattattgttaatgtattgaaaaatttgcttaaaagctaaaacatccaaaatttaaaaaagaaatttaattttaaaattgaattttccaaatttaataatttagtgctctttaaagggccagcagcaattttttacacacaattaaaatggctttttaaagcgcagtgattgatatttgctagtgggcagtcagtttctttcttatcagaacagattggggcatcgttaacagcaattaattaaaattaaaagaaaaaacaattagagagaattagtgtcagctttttagtaattaatgaagaaaaaaacatgcaaaacgcaggaatttttgacagaaaattattcataacttcacccaaaatgaatcaaattttattatcttgatatttttagctagccctaagtggttttctattatcctgcgaaatttcaaaaaagttatcacctgagaaggtcaaaaaaccaagtttttttcaacatttttggtcacaacttttttaaatcttaacgattttttttgaattttgtaggctaatagaaaacacttagggctatcgaaagacatcaaaaattaaaaatttagttgttttggaacaaagttatatcaaaaaatattttcatttgatggtttttgactaacgccatagcacca

SEQ ID NO: 26865 - DNA, 849 bp, Heterodera glycines
ccccccccccccccccctctctctctctccttttttggccgcttttctctcgccaattcctttcggcatttttctctgcccgcctttctcttaattatttgtcagtttcccttttccccgctttttgagaatgtccacaacaatcggatttgcctttccctttcttttctattgcttttcagcctaaaaagtgccattttcagcacttccgccgctttgtttgttttccacaaaatgtcttcgtcagtttaatcctccatttttttgtgccatgccttgcaattgtcagccgattccgccgccgccgccctttgatgtcccccctccccccgacccatcgtttgtgttccatttgctgagtgacgacccgcccgaggcatttgaaaaggtaaaaggcaatttgaagaacgggccaatggtaacggagaagtgactgactttttcgctgggcatttcacgcggattttctgaattgatcccatttttagcattttggggcttagttattttttaaattttcttagttttacccattgctgaaggggttcgtcctccgtgtccccttcctgccgatttccccggcatttcgctctcacttaacatttccccctcttccctctcagcttcatctcctccactcgtgccctcttcaaaaacagcttttcttcttccgttatccgttcggtcgttttcttccgttcgccacagtcgctgcttttctgctgctcacttccttctcagtcacggcctttgttttttggaggaaacggcggaggacgcgaagaatggaagagagggaggaggaagaagaggaaggaacggaatggaggaggaaatcggaggagagga

SEQ ID NO: 26866 - DNA, 960 bp, Heterodera glycines
aaaagtgatcggacaaagccaaacaatggcatgaaaagtgatcggacaaagccaaacaatggcatgaaaagtgatcgggcaaagtcaaacaatggcatgaaaagtgatcgggcaaagccaaacaatggcataaaaagtgatcggacaaagccaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaagtgatcggacaaagccaaacaatggcatgaaaagtgatcgggcaaagtcaaacaatgtcacgaaaagtgatcggacaaagccaaacaatggcatgaaaagtgatcgggcaaagtcaaacaatggcatgaaaagtgatcgggcaaagtcaaactatggcacgaaaagtgatcggacaaagccaaacaatggcatgaaaagtgatcgggcaaagtcaaacaatggcatgaaaagtgatcgggcaaagtcaaactatggcgtgaaaagtgatcggacaaagccaaacaatggcatgaaaagtgatcggacaaagccaaacaatggcatgaaaagtgatcgggcaaagtcaaacaatggcatgaaaagtgatcgggcaaagtcaaacaatggcataaaaagtgatcggacaaagtcaaactatggcatgaaaagtgatcgggcaaagtcaaacaatggcatgaaaagtgatcgggcaaagtcaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaagtgatcggacaaagccaaacaatggcatgaaa

SEQ ID NO: 26867 - DNA, 1554 bp, Heterodera glycines
cttggcgacgagaaggcggaggatggaagcgggagaattcccgggcgcagtttgggggagctcggtttcctggtgttcaaccaggatggtacgccggtggaattggacgacgaggaggagaatcgatggggaggcggcgtccttgatcatcctgaagcggctccgcggcgcgcaccggaggacgcaaaacgaaagaaatggcgccgatgagacggacggatcccacgcgtcaccgggagagccactaccgacagccaatttcgatccttccgccatttccctcgcaatttccccacatttattttgccatttcttattttattcacatttcttattttctctctcttttcttcgcctatcgtatccaatcgtctcacttctccgatttgcaaatagtttatgcatttcttcgccgttttcccaatcccccttttttcgctggcctttggccgtcatttatccgaaaacatttcctttgtcccaatttttgcacattttccatttcattcattcattccccttttttccttttgcattaccattttgtttatctgatcagcctttggccgattcattttgccgtctttgaattagttattcgccagcaattcttcgggggcgtctcccccggtctctccccctccctttgtcattgcgtaacttggccattttcattgtcattttcaaatcattcgccaatttgtaagggggctcctccccctgctctcatccgtcctcgtttttttcacttatgcctaattctatcgcattttcaacatttgttttccactaatcaccactggggagttgtctccccaaatttcaatttcccccaccacaaatcgcggcattcatttaccccctgccgtttgtcactgtcatcccccccattttgtttggttttaattacccaagtttgagctgcttaataaattgtgcttttaatcttgtgtgcttcaaagggtgggaaaggaaaaaagggagcgaactcccttcggacgaactcttcttagcccacggacgggctcgcgcatcgatcggtcacacgggactctctcacttggagtgcccagctcgccttagccctcgcacgggctcagcacgttaaaacgggactcctgcctccggagtgcccagccgtcccattttttctctcccttccccctccccaacgtcctctcttcccctccgagagtcggaccatcggacatcgtcagcgcaagacgggagaagcacgctcccggcagatcaacttgtgggattagccaaggagtcccggcttctccaaattctaagtcggtggtgccgttattcacatcacctggcgccctcgcctgcgccgtttgctgccagcactcaagcccgagggagtcacccctccctccgccggccgctgccagcttcagtcgttcggcacctctgcctgcgccgacgatcgaagcattcaaagcccaaaggagtcatctctccccttgccggccgctgtctttccttagggagtccaatttctccatcgcaaatctttgtttgcctccccgaccctccgcctcactc

SEQ ID NO: 26868 - DNA, 1029 bp, Heterodera glycines
atgtgaatgtttttccagtcatctccgccaaacacatgcatatcagcccaaagtacaacgttgagtaggcggggcgacatggcccagtgaagtgtgtcgtccggtgcaagaaattttgaggataaaatgtgccattgtctgagatttttgacagatttaaaaataatgaaaatagcaaaaaacacaaaataaccttttcattgacaataattatctctgtttttgatacgcataattaattaattttttaaattgtaattccacaccaaacattcatcaaaatcgtaccgcccaaacaaattatcacataattgccatatcttttgcaaatgatccattctattcctatttatcaaaaggcttttcattttacattttgcctatgccatttttcatttaaatcgctttgaataaaaaactatcctaatttatttcaaaaattatttagtgctgaattatccttttcattattcaatttaatttaaaattatattttaaccaacgacttagccaaagagagaattaattactagggctgggatttttaggggcgaaaaattccaatttagggacctaaataaggacaaaaaatacgcgaaataggggcgaaaataggggcgaaaaacttattttaggggcgaacactcaaaatagggatttttaggggcgaacatccaaaatagggattcctagggtcggataggggcgttaaagcgaaggattttcgaacaaaaaatgtgtttttgtgcatttctcgtcgagttaaagccgcagaaaaaataagtaaaaacctaagaatcccagccctattaattacaaatatgggggagggggttcggcccaattagagaaataacacgggcattaattcctacgtaaaaaataaaaataggtgaaccaatttacaaaaataattaaaaaaatattttagcttaaatgtaaatgtctgtgtgttattccagaggtaaatttgatgacgaatgtgcccggctttatatcagtcattccattataattatttattaattt

SEQ ID NO: 26869 - DNA, 1530 bp, Heterodera glycines
  misc_feature (52)..(52): n is a, c, g, or t
  misc_feature (1522)..(1522): n is a, c, g, or t
ttttggaggattttggagaaaaaattttccactcaaaaatcatggtcacacnccttggtcccgaatgcaaaaatcacttttatttctataacttttttcaaaaaagtgataaaaagctaaattaaaatttataaaatagagcaaaaaattgcggatttttgtattattttactttttcaatacaacttttcataaccgagttcagaatttttttctgaaaaatcgaatttttccagaaattctggtataacttttttattttggaagatagaaattccaaacaaatctcataaaattctcctatttttttgctatttttcaaaccgtattacactaaatttgatcaaaaacgaagagagttatgaatttttgaaatttcactggatttcccggggcccaaatagtgacgatttttcaaaaatttgtaaccaccttccaaaaagtctgaaacccaaaataatgtatatattcgagttcagcaccttaaattaggccataaaaatgcattttggctaatttatgagcaaaaaaatttttcatgaaatgcaaaaccatggggtcccccctgtggttttgagtttcaaaatcacaattaattttataactttttttaaattcaagataaaaacatgaaataaagcacattagattgggcttaaaattctctacaaaaaagctcttagacgattttttgataaaatcaactcctgacgagttattgcgccagaactgaaattgaggcctagcaaccaaaattttctatttccaaaaaaattttgaaaattttttctgaaaatgacaccaatcgatagagcatgaaaaacggttgcttgaaagtggtctccgtttttcccggaaaaatctgtaaaaaatcataaaatttaaaaacggaaaattttcgagggggcctagctcgaaaatttctgaaaatttctgaaatctaaaaacatggttggatagagctcgtcaagctgtacaaaaaagccgcttacaccgacctcctatcatcaatatctggcgagttattcggccggcgctgaaatggcccaaaaaagtgacccatttttgcgcagttttccagaaaaactggtaaggcctaggggttcggtcaagaaacaaaaaatgtgccaaacatccatacgaagctcctttacgaggccgatttttcatttaggcctttaaaaaaattttgaatccgagcaacttcaaaaaaaattttgaaaaagccgtttcagcgccgttggcgctcagttggccctcggagcgaaaaacctatagttttcccagatgcgcctcaaaaagttgtccccaaggtcgaaatttcgaacccctcccgacgccccgtaaggagattttgtttttggaaatgagttgccttgtttctttagtagtatataaactagcgtgttggaattgacgggggcggcgtaggcaattggcttttggatgaagagaaaatggacatgctcatttgttattttagaacatacaaaacattaattgcattagtgtgctgttttanagcgctat

SEQ ID NO: 26870 - DNA, 966 bp, Heterodera glycines
ttaattttatttttgcacattaaattttacaattcaagctttcatcctgctttcttaagcttagtccacttgtgttttggtgccatttttcacttcggttccaccgaacttttgccctccccgacagatataacagacaaaccgaggtgtttttttacaaaattttgccaatttttaattgtttaaatttggtccccaaagcataaggtattggacctatccaccgagcacaaaagcgttgcccaccaccacgacaacgacgccaaccacaacaacaaccacaacgaccaccaccacaacgacgacgacgacaatgacaccaaggccaccgccaaaaaagtgccaagacattgacatgaattggtaagaacaaaaggccgagaatggggcgggcgaggggggaatttgggacaaatggaaattgaatttaaaacaaaaaacgaccaattggcattgtgtgtgcgattttaagctttacttgggtggcagagaacccggacagctgcgaacaggacacggaagtgttgagactgtgccgacggtcgtgccaaatgtgcggcaacaattacacagtggaagtgccggacaatgaggtggaggaaagtgagtaaaaaacagctgggacaattaataaagtgcaaaagacgaaggcctacggtaggtggtacagtaccccaaatttggttaattgggcctaattgcgtgcttactccccctttttgcgcagtgtacgacatccgtcgagtgcctgcccatttgcagcggttggcctttctgatcggacggtggcaaagcgatttcggaggaaaagccgactttccgaccatcccgcgcttcacctacggagagaagttggacttcagtgtgagcacccatctgaagcaatcagtgctcaattacaggtggcacacttggaggggaaggggggaatggacggcatttcgaataaaaagggagggggggggg

SEQ ID NO: 26871 - DNA, 1326 bp, Heterodera glycines
  misc_feature (25)..(25): n is a, c, g, or t
  misc_feature (51)..(51): n is a, c, g, or t
tccagccctcgatcggtgtacatgntgtctgcacccctggccattgctcanaatagctcttcaaacgcccttttcatgtccgtcggtcgtttactctttacgggggtgccgaacattcgcctcgatagaacatccaccgccaacagcaagtaacggtagccgctgttcttgcgcgaaagtgcctggaaatctgccaagtccgcctgaacatctgaaccctgaattgtgcgcaataagccccggtacaacttaccggtcatgaaacccgtaggcacagtgcgtaggcgtcggaacttgtctctctttggcttgaacagcgtgtaggtggtgttcctttgcaaaaagtcctcaaactcggcacgcttcaacttcgggtgcttctccttcaccgccgcgtacagagcactcgcccccgcatacccgcccggattggccgggtcggtgtatattttgtttattttcttgtccattttgagggaacaaatcctctcgtttgtttgacttgtccgacgaacccagacccaacaaacagtcgattgagtaggctactggcgagcggattctgtgcgagtttcctcttcaactctttggttccgcgtggcgaaggggcattctccgggcgagggtccaccaggcgttcaattgaccaggccaggtccgagtcgataaactctcggcccgtctttgggttaatgattttcccacggtcagttgcgccgaatctctgcggatcagacataatgatggccaacaggtggtccttcttctcgatcaatttttgctgttttgctgctttcttattggtcctgggtgatcggctgcttccctgcgtctggcttgttggggttaaaaactttggcacttcaatttcttcctcttcatcttcgtcggtaaccatcacggacttgtccttcggttcgtccggaccaggccgtacctgcacacccgtctccactgttttatttagcagttgagcaccgttgctgagctgtactcggacgggccgctccttatgttccttgcgcatcttcaggtaccggcgcaggtgctggttgtacattgcgttccgctcgctgacgtttcccttccgcttctgtactgcagcggtcacctgtcgtttgacaaagcctaagtttgtccgctcagcaatgtcgtcgtcgtcgtcattctttgtctccctcgctgcaaccagccccttgtagtgctcgtacggcagcagaataagtttattggccattattgctgcgcgaaagcaggtatcgggcagccctcatcagaatgggggccaacaaaggggccaaaagtgatccgcctgactgctgcact

SEQ ID NO: 26872 - DNA, 920 bp, Heterodera glycines
ttattaaaagggccattcacaaacctatgcatagagagatgaaaatgaaattattaatttgtgccgctcggggtaaaaggggaccattaaaataattactgcgcttttttcactgattgatcgcttgctgtgctctgcttttcttctaattggttctgcatccgctgattttgcttgctgattcattgccagcccataataattagtcattcattccccacttttcctaattggcgctggaggggttaaaatatataagaggcgcgtgacgacaaaacagcgggaagcaaattcggagtcctttcattacaaaggaaaaccgacagatcaatcagcgggccatttttgagggaaaacattcattggttttcccaaataatcatttaaaattcgaaaattgggcaaaaaaatgcgatttaaaatacatttcccagtaaattgttggataaaattgaggacaaggtcagttcacttttgaaatatttgtggagattttatcaaattagttgcccatcgacaaaacaaattttttttaaatcttcaattttcgagtaatgaattttttgtgaaaattttttaaagtcaaaattttgatagaaaatatttttatttgttggtccatgattaaatggttcgcacaaagtgctcttgtggcgcaatcggttagcgcgttcggctgttaaccgaaaggttggtggttcgaatccacccaggagcggcagtcttttttagcattttttaaatattttatttttataatgtttattaaaatagctagatattttttattagagcgacactcacaagtgctcttgtggcgcaatcggttagcgcgttcggctgttaaccgaaaggttggtggttcgaatccacccaggagcgggttatctttttagctttttttaaatattttaaaaaaa

SEQ ID NO: 26873 - DNA, 922 bp, Heterodera glycines
tttaatttcggttggtggccaaatttcgaatttttcaaaatcaaaggacatattcactttgcataaattatagagctaacagatccgtttgtcgaaatatcggctttattcctgcaaaataatttttggcgcgcccaatttttagcaattttacgcaacttttttaaaatcaaaattttttattagttggccataaaattgaaaacaattatttttattatttaatttgaccgatttgtgcaattgtcttcccgcaatgtttgatcatattccgacagggatgagatgaaaatgatggcattcacattgtcaaagcaatgaatccacttcaaattcattaatttgatagcaatttgttaattattgtcttattaattatttttaattttttcaaataattgttttatttatggattatatgcaattgttgaaatgtttttacttttttacgttcggtctttgaccaccaacatcgatgaccctaaaaaatagagtagagcgggaccgggaccgggccgggaattcccggtcatccgaggtcccggtcccggttcccggattttgaaaagctcaggtccaggtcccggtagggcaaccgggaaccgggaaaaacaagcactggtaagaatggagggtctgagtgaaaaattagtgatgaaaattggagttaaagggaaaaattaagaaataatcataaatatattctttcaaagaaacaataccaatgtgcaaatggtctagtggctagtctcattgacttttcccttcttctttcccctggttcaatccctctacagaaattaaaatattttgaattttctttttgtatactcatggctttcttatcgacaaaatatgattcttaattttttttaaattgtattttatcattttttaaagaaaatccgtacaaattagccta

SEQ ID NO: 26874 - DNA, 1182 bp, Heterodera glycines
  misc_feature (1134)..(1134): n is a, c, g, or t
ttaattagtcggtgttggtttcttaaatacttttaaaatgcatttgtttttgtttttattttcgtttgcccccaccctttgcgattgtttgcgttctctccgccatttttgccattgtcgcgcgcgacccgtgccgtcgtcgcctcccccatcgacgaacatcatcaaagacaccgccgcgggagttggccccgtcgttggcatcgctgtcggcatgtcgtccattgtgcgcgaaatgtcgcggatattgtccaatttttcgaacagagaataaatcagagttgcctgacaaacggaaagcgaaatttaattaaataaaagaaatactaaaatccaattaaatttattttaaaaacattaaaatacaataaacccaaattttcattttgtaaaaacatttgaataaaaataaaataaaaataaatattatttttcccaataataattcctcttacataattaatgacatagagagatgagatcctaaaatgaatattacatttataaaatgacctttttaattgacctaattaagtgaagtcgcagcgaaagttttgcatgatgtctaaaaaaggtgagaaatattgtttaaaaataaatccaaacttctcaatgcgcccgataaggtcaaaaatcatcggaaaaatatgtgtaattgtggacagcaaaaggggaacctgaaaaataaaataaataatttattaaatttatcaaaaaatcatgaaaatgatttgacctgattctttgtaaaaatactgcccgatgatttttccacagtttctgacgattggacggcggtatgtatacagtaaatggacagaagaatcatcgctattattacggtattagttgccttaacattgtttatttgttttttgcatgctttcacaattcaatgtaccaatctgatggcccaaagtgatggtttgcatcgccgctgggcgtggatttggcattcgttaattgcctcctaattacacgcaaatttaatgtgtgccccatttcgatcagttctttcccgtgtgaacagtttccagttgaacacgtactgttccgctttgctgcccgacaatttgctgaggcgggcattcaaagaaattctaaaaaataaataattcaatttaataaatattnttagagactgttttttcggacctgcgcaaatgataaacagactgaaac

SEQ ID NO: 26875 - DNA, 927 bp, Heterodera glycines
atttaccatttgcccgttgggtagtcaatttgtggcttaattccatctttgcttttccagtcgtcgttaccagcaattgtataccatggcacattcaaactgtcataattgtacacttttgtaaaattctataaacagaaaaacatttgtatttatacaaaatatagtgtttcttttttacatattaaatattatatatattttttccttaaaaaatctttatggttaattccttttctaatactccttaattaatttaattacctgttcaaaacgctctgcaacatcctcttttgttacgccttcgtcgtaaaaattgtcgccaacgttcaacaaaaaatggggtgccatttctccagaagcaattttatacaattcttttttcgactttttagaagcaaacacttttgtaaaatcctataaaaacaatttgtttaatttttacaaataaaaatttataggagaaattaaagaatttttatatcaaaactttagttttttgttgttaggattaattaattaattattaattacttttcgaggtgtcactccattactcgtagcaagcgaatccatcgcctttgccaccgctttttgtgccacagttggacgataatactttactaccgtaggacaattatttttcttacaatcagccaccgttccttaactcacagtggtcacatatgcgtttaagtgattattgtatattcctattttattttctctcattttaaaatgttattttgttctccctcttcaacttaccgtgtccttccaccgtacactgctgctgtttgccctctaccgtatactcctccccaccgatgtcaccgatgacaaaaaagcgcaaaacatttccctccgcagaacagccataattttgcgaatttgaaacatttgtgcatttaaagccaagttgatttt

SEQ ID NO: 26876 - DNA, 1029 bp, Heterodera glycines
ttttagagatagaaattccaaataaatcctataatattctccttatttttctctatttttattgctttatttcactaaaattgatcaacacttcgatttactataaattttcaaaaattaacccaaatttccaagggccaaaaaattgacgaatattcaataatttttaaaaaattccaaaaataatgaaacgaaaaacaaaggtcatattcgtaatcagcatctcaaaataccacagaaaaaaatttttcaccccccttttcaatccaaaaaaaaattccgaaaatttctagggggcctagctcgaaaattttttaaaatttccggccatagagcacaccgttcgatagagtttcaaaagctctacaattttgccctaagacactttttggctaaaaccgacccctgacgagttatgggcccgggactcaaatgtcccgctgaggccaaaaattttttctatttccgggaaaaaatcgaaaattttctaaaaattttaccaatcgatagagctcgaaaaacgatgttttggaagtggtcttcgttttcccgggaaaattcgttaaaaaatcacaaaattcaaaaaccaaaaaatcgttttttaggcctagctcgaaaatttttgaattttttgaaaattttaaaatttgcaaatatcgagctcatcgagctctacaataagtctgctggcgccccctggctcagatcaaacccgggcgtgctattcgcctggtactgaagtgtccaaaaaaagtgattcttacgttgcctaacctacaggtcaggcctttgatctgatcaaaaaatttttgctggcaatgttgtaggcaacagttggggcatttcgcttttggggtctactaagccctgaaagcaaaagcaaaaaatttcgtaacagtgagactgtcggcaaagtcggtttttgagccgctggtactcagttggcgaccggaccggaaaatccgtatttttcccggatgcgccatcccgagatgcctaagcctgcaaaatttcagcccgatccgttca

SEQ ID NO: 26877 - DNA, 717 bp, Heterodera glycines
tttttgtttttgggcagtcaccccgccccgatgcgcccagatatatgtggagagagaatccttcgtgaatagattccctatatccagtactttaaagagaaatgggatattttaaataccccatagtcagttgagtgccccccccggacgctccaaaaaatttttttttttgttttcggggcagtccccccgagccgatgcgcccagatttatggggagaccgaatccttccggaataccttccctatagtctgtactttaattttgcgttggatttttgctccccataattgtttgagtgccccacacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccggatttatggggagac

SEQ ID NO: 26878 - DNA, 1694 bp, Heterodera glycines
ccatttgttggcaaaaatttttgttctgttggttgtgctactgcattatatttatgatagacttgccctgatattttaaaacaacttgggcctggagttgtaaaaccaaatctattgcaagctaaagaagcgcaagcgaatgaattattgtattttcttatattattcgtaaaatttttcgaagtttcattttcttctgtaaacaactgttttaattcaaatggatattcatcaaataattccaacaaattttttgattttccaaaattgcaacatgaatggaattcattcacttttgaatttttgattgattgctcttctataaaatgcactgccttgcaaaatatacattcaatgttaaactcttgtaaagagaatttttttacattgtttagttctgctgcacttttaaacaaaaaacccgtcggtatacgtttcgtatttggttgagatttttgtgtttgagtggtttcgtttactccatctaaatcaatcatatccaggtttataacgctttccaggttcatatcttttccaattttctttctttttctttctatttcatcgctttctttaacttcttcaaaatcaatcatatccaaatttataacattttccaaattcatttcatttccaatgttctttttctcattcatatgcattctttcaaaagaatcaaacattgttcttgaccgcttttttccggagctttgaaccggtttaaccgcttttttagacgggagcttggaacccgtttggttttcagagatttctgaggaattattttgtaaagaagatgaagaacattgaagctcagagggaaataattgtttagttcgaaccattgcaaatctaaaaaataatttttgaatatatttttatagctattgagagcatttcataaaagattaaaaacaccttaaaaaattatgaaattcaaaaaaattatatcaaaaaacgattaaaacaaaaataataatgaattattagaaaaaaaatggacattcacaaaaatgtgataataatttaaaagaaaaatattaatgataaaaagttcctttaaaatgaagggcacacaaaggaaaagaaatccattcggaaggggaaacgtaaaaacaaatgatgaaatcaaaaacgtaaataacaaaataatgaagtgttctcttcccttcatacataatcttttattttattaaaatcatacataataaacaccaaatcaaatgaaataaaaaaattaattaaatagtgataatttaatgtaaaaacctgagaattttacgatgactattttaattatatgtttttatgagcaccaaatagtataaaaatatgaaattaaaagaaaataagaaatataataaaacaaaaatatatatacaatgaaatttaatgtgttttataaaaaaattactgatcgatgtttttagcttcttctcgccaatacaaaagccgatttttgtggaactcaaaccttacttaaaggatgaaagacgacggaacggataagcatttgaaggaacagaattttttttaaattttttaattaaaaataaattaattaaatgattataattaaaaaagtgattattataaaaatattatttgtcgctttccaagacaaatatcaaaaattggcaacttgctacgcgagccaatgaaaagtaatagctaaaatcaatttgattttactt

SEQ ID NO: 26879 - DNA, 1411 bp, Heterodera glycines
ggaacaagaattgatgatttgaaatgacttattttgctaattgctgactaattaccctccccccccccaaactcacttcgtgtttggagccgtcccaataattgccaatgaacggctcgttaggctgaaaagtcggcactttccttcacgttatgccattttcatttaagcttaccttgaactgccaatcggcgttcttcttggaccccttcacccatttgctgccctcgagccccgtgccgaccatcatccgataagtgccgttcgggaaacggtacaaaatgcgtgtgaacctgggcagctccactttcttgcgcatctcagggtcactgtaccctaaaagggagcaaagaacggataaatcggttgattgggtgggtaatttggggcaatgccatcaaaaagttgccgtgggactgatcagtctttccctcccatcgttctgatcagaagccaatcaatggaatcgatggctgatcagcagaattagttagcccaatccattgggaaataaatcatgccaaaataatagctaactgatcagatcacccttttgtttcttgtttgaagaccgcgaaaccgaggctttacctcaagactcggctccttttgaaattgcttttctctcttgggcaacataacactaatatccgattgaaatgacgaaaactttccaaaacagtcttaatttgtaaatggcttaaggcttgcctttggcaatcaaataatcgtcccaattgtcgctgtgatccaatttgaaggcgccataaaattgttgagggatttcggcagcgccggcattttcctcagcagccgaacaaacgaagggatggagaagcacaaagaggagcggcaaagcaaatttgatcagcatcattagcactaatgagtggtaattagagttaatttagaagtgattaaaatggtgttgcgcggggaaaggttaatttttagggagggggcgataaatgacgacgtcttattattattattatcattttatgggtggggaggggaactgcgcggtggtgtaatgttaacatcaattacgggacacattagggacaaacagcgaaagggggaggaagagaaggacaaaattgggaattgggggggggggcgattcggcggagagactcattagtacaaatgaaaaagggaattgttggcaccatcatttgccaattactttaatgattaaatccgatcaggtccagtttcggaacaaagctgcgaaaaataggtccaaagttgttggccttaattgcataattattaaattgtcattagattagtgggacttaaatactcccattcgttacgcggcctcaggcagcgaaaatttgcacaaaaagcgcgtgtaattgggcgggccgtcgtcattaatcagagagaccaacggacagagaaa

SEQ ID NO: 26880 - DNA, 1236 bp, Heterodera glycines
gtcgccatgctttatgcctaattaggcaaacattttctcagttttgacacattgggctctgtcgcgctgacatccgccaccgaaatgggcacgtgccactatgacctttctgcaattgtacgggtggaaacaggcgagaaaaaagcaaaacgttttataaaagctattttttgaaatgctttatactttccggcattaggtcggtctcgtcaaggccagcgtgaactttgaccgtttgtcgctgcactcgctgaagggctatttgaaggacgcgcaaatcgaagtgaacgtcgagatcgagttggacccgttcatgacaccggacgaaataatcgccacggggaagctgaaacagctgcgaaaccgagcgagaagtgcgaagcatttcaaattttaagaaattaaaacaaaaaaactacacatggataccatatcccaaaattaccttcaaaattggacaatttgtccctccttcttaaagagccataattgatttcacgaaagcaagaaatttggattcagattaagtattcggtcttgttctgctaagtttatatttgatcatcctttgacttaaaatattgtttttttcggtcaataattctctcattcatccttttcctacagtaatctctcattcatcctttttctacagtaatcactcattcatccttttcctacagtaatcatcgtcgagatgggcttggacttgcatacgtcacgctccttcatggtggccatctaccggtctcagatgaagaacccggccgaatacgtctacatcatcccgtggctagcacatgtaaataattaaaacgaaataaaaacaattaaacgaaatttaaagatgcacgaccattacccgtgggaggcgagtaacatcgacaaattggagacacgcgtggcattcgacgacacaattgtgatcacagcgcatggctatgacaagaaattcattgaggagttcgaacttggcttctcgaaagtgaccggagtgatcagcagtcatgtgaggagaaacacaatataaacttagatggcctttaaattatttttcaaaaatttatagtaaattacggacctaaaaatacgcccaggggcgaaaaaatgtaaaatttcacttaaacattgaaaaacacgatttttggatagaattttttaatgaaatttcgttgccttatgggatatcggctttcgatcccatttgttcttgtataatatgttggatacagtaac

SEQ ID NO: 26881 - DNA, 721 bp, Heterodera glycines
ctaggcagttagatggtgttatagaattatgaatgataaaatcgactgcctcggccgcttcgcgccctcgcatcattttcttggcttttctccaatctctgggactcaacccaccagcaattcaatctctgggactcaattctccggcattccaaacactgggactcaaatctccggcattccaatctctgggactcaaatctccggcattctaaacattgggactcaacccaccaactttcaatgacattccaatcactgaaactaaacccaccagcatttcaatctctgggactcaaatctccggcattacaaacactgggactcaacccaccaactttcaatgacattccaatcactgaaactaaacccaccagcatttcaatctctgggactcaaatctccggcattacaaacactgggactcaacccaccaactttcaatgacattccaatcactgaaactaaacccaccagcatttcaatctctgggactcaaatctccggcattacaaacactgggactcaacccaccaactttcaatgacattccaatcactgaaactaaacccaccagcatttcaatctctgtgactcaaatctccggcattacaaacactgggactcaacctcagcaaatttctttagcatttttaactttttgtgtgccttgggatgttgaacagttggggagggctcggccgcttcgcggcctcatact

SEQ ID NO: 26882 - DNA, 1304 bp, Heterodera glycines
  misc_feature (169)..(169): n is a, c, g, or t
gcgggcgctttgctcgcctgacggcgggcgctttgctcgcctgacggcgggcgcttgctcacctgacggcgggcgcttgctcgcctgacggcgggcgctttgctcgcctgacggcgggcgctttgctcgcctgacggcgggcgcttgctcacctgacggcgggcgcttngctcgcctgacggcgggcgctttgctcgcctgacggcgggctctttgctcgcctgacggcgggcgtatgctcgctcgacggcgggcgctttgctcgcctgacggcgggctctttgctcgccgaaaggccagagtggcctaataataataataattaaaaacccagcaatgctcgcatcgccacagggagcaatgtgaacgcgattttgaggacgaagggaaggaattctacgagatagcatcccttcggctgtacgacatctgtaactgcctgcgttgtgaaaaaatctgccatttctggaagataagatttttcggcgacggatctgagtatttactggaaacagatgtactcgagcatgtaattttattaatcttattttgaaaaaattgacataccattaaggctggcgagtccattcttttgatcatggaagcaatcaataatcgcgccagaatcgagggccatatagacgtccatttggcgcgtaaaatgtaaatatggctattttaaaatcttttttaattttaattttttaaaattttctaccagtttcgaattttttcaacagtttttcttaacgttgtattttttacaacattttatctataaaaaaaaatttttgtatttacggatattaacgctaaaaagaagatagttccgaccaaaaacgagttattgtggaaattctcacaaaaatgaaaactgttaaaaatattcaaataaatataagccctagtcataatgataaatacgatcaattttagtattgttcaaaataataacggctccctaaaaattcacggttttgacgaatcgacaaatggcagcgtcaacattgcggatattttccctgttgtgcctatcgcaaaacacacaaggatggatcttccgtcttcaagcggtaccgtggagttgttcgaccgagggttggcattctctgtacaggaacaatacggtctacaaacggctgcgacattgcgacaaaaggacaaccagtttctcacaacatcacatgccttcgcccccactgaaatttctgctgatgctctttttaaatctgtcgttgctgcggcaactgtgcaaccacaacaaaaatcaccaccatcatcatcattatcatcggcatccccac

SEQ ID NO: 26883 - DNA, 1628 bp, Heterodera glycines
ttagaagaggtacaacgagtgattaaaaaggtacaacttttattagaagaagtacaaaagtgattaaaagaggtacatcgttgattagaagaggtacaacatggtttaaaattaaataaataatgaaaagtttttataaaaatttaattcaaatataaaaatgtaatttattattaataaaataaaaaatattttaaatgaataaaacaatgaaaacacgaaaaaatggtagttattaattaaaaacaacgttggaaattattaattgaatatttatttaatttgaaattaaattattttttttacaaattcaaaaaaaataatgaaattctttaatttaaaaaaaataaatttaaataatttaaaagaaatcttcaaattaattaaaaacagtcaaaataacccaaaaatgcacagaaaaataatgttacaccgtccggattcgaactttgcaccccccccccaaaaatgatgcctcagaatccccaatcacacagggattctgaggtcttgactatgtcaaaagtaaaactgattacgtattcgtgatcagcggcccaaataacccctaaatacatatttttggaagatttttgtgagaaaaatttttccactcaaaaatcatgtgctccccccagtgattaaaatttgaacaaaagtgattagaagaggtacaatcatggtttaaaatgaaataaataagaaaattgtattattggatgtattataaatttatcaaattaaaaaaaatccttttacttattaaaaataaagttagaaatttataatatagaatatttattgaaattgaaaggaattaattctagaaaattcaaattaaataaaacatttattcatcagaaaataatttaaaataattaataaaacaatattaaattaaataatttaaattaaaacatttgttcaccaaaataatttaatttaaattaaaaatttttatttatttttaataatacaaaacaaattaattaaaatcattaagaataacgtaaaaatgcacagaaaaataatgttacaccgtccggattcgaactttgcaccccccctcaaaatgatgcctcagaatccccaatcacacagggattctgaggttttaacgatgtcaaaagtaaaatctgatcacgtattcgtgatcagctgcccaaataacccctaaagacatatttttggaagatttttgtgagaaaaatttttccactcaaaaaccatgtgctcacccctttggtcccgaatctcaaaatcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattcaaaataaagtccataaaattctcctgatttttctctatttttaaggctttattgctgtaaaattgatcaacccttcgatttgttatgaattttctaatattaggccaaaatcccgagggccaaaaagttgccaaaaaataaagaatttttaaaatattccaaa

SEQ ID NO: 26884 - DNA, 1031 bp, Heterodera glycines
taatgctcgtaacgacaaaagctgaggcgaagacgtagtaaaaattgcgcagaattgggtagtaagcccagtaatgacgccaggggaacatgcgaagctaattttaagaaaatatatggtttaaaacattacaataaaaaaaattcgaagcccggaacccgaaaagaaacaagtcaaatttttgactttcgaatttttggctcaactggtttaaataactatcgtttgtatgattttcactatttgtcagcactacaaaaaagtggcagaaaattgtcaattttatttgatgcaaacaaagaacaaacccattcatgaagttgggttggataggcgggcattctttaattaagccaattacatatgtaaaataagcaaacaaaaaaccttggatcaagcttggtctttgggatttgccaatttgggtcaaaaaagactttcacagcaccgtggaagaatttgcaagtctcctttccaatataccacattcggcttaccacggccattttatatattaatctctgaaaagaaaatatacatacaaagtcaattaattaacaaatctatttttataaaaattttcatgcatttttctggtttacacagggttgccatccgtccttgaatggcaaggacgtccttgaaattgggccctctttcttgaaaataaaaaatgtccttggatgccaaggacgtccttgaaaatgaacatttagaaaagttttaaaaaaattcaaagaaatttgataatttttgtaattttcaacaatatttggattaaattatggcattatgtcaataaaatgcaaatttaattgcccaaaatctcaaaatttggtcattttttggacaaaatctactaacaaacagcattaaaaatacaaaattcttccggcgccgccggaccctcccctatcctcaaaattaaaaaaaaagcgcgccgtaaaaaaaccttttttgtcaacaaaaaaaagtcgtcgcatggcttaaatcgcaaaaattaggcagtttttggggaaatctgttaacaa

SEQ ID NO: 26885 - DNA, 1736 bp, Heterodera glycines
agaccgaatccttcgggaatagcttccctatagtctgtactttaattctgcgttggatttttgctccccataattgtttgagtaccccaaacggacacttgaaaaaatcgatttttttgttttcggggcagtacccccgaaccgatgcgcccagatttatggggagaccgaatccttcgggaatagcttccctatagcctgtactataattctgcgttggatttttgctccccataattgtttgagtaccccaaacgtacacttggaaaaatcgatttttttgttttcggggcagtccccccgaaccgatgcgcccagatttatggggagaccgaatccttccggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaataaatcgatttttttgttttcggggcagtactcccgaaccgatgcgcccagatttatggggagaccgaatccttcgggaataggttccctatttaggcttatattttaaaaagtttcatcgaacctagcgcactaaaatcgataaaatctctccaaatgttgcaggccttctccattgtaaaggactaacttaacttgaaaaaatgccaacgcttgttgtttttaaaatttttcgaaattctgactttttcattttttatttattttttgcaaaattaattcataagtattttttcagaaagtgctctgaaacgttaattaaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtatttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacttgaaaaaatgccaacgcttgttgtttttaaaatttttcgaaattctgactttttcattaattatttattttttgcaaaattaattcttaaatattttttagaacgtgctctgaaacgcaccaaattttatttacatgttagtttaggcactctgatgctttttctatcaaaagggagatgaataaatattttaaaaatttttaattcctttttaaacaggcccaaaagtttaggcttatattttaaaagtttcatcgaacctagcgcactaaaatcgatataatctctccaaatttt

SEQ ID NO: 26886 - DNA, 924 bp, Heterodera glycines
cctttttcggggcgtcggtggaaagaaatttcccccccccccctcaaattcccatccatcggcgaaaggtcctccccccaccgacggatgcgcagagcgccccaccaattgcgcaacacaattttggcgagaggaaatttgtctgtcgtaacgacgggggggggggggggggaaagttgggggccgaccgacgaattaattcattggcattttatgtattactgtaagaacgcaaaaaagggaatacttttacaaaaaataaaacgaaatattcatgtggttaatatagtttttattttccaagtaaatttgtgggacaattcgaattacttggaaattccaatcaatttttttcttaataatttctcgagaaatttcaaaattctcgaatgtctcgtcgactcgagaatggtctctgtctttccgggatttcgttttttcgagtttttggcaaaataaattcggagtttccccctcagaaatgttcatttgtccctttcttttcctctttaggtgtccgttctgtccgcttcatttggccgccttttgcttctcagcgctttcgaagagggccttttgcgcgcgactcattttgaggaagtgccatcgacggcggaggagcagtgccaacggaacaccacaacaaaaagcagcggaggaaagggtgaaaaaatcagtggccagaaaatgcttacgattaattatgcggcgttagtcctacctccgtacttttatgcaaagccaacctttctcccaaaaaatgcaaatctgaaaatttagaaaaactctattttcccccacgccaaaacgccctctgttggggcattcactgggctaagtcaaccaaatacaacaaacttggaatcagcagcgggcattccgacaccggtcaaaataccaacagattttctttcgtaaatttcc

SEQ ID NO: 26887 - DNA, 925 bp, Heterodera glycines
  misc_feature (841)..(841): n is a, c, g, or t
ccactccacactttctatcaccagagtatcgccaatttccttttatttgtggtttttatgtgttttatttaatttttattttaatgtttattattatgattattatgttatttcttttaattttcatatagaaaaattatatagaattggtaattttatttttaaatttatgggctaaacttgggatatttattctctgatttgcataggcatttccattattgttttgttgaactatctttagtggacttttttatagttttgatatgattttattattaaaaaaatattttttttattcaaaaaaaaatattttttattttttatgagtcttatcattaataattcttttttattattattttatttgggttaaattcataaatttcatattgaatttttatataatcgcacaaatttatttaaaatttgattgatcagcgtttttacacggccgaagccgtagcttgccagttgagtctggcctggtgtacccaacacggtctgtcgttcatcccttcggccccaagctgctcaaaaccttctctccactccacactttctatcaccagagtatcgccaatttaataatattttggtttttatgtgttttatttaatttttattttaatgtttattattatgattattatgttatttcttttaattttcatatagaaaaattatatagaattggtaattttatttttaaatttatgggctaaacttgggatatttattctctgatttgcataggcatttccattattgttttgttgaactacctttagtggacttttttatagttttgatatgaatttattagttttttatatttaanatgaattttaaaaaaatattttttttattcaaaaaaatatttttttattttttatgagtcttatcattaataattcttttttat

SEQ ID NO: 26888 - DNA, 726 bp, Heterodera glycines
tttgattgccacatcacactaattcatcattattacgctaattagtcatcaattgcctcattatcacgctaattagtcagtaattgcctccattatcacaataatcaattttttgtgtttccctttgttgtcaccagttcgcatttttatttatgcaatgactgtttggccatgatatggccccattctttgtcatccatcgttttcgtcgttcgtcaacacttttctcgtcgtcgctgatctcttcccctaattgcaacccgcccctccttaattggtcaattgtgctcccttatttaatgaatcgcacaatcactctttctttcccccactaatgagccataatttgtcccccccccacccctctcccctcccgttcgctctttgctaattgatgtgaaaatgatcattgatgatacttttctcctcccgtctctttgctcccccccccaccccctaaaatattcgctcttttgccgctcttttgacgtttttggactttgccttcccctctattccttcccatctcccaccattttctccatacacagcaacaaaagagagaagcgtgagacaaagagagagtccccccgtctgagttcggccgattcagtcccacacgccccgttgagtcctcagactcagacccatcccctgtatgaattctgccgattcagtcccacaccctcgatgacttcctccccgtcgaatggagaaaacaacaaa

SEQ ID NO: 26889 - DNA, 1022 bp, Heterodera glycines
  misc_feature (996)..(996): n is a, c, g, or t
atgcgtgacatgaatgaaactcgtgcctaaagaaattttattttattcattctttattagtaccttattgtaagtttgttctttttctgtaaaattaaaattaaaattatgttttgatttattttaaatttttattatttcacgttttttgtaggtgattgtatatttctaaattttaatggaatttttcggaaaaaaggccaaaaaaataaatttcttgcaagataaataatttatttaattgaaatttaataaatttttttgaacttgttattatgtcctaatatatgaaaattattgaaaattatatatttttattgtgtacaatattaactgatttattttttctctgaggcaatgtttatttaatatttttacaaaatgcattttcagtttttctctccgtttttctttataaatattttatacataataataattattgttgcgaattaaattatatttttatctttttttgttataaattgttatattaatttttgtaatttagtttttgaaataatttataaattatgatcattctaaggcttttctatatcttagtatgggtatttaatttttttattcgtaaaaacctaataattttccatttctgttttttttttcgtttccaatatttcaattttattgattttgactttgatttatttctttgattcaaatgtgtattttttaagtttatgctgtaaacttatattatattcatgaagttaacttttaaaggtgattttaatttttataattattatttaatctcaattattagattaattttattttttattattattttaaattttttaattttaattcttaactttcaactttatgtagtatctatctaataaaatactcaatcatatttatccaaaaattaaatcgtcctccgcttccatttaaggaattattggtggatgaatttttttaaatttaatttgttcattgttttctcacttttttcttttgaaatataanattatttttatttgaatattttttat

SEQ ID NO: 26890 - DNA, 1014 bp, Heterodera glycines
  misc_feature (20)..(20): n is a, c, g, or t
  misc_feature (996)..(996): n is a, c, g, or t
ccgacgcactcaaaaatttncggaaatttttaagtaaacataatagaaaaaaataaatatattcattcacctctacaaatagtaaattgacaacaatacccaaaatttatcaaaatcaatggttggtaaatttaattaaaaaatttcgaaaattttctcctttaataaattgcgtaggcttttgagaataatccttcgctttcaacgctaaaatcctttcgagcaacaaaacacaacagagagaaagaagtaagtggccactttccttgttcttctttcaggtttcaaaagtgtcagcatttgtcaacgtatattggtccatttttactgtcacaaaagagaaagtcaacaacaatttcggtacttgtgcagaccataaaaaaataattttaaaccatataaacatttctagggggttctcgggatcgctgaccacgaatctaagctccgcttagaccgaaaattaaaattcgagaatttgaattttcgatttttttgttcgaattcgggtccggattgaaaataaaaggtgccgaagtgtttatgcacaattgtaatttttttgcccaataaaactgacagctttaagcgctgcgctcaaatttaacgctgtaaagtattttttggcgaatgtttttttattctccaattcccaacaaattgccgaaaatttccgtatcttaatcgaaaatttcggcaaaggtttttgcaagaaccttcattttgtctatgatttttcaccaataagcataaaaaaataaactgcagccaagcggactcgaacccacaccccatctcatataacccctagggattaataaataaatttcaaaaaatcatagaaaattaaatacttgacttctcaatagattcaatagctcattcaaaaatatttttaagctctacaacatctgtatatgagttttttacgcccattcattttcttaaaatttttggaaaaaaccaagtacttgataaaaagtcatagaacaaatncatgattttcaaaatctg

SEQ ID NO: 26891 - DNA, 669 bp, Heterodera glycines
cagaataaaattgtcaatcttttcggctttcacttcagtcccttttgtctgttttcgttagagtcttcatattttcatcaaatttggttttgtactccgaatctttatgcttttcacttttcagatgacaaattaatgatgatatgctcccgtcggaaagcttgaattggtattttggctgttttttggctttgcattcaacgcattctgccagtttgtcgttttccttgctcttctcaaacaacccaattttccaaatagggtgaaatggcgccattaattatgaattattaaaatcttaactaaattggaagaaagaatatcaaaaatattattcctcatgagaaagttgacaagcaaatattaatctgactatttaattttggctaaatgttttgccaaaaattcaaaaaattccaatttttaccagtgcatttttactcccgtttttgggtaaaaatttccgggagcgggagcgggatcgggagttcaaaattttccgggacgggagtcccgaacgggaatcccgtaaaaaatcccgttcaccgaaaaaagcgggagtcgggagcgggaatcccgtaaaatcccgcgggagtcccgatcccgccgggctctagttgatatcattcgaaagcttaacaaaaatttgaagttttttcttaatacatt

SEQ ID NO: 26892 - DNA, 841 bp, Heterodera glycines
cattttccccagttttgaccattctcaactcggcctcaaattggcacttctttcgccacgttttatactttcgaatgataccaaaaagatagggtttgttagaacatgaacaaagttattgtataaaaacccgggattgtcaattgattggactcataaaagtcgattggactcataaactgcactagagccaaaatccgttccctaatcatgacacataaacaaaaagatacaaaaacattcatcaatcccttttcatgtctataaaaatgtttgttttttcgctttgtctcgcatttgaaaaaaataaaaatttctaacgcaattaattattctgctctttgttgtgtgacatcattcggaactcggccaaaattgtgctaattgccacaaaaatgaaccgacggtaattaaattaaaagtcacaaattcgtcgtttatttaactaaactgttttcccatttcagttggatttgcaacgacgtttggatggacattttcccctcttttgaccgtcctcaactcggcctcaaattggcacttctttcgcacgttttaattcgctggtggacaaacatttcgatggcaaaagcgaattgacaatttggagaccaatcgaaattagcaaggacaaaggacctgaaccgaaactatctgtgcggatggatgacaaatttgtggaatttccattgcccgaccgtccgttgcccagcaaaatccgttttaagcgccttcagattgagtaattcggaatcagagatttatggcaataaaagcattcatcccatttttagggacattgatcactccgtcatcgcttttcttcgttcaaatcaacaaa

SEQ ID NO: 26893 - DNA, 1796 bp, Heterodera glycines
gcaatcattgccgttgaaatttcttgaaaatttatataagttcattaacagaatatcaaaaaaccaagtttgaagtttaaagaagattttaaaaagataaaataagttgaattattaaaattatactttgtaatagaaatataattagactccgatggagccgttaggcgcctatggaaattttttaaatttatataatccattaatagttttaacaaaattccagttttgctgtttaacttagtttaaaaaagataaaatacttcgagaattattatttattacatagcaaaaaacataaataaagtgattaaacgactaaaatgtcgaaaaaaagttataataaaattaattaattaattaaaagtcagattaatggaataaggctcaaggtcgtggaaaacatttaacttaacggcgattctaaaatgagtattagtcaaattattctggattattattaaccaagataataatttaaatgtactcaataagaaagtatttacaaagtgacatgtgtagcaactaatattacaaattaactgaatttataaaaattaattaaaattctttatttttgtatgtaaaaattattaagtgacattgaaaataaaatattattatataattgattaatgaatgacttgattatgatctggatgataataaaaataacactctcagggcaattatttaaatgatataacaaaaagaaacaataataagcaatcaaaaatgagaaagaatttttccgacgacgataattttaaattaaaattttgctacaataaaaaacaaaattaattttggtttcaaaaaatttaggctgcaaattcaaaaattgagagggccttggctaaagcgggacaatttaaatgaaacattaaaaaacccctttaataattaaaaaataaatgaaaaaattttttcatgctgccgatgaacaagttgaaatgatcaaccaccactcgttttccatttgcaattgattgcatctacaattttaatcatccgataaatttctctagtatcactttaaaaaaaattaaaaaatcagctaattctcttaatataaaaattaatttagctcttataaataaattattattacatgcgaaataagtattttattgtaagatgaaaacaaatcaaaataaataaaaactgatgtgtttgtttgataggtataatcatggcagcgaacagagagagcttcaagcaaattattaaagtaaataaaaaactattttttaaagaaatataaagaaattatttattatcaatatgattaatcggataaaatcaataactacataaaatatgctataaatatttaataactaagcaaaaaggaagaaaatattcagcaaaagaaaggtgcaaaattaattcaaaaatagcgaaaccattgggcacaaataaaacataatttataaatggattaaagaattgggccttaatcaaagaataaacaaatgttacaaatcaaaaactgattaccaaaaaattgaaaatgagcaaaaatttattgaattaaaaaagaatataaactaaaaagaaaacattcgagcaaaaaatagaagaaaatttattatttttttttcaaatttatatttgcattaaattttcattgtgcaaaaaaagcaagtattaaaaagcagaaagtcctgtattaaacaatttaattgaggaaaattataatttaaataaaaaattgtaatattttttttaattgctattattgtttactttaagatttacactttccaaagataaaaaaacaataataattgata

SEQ ID NO: 26894 - DNA, 1027 bp, Heterodera glycines
gaaaaattaaaaaaaaagtttttgtggcattgtcgcgagattacattataaaattggtaaaatatttaaaataatgacaaaattttagcaaccaaattatctgtatttcatgcacccataaaattgcctaacaagttcttattattcatattttaattttcacctctgcagattgttcacttgttcgtttacgtccgaggaagtcgcaaattcccaatctcgcttaaatttctgaaggttttaaattcgaaattgctattattataatgtaattcaataaaaaaaatttgtgtattttttaaaataaatttacaaatttgaaaaaaaaattttaaatttatttttaacaaaactcaccgatacacttgtgctgggttcatcgtccccatttggaccaatttgcgcaccagctaaaaatttataattaagaatattcattttgtcttttaccttttctgttttattccatacagatcgaaggccgcacttaacatttttaaaggtcttttttatcaaacgtctgacttcttttctgtcgtcaagaccttaaatataacatggttggagcccaattcatttccaaagagcttgtaaaatagttgtcaaaaaattaaataagtgatttttcaaattgcctcattatttatctatttcagttgaacaattttaaataaaaaacatcaaagcataagagttgaattatcacaataatggcaccctttattcaagcgtctcttcgtcattcataggcgtctcagtcgccagtgattctctccccctccgtacggggaagcgcctcccgccgcatacgaaccgccgtacgggggagcgcctcccgccgcattcggaccaccgtacgggggaacgcctcccgcattcggaccaccgtacgggggaacacctcccgcattcggacccccgtacgggggaacgcctcccgcattcggacccccgtacgggggaacgcctcccgcattcggaccaccgtgcgggagtacgcctcccgcattcggacccccgtacgggg

SEQ ID NO: 26895 - DNA, 1112 bp, Heterodera glycines
  misc_feature (133)..(133): n is a, c, g, or t
aataaataattaatgaaaaagtcagaatttccgaaaaaattttaaaaacaccaagcggttggcattttttcaggttaagttagtccttacaaatggagaaggcctgcaaaattttgagagattaaatcgattntagtgcgctaggttcgatgaaactttttaaaatataagcctaaactttttggcttatttaaaaagcaattaaaatttttaaaaattttattcatctcccttttgatagaaaaagcttcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaacatttggagagattttatcgattttagtgcgctaggttcgatgaaactttttaaaatataagcctaaactttttggcttatttaaaaagcaattaaaatttttaaaaattttattcatctcccttttgatagaaaaagcttcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggctgcaaaatttggagagattttatcgattttagtgcgctaggttcgatgaaactttttaaaatataagcctaaactttttggcttatttaaaaagcaattaaaatttttaaaaattttattcatctcccttttgatacaaaaagcttcagagagccttatttaacttttaattaacatttggtgcgtttcagagcacgttctaaaaaatatttatgaattaattttgcaaaataataaataattaatgaaaaagtcagaatttcgaaaaattttttaaaaacaacaagcgttggcattttttcaggttaagttagtcctttacaatggagaaaggcctgcacat

SEQ ID NO: 26896 - DNA, 933 bp, Heterodera glycines
ttcaacactttgggcaaataactaaaggaacgaggaaactcgtaggaggattattcaaaatggacaaagggaacgcacctgaactgcttgttcttgtccgaagacattgtctgttcaaggaatgaaactaggaaaagaaatgcatttgcacgaaacaaaaggaaaatggacagaaaaaatggcaattggaaaccaaatttaaatttcaaaaacagcgaaaaatggaatactctttatgatcaccaacatcatcaacaacagtaactacaaaacaacaaaaaacatatgaaaagtgaataaatatgcaaaaaaaggaaaagaacccgtcagaaaggaaaagtgccaatgaaaaggaagagaaatgaaaataaatatcaaagaatgccgtttcgacaatagaaaaaacaaaagcgaatcaatttgtttttggcagttttatcagttcggtaaacgaagtgaaaattctggagaaaaaagtgaccaaaaaggaggaagtggcgaaaatgccaccgaccaatgagcaaatgcgcagcatcaattggagaaaggacctaaaagaatggcaaactgtgaaatgagcaaaaaatgggttggttgtcacatggaaacggggtgcacttcgatcactgtggccgcaaattcgtagtcaaacacaatggaatcgtgcacgtggtcttccccttgggcctcttttttctgaaagaattaattcgctaatttttattttattttcccatattttacgatatatgtgacggcgtattggtaagtggtcaaatatttgctgcgtccaaacgaaggcaaaaagccacctttgtaaatccgagtaggaacaaccttcacgaaatacttgaacgtcgtcccggctaaactgatgaaatgattaatgaaatcgcattattttaaatttgcgctacgtttcgtcgcgaattg

SEQ ID NO: 26897 - DNA, 1727 bp, Heterodera glycines
aaaaatttaataattttgggggggaaaatttttttatttcaaagtttaaagaaagaactggagaaaaaattcagaattttgattcaatcattccattattttttatttttgaaatcttaaaaaagtattttagaaatgaatacaacaatctggaaaataggtttattgaaaagtcaaaggatggcaaaatggcggaatgccgaagatgtaaagaaaatgaaaggcccaagtatgaatttaccctctctgactctcccggtagggcaaccgggaaccgggaaaaacaagcactggtaagaatggggtctgagtgaaaaattagtgaagaaaattggagtcaaagggaaaaataaaaaataataattaatatattctttaaaagtaacactgcccaattgtgcaaatggcctacgggctagtctccttgactttcccttcttctttcccctggttcaatccctctacagaaattagattattttcaattttttttttgtatactcgtgggtttcctataaagaaaatatgattcctcatagtttttttttaaattgatacatattttatcattttttaatttttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaccttagccaggtgaggggaagaattccccccttcccccgcccgaaatgaaaaattaaaaatttttacaggaaaaattgggacttttaaattttttttgtcgatttttcttaataaaataattaaaatttcaaaaaaaaacccggcggcacctatcggcaccgccggaccacgatttactcgattttaccttatttttttaaattttgactacaaaatggcaaaaagtagtctttttttggctaaaaatggttacaattcctgtttttgctgtccggcgctgaacttttttaaaaaacactaaataaattttaccaaaaaaaattcttcggactcccccccccccttgaagtgcttgtaaaataaagcccccgtgggttttattagaggctaactacgataattatattggaaatagatgtgcaattaattttgtgttcaaaatatctttcttcgaattcaatgcattttttcttgttccattttttcaaaatttcttggtgcaacggaaattttttttatttttttattaaaattgatgaacagatttttgacaaaaattaccatttttaaattaattttgaattacctagttttgtcagattttatgtgctgctcggctgtatgacatttgcggcctgtgctcgaaatcggacatttgcggctaacggaacgccaaattatcacttttttaattagggttggttgggcccccgacgtcggggttggaaaattcggggttgtcggggttgattatactacaatatgtaaaaccagtaatcaagtaattatggttttctttaatttgaataaatcaattaggtaggtattaacaaaaatttagttttatttaatttgaggaatgattcataaataattttcctctctatataaaaatattataagattttacattcttatttttattgctttttataaaatagtatatatggcattaacataaatgttaaatattta

SEQ ID NO: 26898 - DNA, 833 bp, Heterodera glycines
atcgggaccgcaattctgcacctttgcccatcttttttaatgctgctattattttttgcttaagtttctaaatgttaaataaatacgtttcggtaattttgaatatttgttcgtactggatttgattcgcgattgaccaaagaaaatcagattcgtgaacaacgacaccgaaaccccctaccccttcaacgatggtataaaattctcagatttatacaactaaaagcatcgggactccttagcaagaaaatatttttcagtgcgcctgtagtttaagcaggaaaaaaacttacaggaggtagaggttgctgggcgggttgctccattgcacaactgaaaaattagcatataaatgagagtaaaactaaagaaactgtaaagcatttttgtttccaaatggataaatgatgactgatagtttttagccagaacatacgaaaatagtcaaaatctcggggactgtcactgttttttgaacccgtgcagaaactgaacttggccaagaaatgtttcccgaaccccagtcccgtcccgtcaaccccaactttataccttgtcgcagggttcgaacagaacgccaatcagtgtccgccggcaaacacccgctttgtttggcaatcacttgggcagcgattcggcactcgacaaccctttaggaacaaagtgccgatcattgtttttccgatcatgaacttatgtgtttgatcaaagttttcttacccataacccattgatcatacaattttcttaaatttaatttgttttgccattgttttctgatcgttttcctcatcagtggctcctttagtcataaatttgtctgatcatctctc

SEQ ID NO: 26899 - DNA, 1414 bp, Heterodera glycines
  misc_feature (49)..(49): n is a, c, g, or t
agaattgtttttgtatggggtgcagctatttgatggacaaaaaatagcnagagaagtcatacacacgcgtgcactatttcatttccctctcgctgtctctacttaacaaattctctcatgttggcacgctattttttcatctcctatttttttttactgcacttctttctctttctttcgtacacaagttgtgggtttgaatttaaatttctgatcagtttgattattagaacaaaaatgactgatcagctcattcatacacatttaaatccggattattctgaatttattgaacacagctcatttctgatcattttagttcgtcaattccttgatcagtcattttctgatcagatcaggtcccatcttctgatcagtttgaatcacaaataaacatccatttttctttttgtttgtttcgagttttcagcttatctgtgctgccaagcctttctttctgtgtcagactttttacactacaactttccctcccttttctgtgctatttgattccgatcagttcagatcactcactgcccattcattcctttttttgtatttttctctgttgtttgtttgttgttttttttaccacgatcgcgccaacacatcatcatcaattcaattcaattgaataatgttcgtctttcatttcattttcaatttcaattttaatttttttaattttaatttactatttactattttacattttaatttttatttttatttttattgttgtgccaattgggccgaatttgtgcaattgtcgtttcgatctgattactccatttcattttttaatttatttattttcaccacgattgtctgccagttatcgtatgcctgcctataagatatcatttttattacaatttactatcatggaccatccaaaatatatattataaagtagattaaaatgaccgatcagcggcgctgaaatggtcacgatcgaccggcctcagttggctcttatcaaccgcgctgaattgtccatgatttttccattcattcattttttaatttatttgtctgtttttctctgactctcttactgcccgccaggagcggtgcttgtctttcactgttttctttttcatttttttgtgtcgatacctaccgtaattcgtttaccgtacttgtataatacagtgtccgaatcggtttttatttaattttatggtaaaatgtaaaaaatatttcattccagacctccgcaagagatttttcaattaatatttatttaaattattttttttccacattaattttcgtttgccatttaattttttgcaataataaaattttgtactgttttgcgagttatttgtgataattatttattaatcataagagccaattaaataaaatattatttataagaaataactttaattttacgaaatttata

SEQ ID NO: 26900 - DNA, 1800 bp, Heterodera glycines
  misc_feature (60)..(60): n is a, c, g, or t
  misc_feature (112)..(112): n is a, c, g, or t
  misc_feature (143)..(143): n is a, c, g, or t
  misc_feature (179)..(179): n is a, c, g, or t
  misc_feature (222)..(222): n is a, c, g, or t
tgattcgcgccactaagcatcgaccaattttgagtttcaaaaaatgacactaattagacnaatttaaaacaaaagtgcaaactttaatgaccataagtgatgagcattttcnaaggctttcaactttaagcgggcggacaaancgtcgggcaaatgaacaacagccagaaagggaaaangggttttgtgctgacaattagtaaatggggcatttttgcagtntaatggacttggtgaaaatccacagggtgacgtttttaaattatttttttaaaataaaagcaccccacctatcgtttttcatggtccacttaactgcaaaagctcagtctcaaagaaacctgttcatcagagcataatctgtgtagtcattggaaagcgaatccaaatcgatgccagcggagttaactgtgggaggcttcggttgaacttctgaatgtggaaaatcgattctcaccaatatttaccaagtgaataaccgtgattaataggttcgtcaacaccaattggatcatttatattccctaagtcgaaatcagcagacattggctcttcgataaactcatcctcatcttcctgctccatcccctccataaattcgtggtcatccattaataaaatcgggcaaatcttttgctttaataataaatataaattaaagatcatttaaaaatttatgaaacgttccaattatgagacaggatactatttgatctagagaccggaattttgaaatgaaggggactttgaaaatggatcgggatggaacccgggacgaggctcccgtttttccgggaatcccggtttcagccaatttttaagaaagtttttggtctggcggtatctataaatgtctgacggtgaaaaaatgtaaatttttgcaatattttttaatataggtacctactttaccaaaattgtccatttttgcaaattttagtggaattttgagggccagtggtgcaaagattattgacgatgccatcgagaatttgtggatttatgaattaagaaaaatgagtgcaattttcaaaatttgcttttttataaaaaaaaattgttattttttatttcagtgaatttcattaattatcgtaaaattcaagactgcactaattataatttgcagtgcattgttgcgattttttcattgggcaatggtaaagaatttggtccctaatgaaaataaattaaagcgttaaattttatcaagatttaaaatttgaccagttttaacttatattttgaaaaaaaaatttccaactttttgttcgaattcgggtccggggttcggaattgggcaaatccaagttcaaatgcgtaatcaacaccctcgaaaaccccgggaaactgatcttgagccgaaaataaaaaagttaaattagggaccacaattctttagcattgccaaaaatttttccaatggtagggaaattttggactaggctatacaaaaaaaaattttaagtcgttttgggcgtaccgcatttccaattttaaagaaaaaaattacgttgccatgaaggttggtgtgccgaacattgtgcgcagttggccatagcgtttggacaggccgaagtcggtgattttctaggattttttttgtcaattttttgaattttggaccctgtggtgtcgagagaactcccacactaatgattattttggttttctcttttctttaaagaaacaaacggaaaagcatttaaataaaaaaattcagcaatttttttggaaaaatagtaaatcaaaaaatgtcaaaaaaattttcaattggaaagtaccattttttgtaatact

SEQ ID NO: 26901 - DNA, 738 bp, Heterodera glycines
  misc_feature (706)..(706): n is a, c, g, or t
ctacccgacatttgaggatttgacatttgaggacccgacatttgaggatttgacatttgaggacccgacatttgaggatcccgacatttgaggatcccgatatttgaggacacgacttttgaggacccgacatttgattccgggctctgttatatagccaaatcttgtctgtatattttttccgttctcgaattcttatcccctgagttgggttttcaagtttttttgtgcatatttgatgcatatttcacgattttatttgcatatttatgcgcatattttggccatttttcgtgcatattttttgcagccctgtaaataacacattttccacttggtttgaggcttttacgttgacttttattatgcctttttttgcctttttctttggcattttgccgttttggtgcctttttggcgtttttttccgtttttggtgacttcttttggcgtttttccggaaaattcatttaaaaatggaataaaatcaagaaaacacacccctaagaaattatttgaaaaattttcagaaaatacatccttaagaattgaaaaacctttcagaaaatgcacccctatgaatcaaaaattttctcaaaaattgattggcaaaattcattttttcttgataaaaaattttagccttaaaaattttccttaatcgaaaaacattataaagtatttcataatcatttaaaagaccaanaatatatttctggttaatttttacttgttttg

SEQ ID NO: 26902 - DNA, 888 bp, Heterodera glycines
ttaagctttttaacattaatgaatttgatcctaacattttttcatttttattcaatattttggcatgtattaaaattgggaaaatccggtgtctttatgcacaaaaatcccagaaaattctcaataattatttctctcatagagaataaaatgggaaaaaatattattaggaccaaaattattaatgtttaaaaggcttaaaaacttttttggatatgaaaaaaacaaaaataattattgcagggtgcggaattgaacttcagaagaaaaaataaaatggaaggcatagaccactaggcaaagcattctttgtaaatgatattgataagtcaaaaaggaaaagcttcatatctcggccagaagcttcatttagcaaaaaaaaaaaaattttataatacaaaagggaggtaatctacccaccctgtaagtttcattcggaagtcccacagtcacttgggtacctctcctttgttagggactcaaaaactaagttttttttttggtcataattttgtagaaacttaataaaactttttgatattgtgccaagatagtaaaaatatttagggctacaaaaaaagatttgcaaattttttgaatgtatcatttgatagagtaaagtggaaaattcaaaataaaaatatactaattaattcattgctttttataggaaccaactacacaggtaaatttatgaacaatatcggtcgaacgaagtttattataataatcttttggaaaaatccaaaaaatcccattaatcctatacaaaaataataataatattaaaataataataaaataacaatacttatatcttttatactaatccctgaaagttaaaattatcaaaaaaaaataatatttttatataaaatatgcgaattg

SEQ ID NO: 26903 - DNA, 824 bp, Heterodera glycines
ttttaattagcgaaaatggcatttagaaagaaaacaagcaaaaaaaagggcaaaaaaagttaccaaatagaaattgagacaaattaatgaaataaaaattttaatttgcaaaaaatggggtttttcaaaaaatacaaaaatagttaaatttatataaaaaaatgatttaaaaaatcaattaaaaaaaaaagattaggaattattaagaaaaaaattataaaaaatgaattgaagtaaaaatatcttaaaaataaatgccaaattaagggactgaaaaatattaaaaaattcaattttcactattggaatctgagataataagcaacaaaattaattttataaagtttcaaaagcttacgtaaatttggcattaaaattaatgttttttatattctaagcatttattgcaatgaataaaaaatttgaattttccgaaaactctcaaccaaagaaaattggacgaagcttatgtgtgtaatatgatccaataataagcccagctgggaggagaccaatccagcaggttctttcgttcattttttcttttttttcagcccattaccatcattacgcggcccattcattcattcgctggtgaaaggaatttttattattatttgccgtgccgtccttttctgtgtctcgatgcccgttctcgcctgcccaggaacacacaatttgggtggcactggtggcggcagtatcaaattgtccaaaaaatatttgtgccaaattatccacggcaccgttgcgtggggggggggggaagtgccaattgttcaatgccaaattatgagcacacaaacatttttttttgaggggtg

SEQ ID NO: 26904 - DNA, 1888 bp, Heterodera glycines
  misc_feature (169)..(169): n is a, c, g, or t
tcataactagggacgggatttctaagtttttgcttattttttctgcggctttaactcgacgagaaatgcacgaaaaacacattttttgttcgaaaattttgtgttttaacgcacttattcgaacttagaaatgcttattttggcgtttcgtgcttaaaaatgcttattntagaggttcgcccttaaaataagtttttgtacttattttagcgttttatgcttattttcgttcttatttcgcgatttttgggaacaaaaatgcaataaaaatgataaatacacccctaagaatcggccaaaaaaatttcggaaaaatacacccctgagaatcgacccttaaatcctgaaaatttctaaatgtacttcatttctaactgcaatcagtaaataaaattgtttgacttaattttaactaatttacatagagcaaacagcaattttaacaaatttcgcctctacatttggaattttttcatgcttattttcgcacttatttcgcgcttttttcgcccttatttaagcacttattttggactttttcgcgcttaaaaatccgttccctaattaagacaaattgagaaaaataatttttaaaatcaaaaattctcgtaaataggtaaaaatctaaaaatgtaagccctatttattattacgttggtcagttttcaaatttcaaaaaacaaatgcgcgtctaacatttgcaaatgaaagttggataaaaataatccgtcaaattgattttttattgattgatttgggggtaggggctaaaacgcccggcaaatgtcatcattttgcaaaatatattctcctctgttgcgttccttccattccaaagcactgccattccctttttctgctcgctttttgtcaatgatttttcgtctcccattggcatattgtccaacccctcgggcccatttgcaacaatttagggcaaacaaaattcaaaagttgttttgataaaatgtgattttcgttagaatttttggttttccgcttttctcattatataaaaataaagtttccaacgcaattaattcttctgctatttgtgtgacatcattcggaactcgtccaaattgtgctaattgctgccaaaaatgaaccgacggtaaaagaattttaaaagtctaaattcagcattatttagctaaactgttttcccatttcagttggatttgcaacgacgtttggatggacattttcccatcctttgaccgtcctcaacttggcctcaaattggcacttctttcgccacgtttcaatgcgttggtggacaaacatttcaatggcaaaagcgaattgacaatttggagatcaatcgaaattcgtcgcaaggacaaaggaccagaaccgaaactatctgtgtggttggatgacaaatttgtgccatttccattgcccgaccgtccgttgcccagcaaaatccgttttaagaatcttcagattgagtaattcggaatcagagatttatggcaataaaagcattcatcccatttttaggtacattgatcactccgtcatcgcttttcttcgttcaaatcaccaaattttcgacaaaagaggcaccaatttacatttgtggattccatcatcacactctacgaatggccagccgattttggacattttttgtcgtgaaatttggcccattttttcgacaaacattcgctgtttgggctttaccaatggtgttgatttggacaatttgcgtcgtctcatttcaccgacaattctcaccgatctcaaccaattgaattcaatcaattccggtgatttgtcgcccgctgcgtttggtggtgattttgatgggccaaatgcaacaatttctgctggccaagcattgtcaaaatggttgcactctccgagaaacgatgacaaccca

SEQ ID NO: 26905 - DNA, 823 bp, Heterodera glycines
aaaaaaaaaaaaattgtttttttccggtggccgtttgggggcctcaaccaattatggggagcaaaaatccaacccagaattaaagtcaggctattaggaaagttctcccgaaggattggtttccccataaatctgggcgcatcgttcgggggggctgccccaaaacaaaaaaatcggttttttcaagtgtccgtttggggtactcaaacaattatggggaccaaaaatccaacgcagaattaaagtacaggctatagggaagctactcccgaaggattcggtctccccataaatctgggcgcatcggtttggggggactgccccgaaaacaaaaaaaatcgattttttcaagtgtccgtttggggtactcaaccaattatggggagcaaaaatccaacgcagaattaaagtacaggctataggaaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagatttaaagtacaggctatagggaagctactcccgaaggattcggtctccccataaatctgggcgcgtcggttcggggggactgccccgaaaac

SEQ ID NO: 26906 - DNA, 1033 bp, Heterodera glycines
aattccgaccccaaaaatgtcggaaatcggaattccgtgccatccctgacggacatcatcggtcgggaatgggcggtagcggtataataaacggaaaattaagtgcaaaataaaatgaaatgtgaaattgaaattcctatggcttcggcaagaaaaatggcgttttttagaccattcttacaatgttattgtaaatgttgttggcattcgaacgaaactttattaagcaaattagtttctcattttaaacactcatacaacctgagaaaatgtggcgttttttaaatcagttaaaaaggaaataaattaattaattaattgggcaatgccgtctttttcactcagtcagtccttctctgttcgtcacaattgacttgagtccaacctttagctgctccattttcccctctatttcttccgcttccatcgctttgtacggtttttctgcgcttccatcggctgacacttttgcgtaattatacctcaaatagtcacgctttattctgtagtcgaaaaggttcaaagcatagttcaaatcgtttgcattttcgttcctcaaatttatgccaattaaccacacgttgcaataagttgcgctggaaaataatttgcaaaaaaaagtgaactataataagaaaactcaatgcttttcctaatgatttgttttggatgttaaggcatattttgggcattcccaaaattaatggtcgtcattggccatgggatttccagggtcatattttttcaaaatttgcttaatctctagcataagaaaagtcgatggatgtttgagattttagtgttataactagggctataaattatatgcactaaaaattctccaaatatgctttaaaaaccggaaaaatgcccaaatatgcactaaaatatgccttaaaaatgacccaaaatggcttttaaccctcaaaacaaaaaagccaaaattgtgtaaaaatacagaattggctttaaaaaatggctaaggagcgtttatagataagtgcaaaaaattttgatttctaaatttatatat

SEQ ID NO: 26907 - DNA, 158 bp, Heterodera glycines
cccctcccctatttccactcacccctcttccccactgctcccaccctttgcccctcccgttcccccgctccccgctccccctcccctatttccactcacccctcttccccactgctcccaccctttgcccctcccgttcccccgctcccccgatcccc

SEQ ID NO: 26908 - DNA, 713 bp, Heterodera glycines
ccataaaaaaatggaagtttttccggtgccaaatttttgtgaattttctttcgtcccgtcataaacggattgtttggggcaatatgaatacaaattttgtgttattcgaatgcgctagccgatctatacattttcttatgtatcagcccatagtgtctctccccgggtggggggaggggggaattgaaatggaaatggttctgctggtgattcccaccgccccgcctccccaccccgtcccctcccaccatcttcctatgtccatatgtcctctgatgatgagatctaaatcattttatggccaactacgatcgacgatatggaagtggcgcttagtagggcatcagacttaggcaacaatgagtacagagatccctcaaaaaattttcagaaatccttttttgtttatttttaggttggggccaaaggtggacccaaacgaccgggccctttagtaagcttatagaaaatgtcaattcatcggaaaaatccttttttatagccaaactcatatttggacggcacacaccgtctttcatgtcattcttatcgaaaattaataaattaaagcttttttagaaagattcacaattattaaaaattagcgagtgagagagagaaaatggatgtgccaaacgttggagacgaacacgaggacttcgaagacgatgcggtgagatatatcgtatggaaaaagaaagaggggggggggg

SEQ ID NO: 26909 - DNA, 1262 bp, Heterodera glycines
tggagcatacgtcagcttttttgaagcaattcggcaccgagttgggaataattggttcccaattcgcatcatgagtgattttgaatttgcggcaataaacgctgccggaaatgtcttcccaaattcggtcaaaagtggttgcctatttcactttgggcaggcgttatttcgtcgcatccaacgtcttcctaatttgtacacaatctacctacaagacagaaatttccaattgtcaattcgatcattggaggtagaaattggggggggggatttttcggttttagaccccacccccagaaaattttaaaataaaaaaataatttttatttttttttaaatcaaggcattggcatttgtgccagatcactatgtgtacaattatttttgtgcattgatgtcaaagtcttttggaaaaagcgcgccgaaaaaaagtgattgagaagcaaatctgaatttctaatagtcatttagcccaaaatgattaattgtttgaaatgattgaagaaaatttgtttgaaaattttcattaatttaatttagctctaacttttggattttattaaataaaaaatcaaaatttaattttgtattattttcaattgaaataaattaaaattaattttttttttaattttttaaattttttgaatttttaaaatttcccggttggtcccggttcccggtcccgaagaaaaatcgaggtcccggtcccggcttctcaggtcccggcaagtcccggtcccggttttgctcaaaattcccggtcccgcttcattctagtttaaattatgaattggttaatgaaagtttgagaatgtcacacctaatcaactgacaattagcataagtttgatcaaatggaacaaaattcacaataacaaaaatgaacttaaaccatatgacctttcttttgaaaaaattgtaaccacaaatttcaacggagtaaatctgtgtaaataaattaaataatttttttgaaccattggcaaatagagccgatgttcagttggaataaatgcgttaatttacgtcatttccaccggagcaaaagcccatataaatggctaaacaaattcgaaacatttaaaatatttttaaaatttggcccacaaaaatggtaaaatcccttctgtttgtgctcccgttgctttttgtgcttacggatgctttttggatgatgccattcggtggcggtggtggtcgtggtggtggcggcaacggctgcggcaaacgccaccacaaaatgccagaatcgtcctcct

SEQ ID NO: 26910 - DNA, 891 bp, Heterodera glycines
tttctatatcatatgtttccatatttcgcgatttatctctatagtttatgtccatattttggcatttttccaaaaaccccctattagaacggcccccatcagctaaattggccgttttgaccccaaagaccggaaaattttccgaaacacattttttacaaaattttgtcaaaaaaaattgattaactttaaattttcttaaaaattggttaatttatgtgaaagataagcaaaaaatggaaaatttcggttttttggtcgggttttttttgaaaatttacccctcaatttagaaaaatttatgtccatactttttgccattttatgtccatattttgagatttttaccattttatgtccatatttcgcgatttttagtccatattttatggccatatttcgcgattttatatccatatttttaccatcctagttataacatcatacctgagcattcggtggcagatatcggtaaatgtcatatatctgttctttgaaccccttggtgagcatttcatcggcttcatccaaaacgagcattctaatcgaacgggtacgcaaattgcgacggcgtatcatatctaacagtgagaaattgaataattaattcattataaatcattgtctatcaccgaaaacacgtccaggagtaccagctacgatgtgctgtccataatccaattttcggatgtcctcgccgacatttgtaccaccgatgcaggcgtggcattgcacattcatataatcaccgagtgccaaaataacctgaatcacttgttcaaaacaagtaagaaacaataagaaagaccttctgaatttgaactgccaattcgcgagttggtccgagtatcaatgcctgagtttcacgtgttttgatatcaatgctttgaa

SEQ ID NO: 26911 - DNA, 910 bp, Heterodera glycines
cgcttcactgaagacgccgaggtcgaggaggcggtggggcagtacctgacctcaaagatcggcacagattttttccgtcgcggcattaggaaacttccttctcgttggagaaaggttgttagggtccagggaaactattttgttgagtgatattgtatttacagttgttatgagtagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttcgcgttttttagtccatataatttacaaccctagttatgattgttatttttgatattttatttataatttttttttctaaaa

SEQ ID NO: 26912 - DNA, 998 bp, Heterodera glycines
  misc_feature (16)..(16): n is a, c, g, or t
atataccaacaataanttagatttggttgacaaagaaaaaagttttagtccaaaaactgagctggcgccgaaacggtcggcgccgaaacgcagtggacccgggaaaatcccctacccctcgcgaaaaaaaaattaaaaaattttccaccgcacgccaattttaccaatagtttttgaaactttgcccacaaaatacaaaaaaatattcatttttttttgtcgaaaaacggcttcaaattcctgccttttctccccggcactgaaaattttgaaaaataacatcgtagaattcggatcatccctcctaaattcgtgatcaacgaccccaaacattgaaaatgtgccaagaaaaagcagcaacaattttcgtacttgaatgatggctgccaaataggacggaagtgaccaaccctcgggcagtcggccggtgtacagtgacaattccacccaaattgcgttgatggtcagccaagtgctaaattgcggaaacacaaattttttgcggcatttttcagtgtcgtaataatttaattttggggctattcaaaaaaattttttgaaaaaattgaacattggcaaaagttggtgcaaaatttacggcaatggtatcataaaagaaagtaataaaaatgttatggccgggggatggtacgttgattggacgcgtaaaagtcatttgaaccaaactaaaccaccttgaaccgaacatgcagacgcagaaataatttttgatgccagccattccttaatttaatgataaaaaatgccaattatgtaaaaaacaaacaaaaaatgcacttaaaattgaggaatttccaaaaattttatttataaatttggtgccatcaatttttttttgttgcgcttttattcgaattttaatcatttgagaagaattggagtgccgaaaaaaatgggacacaatttgctttttctgatttttggagtagcgaccaaatttacgctcaaataagcacgaaaaacgttaattttggtaa

SEQ ID NO: 26913 - DNA, 1012 bp, Heterodera glycines
ttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggagcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggagtagttccccctaaaccgatgcgcccagctttatgggtagaccgaatccttccggaataccttccctatagtctgtacttttaattctgggttgggatttttgttccccataaatggttgaataccccaaacgggacctttgaaaaaatcaatttttttt

SEQ ID NO: 26914 - DNA, 1207 bp, Heterodera glycines
atccgaatgagaagccattgattggaaagatgagaaccgcttctcgtgtcacaagtgtggagaacaaggacacattgcgaagaattgccggcaatgagaaagagtaagtccgtggaaatgaatggttaagaatgagtatgaggcccggggacggtccctaaggggtattggaggagaatgaccataaagagtgctttaaaaaaatcttttgcagtgggctatggcccaatacgtattttgaggtcacctgcgttgtctttcttttctcaaaatcttatttttgtccactattgtacctaactgtcttcttccgctttattttctattgtaaaataatacatttaacttttcttaatatgaaataatgactagtgagctacggcccaaaagtattaaaaatgacgtcaaatatttcagcaatggaaaatcacataattcctggaatcccttttcttcttgacggtcaaatcgccataaaattcttcactttgcgatatttcactagcaatcatcatccagcaccgtttgagatggatttcgacgactggggagtgagacacatgcactcgtccgagcaagggtatttcgccttgcgtgcggttgagttcggtgaccgacaacagttcgaatatgttcttaatttggcttcggccagagatgtgaagaaccgaggaaaaagggtacgcggctacaactatgggcattggcagacggtcaagagagaacacatgctgcgcgtggtcttggaaaaatttcggcagaatgaaccgctgtgtgaagctctgctccggacgggctttgtccgactcgtggaagccagcactgaccgatattgggccgccggattgctgataactgatgaagctatacgcagttcaaataattggatgggtcggaatgagcttggctgggtgttgatgcacgtcagagaccaacttcgaccattgccgcaacaagtccacctgatccacaagcactacatcgtatgccaggcggcagcgcctgactacgttgtggccctcgcagcggagccacatgttcagccgtatgctgttcggattaacaacgaaactgtcaatgctgcccgacaactgcaaattggcgatactttggtgatagaaagtgtggagtggagagaaggttttgagcagcttggggccgaaggaatgaacgacagaccgtgttgggtacaccaggccagactcaa

SEQ ID NO: 26915 - DNA, 985 bp, Heterodera glycines
actaattgcagaattcccagaaaaaaaaacttgaaacttttttacatttccttgaatttaataaaaaaaaattcgaatttatttatgattttttttttgatttaggctagataactaaatttttaataattttttaaaattaaaagaaaaatttgcggcgacattttgccctgctcccccctccctccgcaccacacctccttgaaactgttgacccaatcgaagtccgcttgtgcgttcaaatttctgccacaacgaaatcacttgggttggccatcttttatcggagagtgcaaccatttggacaatgcttggccagcagaaattgttgaatttggcaaaaacatcccaaatccgctgttttttttggctgttgttaagctacttttcgagttattagggcctattttctaggtttttattttgaaggaatagaccccaaaaaccggtcggggtcgttttcgcgtggccattttcgcgtgagtacctgtttaggactgaaattggtcggatttgtgcaaaacatccatgtttcgaatcccgaacccgaattcggacaaatttcttaacttttttatttcttgcggctagtatcttctacaataatttgtcagtttggtcggatgtgcgtcaaacggaaaaaataattaaaattggttctagtcggttttacgcgtcccatgacactacgcgtcccatgacactttacgcgtcccatgacatttaacgcgtcccataacattttacgcgtcccatgacattttacgcgtcccataacattttacgcgtcccatgacactttacgcgtcccataacattttacgcgtcccatgacactttacgcgtcccatgacattttacgcgtcccataacattttacgcgtccgatgacattttacgcgtcccataaaaatttacgcgtcccataacattttacgcgtcccatgacattttacgcgtcccatgacattttacgcgtcccatg

SEQ ID NO: 26916 - DNA, 1407 bp, Heterodera glycines
  misc_feature (31)..(31): n is a, c, g, or t
  misc_feature (742)..(742): n is a, c, g, or t
  misc_feature (804)..(804): n is a, c, g, or t
  misc_feature (806)..(806): n is a, c, g, or t
  misc_feature (814)..(815): n is a, c, g, or t
  misc_feature (821)..(821): n is a, c, g, or t
  misc_feature (823)..(823): n is a, c, g, or t
  misc_feature (833)..(833): n is a, c, g, or t
  misc_feature (858)..(858): n is a, c, g, or t
  misc_feature (916)..(917): n is a, c, g, or t
ttttttttttttttttttttttttttttttngggcaaaaaaaaaaaaaaaaaaaaaaaaaaaaaaaaaaaaaaaaaaaaaaatttatatttttttttttttttttttttccttccccccccccccccccccccgccgtgggggggtgggggggggaggggaggggagtttttttttttttttttttcttttttttttttccccccaccacacccaacccgggcgggggggggggggggggggggagagggggggggggggagacaatcatctttttttctctccccacctccccccccccccccccccccctccttcttttttttttttttttgcccccacaaaagagagaaagagttttttttttttctaaaaaaaaaaaaaagttgttttttttttttttttttttttttttttttcttttttttggaaaaacccccgggggggaaaaaaagggggggggggggggaattttttttttggaaaaattaaaaaaggggggggggggttttttaaaaaaggggggaacccgggccccaaaaaaaaaaattaaaaaatttccgaggtttggaaaaaaaaaacaattttttttcgggccccccccggggttttttcaaagtgtttaaaaaaattttttttttaaaatttttttttaaaaacaacagtccctcaccggtttcccccagttggaagggtagggtccacggatcgatccgggaagctgggagtaattgtaaagcatncatcaaaatggtaaaaagaccgtacgcattttcgaaattccatttttgtattatttcaaatncnaaaagatnncattancnagacaatttngggtggggtcttcccagcgactaanttcgcaatttaccaacgatttcgagcattttgctgatggacggctccaaaaatcgacnnaaatattcgccactcatttgcttggggaaaaagcgcagcacttcggaggaatttttggcacgaaaatcggcgattgcgtgcagaattttggcccacgccgttgtcggggaaagggcgctttgctcctgcggcatttgttgctgactcccagtttctgtcgtggcattttcatggtcaacatttctaacatgaaattcaggcttcccatcgccgtccaccacggcacattcgtagcgcacgcggtcgttgaagtcacaggtggaccagaaaaggcgagtgacacggtagccgacctgtaaactttcacaaaaatgaatatggacaggaaagtaatcaaagtgccattgaaaaaggaatttcaattgcctaaatggtgattcaatgaaagcctttttaattatagtaattaatagtgtttgatattaaccgggaaaatgtgctcctctgtggtgaatgccttcagctgatcgggcaacagttggccaattcg

SEQ ID NO: 26917 - DNA, 1228 bp, Heterodera glycines
ttaagtttcaaaaaagttatggccagaaggaactcaaacattgagtatttcgaacttttttgccctgatttttttatgtatgaataaaaattttttgaaaattgcatttttcaaaagctttcgaataataccaataatgtttaatttggttaagaaagaaaaaagttatggtccaaaaagtcgtccgacgacgttttgtcccactccggccgataggtgccgccgggaattaccaaatttactttttctcctgctttttgagaattcgaataacaaatgaagcataatcattggcacagatgtggaaactaagttcactgcccttgttgagtgtattggtctaaatgatttaattgattaaaatcatttttaaaggctgatcatttctttaaacttacactaatgacccgttgtgccccatttttgtcccaatcccaacggataatttgtgccaatggcacagaatttggcttggaagaagaagcattgccaatgtccttgattttcaatatgggataacagcttgtcataaaatcactgaaaaatgtgaaaaatcacgctaggccaattatgttatcaaaatttgattgttttttaatattatttttaattttaaaatttaaaaaattgaaattacagtgcagcaaattgggtcacatcacgaaatgaccagttgtatctgctatagttttggccagagaatccattgatcgctttttcgtcaacaacaataaattcgtcaaagatttccattgattatgtgcttttaattaaaaaaaatattttattaaaaaactttgacaataaaaaacaaaacaaattttcaaagaaaaagttttgataattaaaaatgtggaaaacattttaaaaagatgcaaatgcaattccatgatcaatatttttaaggtcagagaaacgttgtttattcaaatgatttgtttacatgtgaaaagaataaaagacatgaaggaaaatagaaaaacaaaaagcgttattttcttaattaactcataactaaacaattgccaagtttattcatgccatcactaattgatttcataatggaaaaacgcgtgactaattgacgtatatttaaccccgacccgagtcggggttagggtaggggttcggggtcgtcggggttggaagcgtccgggttcgggtcggggtaaaccccgaaaatggccaaaaatgtcggggttcggggtcggggcggggtcgggatgca

SEQ ID NO: 26918 - DNA, 1422 bp, Heterodera glycines
ttttagtagagtgaagcgggaccgggaattttgggcacgtatcgggaccgggaccttttcgggttgaaaaaccgggaatttttggctgggaaaaccgggaaaacccgggactagtccccgtcccggtcaaaaccgggaccatggtactcagttgtactcagttgtccgctaccaggtcccggtcccgcttcactctagtttttagggacccgtgtgggccccagtttttgggccccggggtcgtttgggccccaacccaaaaatagaaaaatgtgcttttttaaaaattaagattctaaaaactaagcctgagggatccctcgccacttggcataaattaggtttaattaacattcgctcattttttacaattttacttattccaactcctattattttttaatagttaaccaatttgatgtgcattctgatttggacatttttcagaaatggctaacccaattgcaaccaaaaaacaaaaagtaaaattgtcttacgaaggccacctttacaccttcgctaaaatgagttctgattggatgacaaaattttgaagatgcgagttcaaaaaatcaatttcacattattttggagtttctccggggaatttctcgcaactatcgaatgaacccgtgattttttgttttattgtccaaattaccttatgaacccgtgaatttctgttaatttttacattttttattgttaaaattattgttgaatttatttttaaaatgtttattttacatttttatgctgaaatttaaaaagttgtttttactgtgatttttcatttttctgtacttggggcccaaacgaccctggggcccaaaaacgagggcccaaaaacgggggcccaaacgcgggggaccaaaaactggggcccaaacgcccccgactcctatttggcccaaaaaatggtttaaataaattttttagtactttatatgctttgatgttcattttattttgtccaaaatttacaaaatttgcaaatttttagcagatttttatcaaaaaattgtttttttttgatttttggaaaaatttaatagctttgttctttggcatccaaatccaacaatcttggtatcattcgaaacacattgtggaaggcgctctttagcggcattgacaattacatcacatatcttaatattcttatacatttaaagtcttggccagaaaatccacaattttgtagttgcgaagataaatgtgatgaagaagccatttaattccgaggaaaaggacaaaatgtttttggttctattggtggacaacaaatactactatgagatgaatcagtggtggttcgttggcgttggctggtcgctcgggtgaagaaaaggtcgttccacccacccatcccaccgccctgcctcgttcaacacacactttgcatcaatttacataaaaaac

SEQ ID NO: 26919 - DNA, 998 bp, Heterodera glycines
  misc_feature (903)..(903): n is a, c, g, or t
atcatttgataatggattcaacagaaacggaaaaattcgtttctttgtggaaaatattttacttaagatttggtttcagacgcggtgtagaatctttaaaaattaatattatttaaatcttttataagatttacgcgatacaaattaaggaaatagtaaagttcatgtgatcttgatagaaaatggataatgaaaatgtggtttattgaaaaaaatggtgttaattcgcgtgcagaatctataaataaattaatattattttaatcattaaaaatattttagttatataaatgataaatcgaaatttattaatgctctgataaaaaaagcatttgataatggattcaacagaaacggaaaaattagcactttgtggaaaatattttacttacagatttgaaggtttcagacgcggtgtagaatcttaaaaaattaatattatttaaatcttttataagatttacgcgatacaaatataggaaatagtaaagttcatgtgatcttgatagaaaatggataatgaaaatgtggtttattgaaaaaaatggtgttaattcgagtgcaggatctataaataaattaatattattttaatcattaaaaatattttagttatataaatgataaatcgaaatttattaatgctctgataaaaaatcatttgataatggattcaacagaaacggaaaaattagcactttgtggaaaatattttacttaagatttggtttcagacgcggtgtagaatctttaaaaattaatattatttaaatcttttataagatttacgcgatacaaattaaggaaatagtaaagttcatgtgatcttgatagaaaatggataatgaaaatgtggtttattgaaaaaaatggtgttaattcgcgtgcagaatctataaatanattaatatttattttatcattaaaaatattttagttaaatgataaatcgaaatttattaatgctctgataaaaaagcatttgataatggattcac

SEQ ID NO: 26920 - DNA, 752 bp, Heterodera glycines
cgacttacaataaaagccgaacattacttcaaatgcatgttaaaattgtttggtgaacttatctttgtattttgcacttttccttacattccaaactttctatgaatgcatgggctgccattgctttcattttccaattttcacaaatttcttttaattctccgatggaattttttccaattacctgcggctcattataaaatatagggttcgagccccgtgggcgggggtggcttttcgcgggggcgggggtcagagtcgcgggggcggtggcgggggcacgataattccgcccccgcgggggcgggggcgggggtttgctttgaattagctccaaaaatctcacaaaaaaaatattttttatgaataatttctttggctccacattgtctaatggaaaaattactggaattatagaaagaatttttttttcaaaattcagcctttctttcctaaacctagtgatatatgatcagcgctaactgtgatgaagaaattctttgaacattagtttttcagtattaaatcaggcgccgcattggcgcttatgccaggcatttcgttgggtaaaattttgtaaagaaaaatttaatagcaatagtttcttcataaattaatttgttaaatgaatatgcttaaggatatttttcatattaaattgttgatataaagttagtcaaaaaaccatcaaatcaaattttcattggtaattgcaagaaatgcctttcaaatactcaatgacacggggaacg

SEQ ID NO: 26921 - DNA, 991 bp, Heterodera glycines
ttatgcgcgcgcgtgttaatacatttctttaaacatggccaaataatctgaatcggttttttgagtatttcagcaataactttaaaatttgtaatttaatagtcaatgatcgtacagtaccaaaaatgcttaaaatttgtttaaagaaataaaaaagttatgttacaaaaaaatgtttctggccggcgaagtttttgcctgctccgcattcggagggagtactgtagtacagtattttaatctggctatagattaacgaaatttcctcttctctattgatttaataacataccttataattaaattaaacaatatacagtacgtacatggactaccatttggcgaatttgggccaactgtctccggcggtgacttctgctgctggcaacaatattgccgcaggcggcgtcgatttcttccagccgcaacttgcgcaattcaactcatccgccgcaattggactcatggcacaacaacacccgccaaaagacatcaaaagggagcagcagccaagcaacacgtgattattacactcacccaaattaaattaattaaaaaaataattctctggaatttgaatgcatttccgaaaatcccaaaatcttgtctgcttcttttaattgggagaaaagattatttgttagaactaaaactttggtaatatttgtgccttgtcaaactgatccatcattgattggttgttctcttttgtctctactcaaattttttaaatgttttctgaaacattttgttcatcaatagggaacaggttttaaacagcaaaaaatttcaaaatacgcgtcagccctttccatttctctgatcagcaaagcgttttctactttgtttgggttttgtactttgatcattaagtgctgccgtcggcattgatcacgtcattctcaagcaacatgccgccgccgctgctgcagcaacccaactgaaaggcatgccattgatggggatgcgcggaaagcttagttcggctgct

SEQ ID NO: 26922 - DNA, 1522 bp, Heterodera glycines
tttattgtttattgaggcgatgaatctttttcatgtcttttaattggtctttttccacaaaaaaacataaaataagtatggcgaagttgaaaaaatatctatccattcttgaaaaatgctataataattgtcattctcctcaaaataattattctccaatcaattttaatttgcataattatggaattagtcaaaatcattcgatgccaaaataaaaattctaaaaaaatcaaataaactttagcgaaattcattaaaatccccgtgacacacggagagtggctaaaatttccttctcaaagtgtgatggaattgttcattttttatcacgacgaatacgaacggttgtacaattgcaccgggctgaacattgactccgtccctttggagcagcgccaatttgtgcccgagtcaatcgcaattagcattttgtgcaccatttactatgtaattagagaaattaaatgcctaattaaattaatgtaaaaattaaaaagccgaatagtaaaatattcgaagtcagattagctaggttttttgatgattttgcattaatcgaattcacttctttttaatgatttaaaattttaatagaaaaatgactcagtgttaatgactaataaatttgaagaaaatagaaaataatcacagatagaaagagtactgtattgtctgattcaatacgttgagatactgtatctgccctgtatgtactccatatggaagcgtttgcgtgacaattcctgctacaaattgctgttctacatcggcatcactgacatgggcattttgtggattctcggcttcttcagggcatggcttaacctgcatggatatgtgttctgctcctatcccacactgatttattttgtcggtgttttggtaacaggtgagaaataattattagttattagtcttatattaattgaataaaattttcgcttatatctctcagtgaaaagtaggactggttcattcccttatttgctagagttcccaggttccggtttttgaagagtcaatttcccggtccgggtcccggtagaataacgggagctgggaaaatttgccattattaggttaaaatttaaattttgactaaaaaccccaaaaaaagcttttctgacaataaacaccaaaatgagtatttatccagttcgttttttctgattaaccccttttccactgatgaaagtttttgctaccggtcttggtattggttttcttaaccctcttttgcacaaaacttttttttaatttctaaactctcaccaaaattaaggaattttcggacaagttgaaaatctaagtaaattatcagttttttgaaccaaggtaccgaaaaaggtcgggaattggggatgagagctcggggtcagggatttctattgaaaattaagtggatttaaatttagtaatattttatttaataatgttttctcctttatttttataattaaaaattttagccctttggatggctgaaagcactgctgatttggtaggctaaatttaatcaaat

SEQ ID NO: 26923 - DNA, 969 bp, Heterodera glycines
  misc_feature (965)..(965): n is a, c, g, or t
gacaaagatagatatcagacttttctgatttgaaagaatttaatcagaatgttatgatttcgtttaattacaaagatattaaccagaaatctaattttgaaacaatagaaaccaaatgttatgtttttggttaatcacaagatagaaaacagaattctgatgtggacaaagaatatatatcagattttctgattttggtttaattacaaagattcaaatcagaatgttatgattttggtttaatcacaaagatagaaaacagaaatctgatttggacaaagaatataaatcagaatgttctgattttggtttaatcacaaagatagaaaacagaattctgatttggacaaagaatataaatcagatgttctgattttggtttaattacaaagataggaatcagaatgttctgattttggtttaatcacaaagatagaaaacagaattctgatttggacaaagaatataaatcagaatgttctgattttggtttattacaaagatagtaaccagaatatctgattttgacaacaatagaaaccagaattttatgagtttggtttaattacaaagatagaaaccagaatattcgaattttgacatcaacagaaatcagaatattctgtattggtttattacaaagataggaatcagaatgttctgattttggtttaatcacaaagatagaaaacagaattctgatttggacaaagatagatatcagactattctgattttcaaacgaatataaatcggaatgttttgattttcgtttaattacaaagatattaaccagaaatctaatttgaaaacaatagaaaccagaatgttatgtttttggtttaattacaaagatagaaaccggaatttgatttggacaaagaatataaatcagatgttctgattttggtttaattacaaagataggaatcagaatgttctgattttggtttaatcacaaagantaga

SEQ ID NO: 26924 - DNA, 1348 bp, Heterodera glycines
  misc_feature (1288)..(1288): n is a, c, g, or t
aacatacaagtattttatataaagctttaaaaattgaacacaacatttagaggatttctgcaaatttaaaatgacatattacatgaaatggaattaaaaaaagataaaaatataaataaaatgcgtatcaaaactaacttcggttacatatttttcaaaaataatattaataaaaagtaattaaatatcttttatgtagtaaaattaatgaattttcaaacaaaaaaaactattgtcatgttcgacagtcctttaaagttaaatatgaatttcaaacaaagaattaaaacataaaagcataaacattgaatgagtttattaaattaaattaaaaaaaaaaccctaattaaaaacttaaagattattttgtcttagctttactccaaaaagcatacgtattaaatggctccacaataatggcgacaaatcacattgctgcgtggatgagtaaatcttgaagaatgcaatttacttgcgacttaaaaaattgacaaatataaacaaacaatgtatttgcaataatttatttatttattaaaacttaacgattaacggataagcaccttagaatcagttccgatcgctgttgtgcaccaagactggcgcaaaacccaaaaaaatggatggattcccttggccgtcaagtttttccacatactgttgaataaaacaataaaattaaaacaataccatatccaactataataaaaagctatgaaaaatcacataatatgctgtgttttaaaatccagaactaatagcttactataataaattctaatattatttaaatgtaaaagttaaaaaaataaaactatcataagaaaattattcccaaaattaattaattaaaaagagatctaattatgaataaaaataattaaattttaaaaatattttaataaattttatttattcatattttatttcaaaaatacgcaaagcaactggacggatcttgaatgctaacttagcacacatgattttaaacaggtattaatatttttattttttattccaaatttaattttttctatttagcaccaaatttaatttgtaagttttagatttatacatttttcattattagcaaaaacacagctggttttatgctaccttatattttatataaattttctttaagtagcaccgcgtgataaatccagtgtttcaggttcataatttattttaaaatataatattaagctctttattgctttaatttataaaattactttttgatcagaaatttttgttatattaatttatggtcaccttaatatcatanaattatattttggaaaaatgaactatttgtcattatcattttagtataagtttaataatt

SEQ ID NO: 26925 - DNA, 936 bp, Heterodera glycines
agtaagaaattttagttacttttcactgtgcctcttctaccccatgaaaatttgaattatcgaatttatatggaaatttttttgacgttggatatttaaaaatgaccagtgccaatgattttatctgtaaaagcattggaattgagatttttggtgattcaaccgaaaaatattttgaagatttttttcgattgttagccaatacaaaaaatatttaaattaaaaaatttattaaacagaaactcttttggacaattgacaaatattaagcataataagcataatgaactgctaaattagacatcacactttatgtttatattgtgcacttttcggcatttgcttctgccgcttttccccaccattggtgcggatgaattttgttgtgccgaaagtgctttttttgtctctctttttacattcgcccactttccgggggaaaagcattacttttaaaaatttagtgccaacatttcccatcaatgcactgaaaagagccaattttgttttcaattccgaaatttctttgatgtaagtttttttaaaacttttaccgcttacttttagtaaaaaattccaaaagtcctttgacaggctattctaatcattaaaagcttttttaagtgcaaaaaatttatttattttccaatttttaaattgaaattcgctttttgttttacttttttcccatttctcatgacaaatcgattttattttccgtttttctccggcggatttcaattcatctcggcggctgatgaatgaatcgttttaacctcttttactcatctccgtccaccttttaatcacatggaatttttattatcctctgaaagaaagcacagccaaacacaactaacaaacaactttttatgctcacaaaagtcacaaagttcgccctttaaattttcattttatccattctctttttttgga

SEQ ID NO: 26926 - DNA, 1274 bp, Heterodera glycines
  misc_feature (1234)..(1234): n is a, c, g, or t
  misc_feature (1242)..(1242): n is a, c, g, or t
taaaaaataataataaataagatcaaaaataatcaataataatttaggcggcaaattatggcattgtgttggactccctcccaccgctcgatgactactaccccggcggacacttccctgaggagctaaagaagccggagcagtggtacgaggagaaccgcaacacgccgtttgacctgcgcgaagtcattgcggattactgcaaagcaggtaaaaattgggcatcaaaaaaaaatatgcaaattttcttcagatgtccaaattttggcccatggaatggccaaaatgcggcagctgttcgccgctgcaactagccaggagctgaccgactccatcaccatggcgtctgttcgacttcacaagggccaacgggaccactgatctttaatggggcaaaatgaagaaagaatgccttttccaatggccaacgggacaactgatcattttagggggcccaccatcgaccttataccataaattatagatgcatttgcgtgataaacaaatttactatcaatcgcagcccgatccgtggatttgttggaaaccaatacgcagtcccataatttgagaaacttcatgatcagattaatcaggtacaaagtcggacacactgtaatttggggctcttataaaaacttctcgttctgccccgatttccgccttaaggattggactgatcatttgcactctctccgtcactttcgcgttgatcaattttctaattcgcttccaatgcctttcccttcccgtgccatttcctttcattcaccaactgtgggcaatccataatatccaaccacactttgctatttgtacgtatttccgttcattctttcgcctctgacgaatttattcctcgctgaagctgcgctataattttgtgaaatccctccacactttccctccccccctttttcctctccctttctctccgccctcacaattcccccaaatatccgtcgtcgtcgtcgtcgtctgcttgaaattcatccccgcaggcgttgtacgcctccatcccccctcccttctcgccttccttcgcattcgttcgtttcgttcggcttcccattttattccctctgcatttccatccgaaacaacacaaaacaaagcaactttcgccgtccgtcgtcgttctcctttgttccttttcttttcgttttttggatccgcccgccaatccgtccattttatttttgtattcgttgtctttcatttattgttgactatntttcgttnaactgctgaagtaccgtaggttggccatccat

SEQ ID NO: 26927 - DNA, 1169 bp, Heterodera glycines
atatctgctgctcaaacgttatgtgtcacaattatgataataacattatataggacactctatcctattttcctaatactaccccgatatgctggaaatggatagtgtgtctccttaatattgaattacataaatgtgtcttggcggcgcgaattcagtgttgaaaagtgaaaatttacgattttcgactttttgttcgaatccgggtccgggttcgaaattggtcgaaatgaatgtcatattcgtgatcagcggccccgaaaacccccggaaatgtattttcatgactttttaaaaaaattttcaaaaaggccaacttttacagtagcgccagaaaatctgtataaaatggcctttcgtttcttagggcaaactttttcacctgactgtagttgtcaaattatttattttcatgtctttttttggtcgtgtaaactgcaatagagccaaaagtttttcgggtttttacaaatagaccgaaagacgtcgaagttaggtatatttgaaagaaatttcccaaatttctatgtgtctatggattctgaaataattttttgcgatctttttaaatttgaaaagagcaccctccagcagaagggacagttgcgggcgaccgggaccttttcgggttgaaaacccgggaatttttggctgggaaaaccgggactagtcccggtcaaaaccgggaccttggtactcagttgtccgctaccaggtcccggtcccgtggcactctaataaaaacgtcttttccgaggtttttggggtcgctgatcactagggtcgcaacttttagtgacgaaaaatcccgaaatagttaactaaaatagtgagtaaaaatgccaaaatagtgacaaaatagtgtcaaaaagtccaaaatagtgacgaatagtgacataattttcagccaaaaaataagccaaaataatttttattcactgattgcagttgcaaatgagtaggacttggatttttaagaccaaaaaacccaaaatagttacctaaaaaaatttttaaaattaaaaatttttgccaagaaagtaaatttttgagaaattttttttcatttcataggagtatattttgaaaaattttagctcgatttttaggggtgtatttttttgaaatttttttaggtcgattcttaggggtgtattttttggttttat

SEQ ID NO: 26928 - DNA, 1063 bp, Heterodera glycines
aagcgatgtcgaagaatctgtcgtcgtcctccccccctccgccgttgtcaatcggacggaaaccgaacccttcaacaattaattgtctttttgccgcttcaactcccattgttcctttttcaccttcgtctttctcctttttgcctcgctttttgtctccgccccgcacgaactcttcgaaagagaccaattcttctcggctttccctgccgaatccgttctcatcgaccagttcggctattgggcgaccgatgttcgtcccgaagcattcgtccactgggaataatccttccgctttttgttggccactcatttcacacaaaaaaactaaaataaatattaaatgcgcaaaattccgaaaaaaagcgacggggggagggacacgaaaagtgactgcgtgctcaaatgagtgattctgagtttgacagccggcactttaagattaattgtatgtatcacgaagtgtgagaaaacttctcccgcccattccatttccgttgctatggctacaacttaacacaaatccattttctgcctaattcactgaattctttaattgtacaaaaaaaggctcgattaaatgcacgtgacgttggcttttttccttaatttattcatgccaaattcacttttgtatgtgaggcgctcaacggagagtattatgaaaagcacaacttttctgtttttgagagtatcccttttgaagtttgctcacaaagacatacaaattgctaattagaaaatccagtgtcaggagcagtagaatatagaaattacattgtgtggattttgggtgggcaaaaaatcagagatgggtcgaaaaagaaagggaaccctctttttggtttgcataacaatttttttgaagataatgataataattacatttttacaaggacgctgattatcatgaatatactttttagctatatgtaataccgatttcgcttttgaacaaatgactttttccagcaccaaaaaaaacaaaatgctatttttttaacaaaatggattggaaaataaaaatttagtgtcacactctttgctgaatgcttgaaaattc

SEQ ID NO: 26929 - DNA, 976 bp, Heterodera glycines
  misc_feature (847)..(847): n is a, c, g, or t
  misc_feature (898)..(898): n is a, c, g, or t
ttgcagaagcttcttattattttttttgatttttccaggacaaatccatcaaattttgcaaaaaatccttgtaaatgatgaaatgacgtacctcttgttgcaaagtgagtgccattgtgagtagttgaagaaattgaagaaggaagtaaaattaaaagtaagggcaaatattagctataaatacatattaaacacatgtaaaaaccagtgccctacggtggtctctctcttctcctcttccacttcctatttcccctttctcttcctcttttcccttttctcttcctcctctcctcaggtccctcttcccctttctcttcctcttttcccttttctcttcctcctctcctcaggtccctcttcccctttctctttcccttttctcttccactcctcttcctctgtcactcctgtccctctttgtcttccactttctcttcctcttctacaactgtctctcttcctctgttcccctttcataatttaataaaacgaaaaaattaacaattaaaaaaatacaaaacaaaaaataagtgtcgaaaattagctacaaatacatattatacaaatgtaaaaactcaaaaaattaattttttttttaaataaaaacaggaggtaaattgttttaatttaaaaaatgacggttggatgaaagcggaggaaggcggaataatgtacatacaaaactatgatcatttgtctgtccgctaaatgccaaacgtcgatcggtgcttctgtccgtgatgagtcacccccccccccctcccgtaacaatttgtcgcacctttttccaccaccactttttctctcccatccacacccttcttcttaaggatgggatgataanaatctcttctgccaccagcagcagcagagccgtttcttcatctcttctgtngtgtattttctgtgattttttattttccccattaagcacatcatttgaaaatataagaaaaaatgtctccatttttcc

SEQ ID NO: 26930 - DNA, 1079 bp, Heterodera glycines
  misc_feature (1041)..(1041): n is a, c, g, or t
aatttcgacattgttcagcgatgttctagctttatcgagtacacaagcatacctaagcattgccctttgtaatttatttggaattttctaaaagttttaaaatttatctaattccaaaaatagacgagagatattcaaatgtataattaattttttttttcgattttttttaaattttcgtcctatggcctaatttcagtcgaaaatttatttgaaaaacgccactctcggctgagaaaatgtgtgaatttttgttcttactaagtaaagagactgatggggttagacgcggctactctttttagagtttcttgggcccgaatcttgaaattctcaaaaaaactttggacttaggatagtcgacaaaaggattttgaatctttttagcccgagattgggctcgttcccgtattttccataggcttatgaccaacaaaaatccaagacccaaattttattttgatttttaatgcttcacagtttgggcccctgccgtttgtctgtggccttgggcgtttgcccaaattggtccctcccaaaaatctctcggaactatcgtcggttgtggccccagggcaccaccaaccaaccacgcaccactcactctcattagtcactcattaatagtatttaccaaaaacactgtcccaccaccgcacgccggtggccaccaattgacgtgtcccccgcccgaccaaatgaatttgttgtatacactgccaccacaaaacactctttttgctggtgatggtgacgaattgcgggggtcggacgaaggcgccaaaaaggcgggagaaatgtccgtccccatggcccctcaggggtaccatctgtcgttgaaccggtttttcgaggggttttgggcccccaaattccgcctcatttttggtggtgacttttggggcccactttcgctctccccccacacgctcagcaggcaaaaacccaatcaaatcatttcccattagcaaaattgtttctgtccgggccgggccaggccagggccaacagcaggggactgacgactgtctgtggtcctgngccaacggaaattcgcacccacccaaatttgttcccca

SEQ ID NO: 26931 - DNA, 826 bp, Heterodera glycines
ccgttttgctgcccttcttctgtcgcttcttctctttccttttccagaactcccgtttccgcccggttcacttcttcttcttccgctaatgtgttttttcgttggcgtttcctgaaaggaaaaacattaagccgaattaaaggagtgataaaaccattacggttttatcaaaagcatcatggctttttcagccgcttttctttttggacgatcagttgtgctgaaatgcaaaacagattttataattttcaatgaaaattttaccccccccccccctccattcttaccaggtaaaagttgtctcgttgctgctggtgtccgaataattcaccagattaattgagtgtgatgtatctgcaaaaatttttttcttttttttttctaataataaatttgaagtttcatactttcgacgtcgacgacaaatgtgtcctccgcattggccccgggcaaacagcgggccatcatcgttggtagcggtggtgcggacacttctccatttggcgaattggtgtcaatgcgcagacacccttgtgagaaaacaaaaaaattatagaccattgaaaatgtaaagaaaaaattaccatcaattgctgacaaatttttgtccgccatcaataaaaaattgtgaacgagctgggaagcttttgagctaaaaaagaaaaagaattatttaaaacaaaaattattatgctttttattgtgaacaatttatgtaaaaatgggaagcaataggaatgcgacgccgccccgtttcctatttgccactgtgaagaccccctcccccctgctatgccatcgattaactgacccctttaaaccaaaa

SEQ ID NO: 26932 - DNA, 1671 bp, Heterodera glycines
agtgccattcgccggtccctccccacgccatcccccccccctcttttcccccctttcggcccttttctcacttgaacacattcaatgcgctgaccaactccgatttgaccaaaataaagccccccgcgtaagccatcgcttggctcagctgttgcagtccgttcgttgtggcaaaaccaatggcctttgattatattttatttcgttaattggtttaattttgcaactcactcgtccatttttgcttttgtttaagtaattgcaggccaaatgttgaaggagcaattggcagcagaaaatggcagcggcgagaaggcccatcggacgattgttttgcagggaagaagcgattgagatcagaagggagctgagcccataaacgaattcgacgggaaggaggggcacccaaaattggcaaaaaattgggggggggaggaagccggggaaatggaagggcaaaccaacaatttcaagcagtccatgatcgacgacctttgatgcggagtcgtcgtgaaactttgagtcttttttgtgctcctccaacagttgcaagcccattttgccaaaaacagtgttctgtgtgtggaatttggttgaaaacgtacaaaaaacaaaggaaaacgacccaaagagtgacagcgccgaaaacgatcattcccacaatggcataagcagagcaaatccaaagcacatctcctagcagagattcatcttttttgcctataaaatcattgaaacgattcacaaagattaactgtaattaaatcagtaacccattttttgctcaaaaacactgaagaaaagcccggttaagcgtgtgaacactggataagcgaaggaatgggccagacaagcaaagaagccgacggcactttggcagggccattttttaagcagcgacaattggattccaatccagcaacgaacaatctgcggttgttaaacataagtggacatcattcggtgtggggcagggatgtgcctaggtttcgcttttcgcatttcgcctttcgcattatttgcattttttggcgtttcgcatttcgcatttcgctttttggcgcgaaaagcgacttttacacccctaagaattggattaaattcccataaaatttttcaaaattttacctataaattggctaattttcagtgaaaaccagtttataaatgatcaaaatttccaattttttccccggcggcgcctatcggcaccgccgcgccctcaaaactcctattttttcttaaaaaatggcccaaaatcgcaaaatttggtaatttgatgaaaaactgttctcagcggcgccccaaaactcttatttctcattagaaaaatgataaaaatcacaaaatttgatcattttttagtgaaaatctgtcaacaaattttaatcaaattttcaaaaattttcccggcgccgcctgccccctcttcccaaaaagtttttttggaaaaagcgcgcctcaaaaaagcgttttatcgatttttaaatttgcaataaaattttaaaaaattatttttgctttaggaatttaattattaaaaagttgtagaaaaaatttcgctttcgcatttcgcctttcgcattttcgcatattttagcttttcgcatttcgtttttttaaatttcgcatttagtttcgcaaatttcgcttttcgcatttcgcttttta

SEQ ID NO: 26933 - DNA, 1895 bp, Heterodera glycines
  misc_feature (9)..(9): n is a, c, g, or t
tacttttantgacaatttggcattaattcttttttccatttacgaaatgtcacattagaaatgcccaattccttcacaaattctttctgtttgcctttgtcgtataaacttttgaattcatcaattcgttcaatgaattcttttcttttcttctcataaaaaattttctttttatttaaatttaattcttttttccatttatatattttatggcgatttgcgcctaataatctagcaattttcctctcaatgttggttgtattttcccagtggtattttcctctttccttaagcttttctttaattgcatcaaatttttgaatgatttctcttttttgttgatcatttgggtcatttcccatttctccacccatttgatcaactgctgctgatctttcattatgttcatttgggtcattttgttccatttttataactttatcttctctttcatttttgttccatccttcgccaaatatttcgtcaaaatttgtttgaattttgccggagtcaattttaaaagcaatgaaaaatataacaaatattaaatgccataaaatcatttttgctattcgaaaatatttgtaaagaaaaataatttatttgagaatttttttgaatggattgctcaatatgaagaatttttaattaatgtgaatttttttattatttgttaattttattacatattagctaaaaatgaagtcaataaatgtccaattaattgtaaaaaagtaataataaaattttgcaaaaattatatcttttctcgtttttcattctttaaatctattgaaaacttataaatattaagaatgcaaaaagatatggacacaaaaaaaaataattaaattacacaaaaccattctgttatttgcttaaatttcaaaaaatttctaactgatataaggaattttttttttaaatttccaataatccattggactggaagcattttgacttacgaatgttgttataaccatgattatatgctgtgtaaacaaatggacaaaacgctacaattgcggcaataacttttgaaattatgtttagaatttgttatgctggtcaattaatatttttcgtgacattttaaagatcagaaataaatgtaaataaacagattaaaattcaaaagatttgacatctctttatcttgaaaattccgtcataaaaattttttcaacttcattaattctaaaaaaaataattgaccgaaacaaaaataaatgggaaagttaatgataagcaaaaagtaaagtgtgactggttcagcttattatggagaaaaacttatgtgttcataaaacgagatggatggacgacggccggggctttttctgacaaaaaacctcggtctgtgtgcaaaagcaactggtcttttagcgcatgaaaaaatgagcgaagagcccccgggggtgagagtaattgcgatcaaaaaaaactcctaaaattcgcgtataaattgcgacttcccatcgcatcgcataaataataaaatcatgtcttgtgaactgcccgtcaaccacgccgatgcccatctccctctggctgcagccacggcagaagaacggaagaagaatgccaagcggaaatgggaagagacggtcagagtgaaaacggaaactgtcgacgaaccgaagcagaatgagccggaagaaaatgccaagcggaaacgggaagagacggtcagagtgaagacggaaactgtagacgaaccgaagcagaatgagccggaagaaaatgccaagcggaaacgggaagagacggtcagagtgaagacggaaactgtagacgaaccgaagcagaatgagccggaagaaaatgccaagcggaaacgggaagagacggtcagagtgaagacggaaactgtagacgaaccgaagcagaatgag

SEQ ID NO: 26934 - DNA, 1108 bp, Heterodera glycines
aaaaagaggatttttctgaccgattgtggcgccgatggacagaaatggtcattcgagacacagaacaatcggaaaaaggtgccaagtcgacagagagagtgtgccaaacatttcgatttgccatttctctgctcaattgtttatggaaagaaatggacgaagaacggaggaaaatgttggcaaaatggctaaaggacggccgatggacagaatttgtgagaattgtgaacggttggttaatcacttcacttagactaaaaacatttagcttttgatcgggagcacattagacaaattggcagagggacaaaaccccaaattggccattgacgacgcacaattgttggagcagttcaaagtgccgttccatttgaaactcgtccacagcctaacgatttacagactgctgaaacgctcttttcaattctcttcgtttttttgtggccaaaattttcaaaaatttaacgaagtcaaaaataatctgttcactttgctcaattcgtccagtgaattcaattggttggaacggaaattcccttttgtgctgaaaattggtaattattaaaaagcaaagaaaaataaaatttatttttgaatttttagagaaaatgaaccacagaatgcgcatttatttgtaccgaaaattgataattaacagaagttggagtgccggatcgctggcgacccatgcccgaattattttgccattgttactggaagaacttgacacaaaaatatacaataaaaatatcgcaaaatgtcgaatttttgaggagttggaagaactattgttaatcatcaagttcgaggtgttcagagcaattgaaagttttagcagtgtttgttggcttatgtacttatggcaatacgttgaggggtacgacgggaggacaatggagtcgacgaaagagatgccgaccaggcaaatgatcgacgaatgtaccaaactcaatgccgcgatgccggtgtgtgggcgggcgtggggtagaagccgtgctcagttggaacagtcgggaacggcattctcgggactgactcagatgggaacacattgttctttctactcagattttcgtcaacatttggggttggcttcagcacaaacact

SEQ ID NO: 26935 - DNA, 1579 bp, Heterodera glycines
aaagaatcttcaagccataatcaaatccaaattcgccataatcaaatccaaattcgccataatcaaatccaaattcgccataatcaaatccaaattcgccataatcaaatgcgaatccgcaataatcatgtccaaagcagggctcacaaacttttttacaaaataagacaaaatggctgaaaaattaagattggacccaaaaataagatttttctaaaactaatagtagcgcgaaggaacgcaataaaacatgaaaagtcacattagctactttatgcgattttaggcataaaaatagcaaaataggcattaaataggcacaaaaattttcaaacaggaactaaaataggccaacattttttattaacgctttttagttagcaaagcatgtataacttgatcaaaaacttaattttggtaaaattttaattcaaataaaatatactggcacaatggggatggactttggataggatgaggggtatgacggcaaaaacacaaagggaatgatgagagagatggatggcatatgcaacagaggtgaatggatagaaatggcacgataacattggaaatgaggggataggattggcttgggatgggatgaacagatggataagtttatgacgggttcgggtcgggcggggaaagtagggcaatttacgttatgcataaaatatgaaattttgaatagtgcggatacagcagattcctttcgattatcatttcattgatgatgttgacgagtagagaaaaacttcgaatagcaatttcataatctttcgagggattaatgccaacgaatacaaatttcaagaacgaaaattcaatcctttggagtaattttctattaaaatttccgagaatttctaaatcttttaatttttatcgtacagtttatttttccttttcgtacaatttatttttcgctttatttttatttcgaaatgggttgggaacatagaattagggcgcgcttgccctttttcaagctgaaaaagtgccagaattggagtgccaaactcagctgggactcaagtgaccgccctataaaaagcactaaaaaatacattttaaataattcttctagggtaatttgtggcgatgatcatgaatatgacctttattttacaaaattccgaaccccgaaccctaatttgaacaaaaatttgaaatttataaattaaagaaaacatatttttaggggattttatcctaataattataaaacaccgatgacaccctgtttttcattggtcagatgcttacaattttttggtgaaaaattctaaaaagtgcataatgtatatttttctgctcattaaaaagtctagcttaatttgattaggtcactccttcatcgtgatcttgatcccccaaaatatattaaaaaccgggaaaattttgaaaaagtgctgttttgaattaaatattattattattaacaaaatttttatcgtttgctttatttgccaactagcagaaaggagagaggaagataaaacggagagaaagagaaatgaaacaagagaggagtgagggagacagaatggtgctaggtcgttactaaccatcatat

SEQ ID NO: 26936 - DNA, 1725 bp, Heterodera glycines
  misc_feature (14)..(14): n is a, c, g, or t
  misc_feature (106)..(106): n is a, c, g, or t
agcagtgtcatganaatgttaaaaaagcggttactgtattactctggtgtagcaaatctggccaaaaagacactaatacaaaatgccacagtgatccatcccattntaatggcacaccaaccaaaaatgggtgtgccaacgctgcggtagtagtagaaccgtgccggatgctccgtttgcgcaccattgcactggccacgctccatttgcgccgctcgtccgcgtccacccattctgtgggggtggtgccaacgagcgatttatcgattgattagccaatcgtttgattttattgattaattttgcacgataaatcaatgaactctcagtgctttatgatgagccatgaacgaaccagggaaggtgccatccttgagaaaaagcgggaccaactctgttaaccaaaaaagtgccaaatgatttcttagaaaaatatcaatccccgccgtgccacggcacaaaaaaactgaccgggtggccaaatgccatccattatcttaattggtttaattattaattaaagcaattaattgtttttggtgaacaaatcggcataccatgtgcgtctgtggcactcggtgcagccgaccctccttcacttgaatggcattctgaaaatcagttacaaaatttagggctcgatggcggcacgttgtgccaatctcgtccatcccttgactttgtgccattctcgtccttcctttctcaaatcttctatcattttcaagcttgtccacaactatttaccaacctctccaccctaagccgttgtgccatcccgcccaactctcacaattggcattatgccatcccccgccttggcattgagccattcatacccctggcgttgtgccattcaatttctttccacgagatatgccagtccccatcacctccccatttgggattgtgccatccccattggcattgtgccatgcccatcccctacaccatttggcattgtgccattcccatttggcattatgccatccctatcccaacgtggttccattgactttgtgcccaccgtgatcagttgctccaagtccaagtcgcacagcactgtcggctccaggccgatgttgtgcccgagcgcggcgagcagatcacgcactcgcaaatgcttggcaccaaaccaaattttgatgctggcaatgttccgaattttttggcccaaatagtataattttttcacatatgttgagccaatgtctgaaaaattttcggttgaaaacccgaaaaaaatttccctatttttttgccaagtgcaatggtggaaatggcaaggccaaagcaaatgtagccgatcaccagcggcagatagagagcacttaaattttaggaaattttttaaaatcattttttggccaaatgaattggccattaaaaatggacagggggtgatcagggaaattgatcattggtttctgatcaattttattcaaatattttaaatgataaaaaactttttaatttttaaactttaattattttcatcataaaatttgaaaaaattgttagaaaattttttttttaatttgttcaactcactccgtaggaattaatttgccgtattcaatggcagttaaacagaggaaggcgaagtaaatgccatttgggaagtccaccgaatcgtccagccaatcgatgagcattgcgcccaaaagctgcaaaaattgggggaacaagttgagggtgaccaatttggaccaattaagaagtgat

SEQ ID NO: 26937 - DNA, 896 bp, Heterodera glycines
  misc_feature (9)..(9): n is a, c, g, or t
aaaagcatnttcggatttaataaaacaaacgaaacttaattcgaaggtttcttacgcaattgccatttccaaacctttgtccatcacagtcatttcttatgggaccagcccactcactgagcaggaactgctccaaatcgtcaacgacaacttcgacctgcgcccaggcgtcatcatcgagtgcgccttttgcccttcgcttcccttttcctttcctctcaatttgcccattttcagggaactcggcttgaagcgcgccatttattcccgaaccgcggctaatggacactttggacacgccgatttcccatgggaaaaagcgaaaccgctcgaaattcgtcctgagctgatggaaaaactgatcgcctatagaaagtctgaacacattccgaatggctgcttcaaagggacgcacattcacgcgcaccactgaacaacgaattgttaaacgaaggaatggaccagtgacttatccgggggattgagcatttgtgtggggccttaaattcaaattatttaattgattttataaaacattttcgaaacttaaccctggataagtctctgaaaattggacgataatatactaccataaaggccccctccacttcggttttgtattaattcgatgcgtttgcacttttccaccgctttatgcattttgttttgtttttaccaaataattcacataatacaatgttttcccacaattcgccgtttgttattgttgtccgttttttcatagttttctgctgccttttgttgtcatttattattttttcatctttacaataaaaatgtcatttcattttcgttaattgctgctattgtaactaggtaatctcccggacgaatgatttactagtaatgacgagaatcttttccttaagcagtcc

SEQ ID NO: 26938 - DNA, 886 bp, Heterodera glycines
  misc_feature (841)..(841): n is a, c, g, or t
aaataatagaatgctaattttataccatatttcctcggcgcgttcttgggcaatttgttgacactttcatgccaacaatgccatccaattttttagagcttaatattattttttaatttaaattagcttattccgaatcatttcaatttggtcgaatcccaacccttgatatctttttatgggtagtttgattttgtcggaaagggatccatattatggttcaaaatcctcttattccttgctttctttacttgtacaattgtcgggcgcgtttccattttgtgtcaagctcatcatcaatttgaaatgatagaacccatttcccggactgattgtcatcataattaaaatgtgatgccgcaatttgttcattttcttcgaacaaaaatggaacgaccgtttcagacgaaggaaatttttccgtatttgtgtcttcttcagacattttcttcgttatagttttgtggtattattggcggatggcgtaagaaagctctcttcattagtttgagagagtcgcatatcacagttttataaaagctgagatttttggtattaaacaccgataaataacaatagaaaggtataattatgcggtgtactgctcggggtaattgtgccgtaggaatgggaagacagtttaggcccgaagcaagcagtacaatgcaatcattcagtagcaaaaaatggaaactggttaataatcaatttatagctaaatccggtttccgtgaattgctaaatttttccccattacaagacaattgatcattgcaaagaaaacaattttacatttttatgagcacgtcaaaatagccttagaattcactttccaacttanaaatcaatatcgatcacttctcgtaattcattgcttctgctgatc

SEQ ID NO: 26939 - DNA, 1745 bp, Heterodera glycines
cacttcctaaagaaccgataaagcgtaaaacggatatacaaaaaagaattgactcgagaacaaaaaaaaacaattaagaattcttggcctaaaatagaacgccaagaaacatttttaattccattcaaatataagcacaaaagacagtggtaattttctctggattgaaagtgtgattgatgtctgagtttacagcatgtaaaaaagggcagcagaaacgaaagatacaaagcgcacatttacgagtaccaaatcaaatcagtgagcggaaaaaagaatggtgtcatatttcgttcctatttcttccaaaagtcgagcaaagtcattgtcctcctcttcttagcagtttgctggctcggctgattccttctcgtcccagtcggtgtttcagcagcaatttttttggcactttggttgggcaattcgatggcaaagtccgtgcataaaatttgacgcattggctgtcgagttggaagggtgcccaaagtgatcagtcgttgtggggaaatgttgtcggtttttggctttgtcgtaatcatcgggatcaatcggttcagcagagaatgccttttaaggaatgagaaattagctgtttactaaatgtaaatgcagatgaaagtgccaacctagcaggagttttatgtgccgtacataatgtaaagcgatcggctaacagaagtggtctgatcagttctgtgtcggctagttcaaacgattcgtcgatgaggaaaaaatcgaacagatttgaggaagaaagaaaatcatttgaaggaactgacgccaaagggcaggccaccaaaaggggctgaaaagagaaaatatacaaaaagaaaaagattaaaaaatagttatacataaaaaattaattgttaaataaacaccttttgctgtgtgagctgtttgacctgacaataaaatgccttggctcctccgtcagtgtccactttggaggcgaactttgccattttggcttccaatagcaaatgctgaaggtctggccgaactgcctggcgtctgccgatgcgaagaagatgggcatcaaggacagacttaatggaacttagaaattggtttgcacagcagtgcgatagtgccgattttttttaaatttccgaaattgcctccgaaccccttatacgacaaatatgaaaaaaatccacaattttacagggtcagaattgagaagttggagcatttcatcaacggcggcattgctgttggaacagaacaacacggacttgttcagacggagtaatgttcgacaaagcacgagaaggaaagcagaaatttctttaaattaagaaaaggatgtaaaagaaatgccaaaaactcccaccttttctgtcacgtcccattgcaatggcatagtcaggtgtgttcagcactcgttcaacatgctcgctcaatggctcgccttccaaaaacggcatttccgatttatcagcaactttttgttcgccctcatccatcaataattcgtcatcaatttgttgtttctgttgtgccggtgtttccctgtcgatttctgttgttgtcagtgttgcggatgacgaagaacattcagcaagggaatgtgccgattttggcaccgaagagtggccaagggtcaaaaccgagcgtaacctttgcctaaataaaaaatgttttgatgagaatgaacatgattaattgaaaattgattaatcaaattacgcccgttcgtcgttttcaagcagtgcagcaacggagccaagacggtaggcaaa

SEQ ID NO: 26940 - DNA, 933 bp, Heterodera glycines
ccaaaaaaaagaagagattattataaatttctaaaaagtattctaattgatgggtcatcattttgcccaaattacttttttgccgtcaaatgccagcccataaatagaggggagattcagcgcaaaagatcaaatgttcattcattcattcatttacatgcgaagatgaattttatttccaattttcatattttttttatttaaaaattttaatttgtagccagtccaattaataccttattaattcgaaaaatgtcttcaaattttatcggttcgccaaattgctttttccgtccaacagctgatcagggtaagagaaataattaaaaaaagaattacgaaaaaaggaaaattattttatctgttttaaataaaataaaataaaaatttatcaccattagcagcagcagcagaagaagtggacaagtatgaagtgttcagttggcacggagatttgagcgaccaattggcagcacaatttttggtcagtgatcagcagctgttgaaggtgggacattttcagaacggacaaatgagcaaagtgggggggggggacaaatgagcacagatgggggggggggagggggagagaggccggacggatcagtcacggacaaagggccgaccaattccgagagcaatcaagagacattttgccaaaaatcagacaattaatgagtgaaggaaattggaaattatttagtggactgaaaaactttttttatttaaggaatgccgagaaaaacttgccagtgccgaattgagagaaacgaaattgctgtgcaaaaacggggaattgaatgcagagaatgtaagaaaaattaattattaaaaaaaatttaaaaaatgacgaaataactgaaagcgaacgcgcataaaaaagaaactttccaaattttgaagaaaattcaaaaggcgcttaaagcaaagttg

SEQ ID NO: 26941 - DNA, 1220 bp, Heterodera glycines
ttaaacaaaaatatgtaaagtaaagatcaaaaatgttattttcgttttcacatatttattaattatatttggtgttttgccaaaaagccaatttgtaagaatgttcttttttgtgagatttttccttttttggagtactgaccacatttttgtgttatttagcaaaatttcatgtaaaatgagcttttttgtgactttttgaaaaaaaacctgacgataatcattttttgtgcaaaatttttcaaaaattacaagattaaaaaattgaacaaaaactgcacaattttgcaggttagacaaaaccttaacaaattcaatttcactcttttgaattgcttcttattcttaaaatgccatttcaacattcaattcaattaacagtctcatctctcttggcatgttttatcactcattttcacattttcttccttttgtccttcttttcttttcccttctcatcagaggtgcgttcttaaaatgataaggtgcaaataatcgcaaaattaaaaggaaataatttgcagcaggtatatcatcattagcatcacgaaaaatgatagcacaaacttcattcgatttcggtatattatagcgccttaaatctgttccttctcttacatcaaataacattgtaatgtcaggaatttcacagtcagtattttttgaaatttctactgctttttcaaatacttctttcatcattttatatgactgggaatgaaagtttcgttaattggtctttgtaggcacttaatcgataattaatcgcttcatcagtatctataaaataaagctgtccattcgtcggtagttcttcttcatttggcctagcaacactattatatgaatgataaatgctaccttgtattttgaaaattggcacatttttatcaggaaatttaaatcgcatacatcccaaagacgcacatgaaaaagaggaatttaaatatcttaatttctttttgaaatcattgtgtaactctccaatttgtgtgtaattattttggtctatttcaggttgaaataaaacccgcaaatccattgggtattcttgtatcatttcttctaaattactgtttttaccatagttgcaacagtcataaaattcttgggttcctttgattttgttgttttcttcctgaaaatgaatagctgggcaatgaatgcatttaacatcaaattcaccaagatgataactgctcaaatcatttactcgaaat

SEQ ID NO: 26942 - DNA, 1163 bp, Heterodera glycines
  misc_feature (127)..(127): n is a, c, g, or t
tgtgcaaaatttcgaaaaagtatttctatttaaatttaaaaatcagaaagcaattcaagaattttttatttttaaatgcatttttaccacatgaattatgataaatttttgcgtttcgaattcattntggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaactctttgtgacccctctctgactctccaatgcagcagttgaccatttttaccactatttttctctcactcatcgtctgctcgtctctcctttattataagctattttcctaagccaacaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaaatgcacagttgtccatttttaccactatttttctatcactcatcgtctgctcgtctctccctttatataagctatttttccaaagcccacaacgcccctttctccctcctttccgttaggcatttcctcattggcggtgacgatccaacatttagggtacaaatttgtttaacctc

SEQ ID NO: 26943 - DNA, 1427 bp, Heterodera glycines
  misc_feature (111)..(111): n is a, c, g, or t
cagatcgactcgtacatgatggacctgaagcggagcggggacgcgctgggcgacgccaaacgccagctcgaaacactccaattcaaaatatgactcaatgaccaaccaacntgttggagaagcagcaggagttgtccctgctccgtgtgcagaaccactcgttgggcgaacagttggcgctgtcccaaagccgtgaacagcaggcgaggaaggaactggaaattttgcgcgccgcgcgctacaacaacgaacgccatggcactcacactgcaggaggtggagacggtgctgaagcgggtggaggcggagaaggcacacgcgtcggaaaggtggggctgatcaactattgtttcttaaaatttatatgcattttctattaaaaaacgccctcatcgacaggggcttgagttgagacacttcattcctaactgtctctaagtaacagtagttaatgcaaaagaatttgtgtaaaaaatgctttaattgccaaattaggcaatttttaataattcattagcctcacaacgctttatgtcggcttcatttaatagttttttaagtcaactccaatccgcaattctcgagcgtgacaatttgcgtcaattgctcgacaaccttcatgatcagaatgcacagttggtgaacggtcttaaggtgagccaagaaagacaacacgtttttgcccaatcattacaaatttccattttgaattttgcatttcttttccaggccaatctcagccaggcgagtggcgaccgtgacaaggcactcgccgaggtcaaatcgttgcagagcaacatcaacgcgttggacaatgtctaccaacggctaaaggctgaccatgagaaattgcgtgaggagatggaacagatccaatccactgataccaacgtggaggcgtgcaagaaggagattcaggtgggtaatggaacgcaaactttgcccttttatgtctatttttttctataaattcaaaattttctttaaactttatggaaaaatacttttagaaaagctttccgtgtcattaatacaattatttttgcacagaaattgcgcaacacggtcgcttaccaagagaaacaaattgcggaatgggaacaaaagtgtgaggagctcaaccaaaccattgagcgcaaggacaaacaaatggaggaaatttgtcgccttggagccgacatggaaagcagcattgaggtgaaactaaaaaaaccaattaccaaacggatttaccgttaaagaattataagacaatgcataaattggggggcaatcctgcagtttactggtcccgttttttttttttttgtaaaattctgggaaaacttttctagggctattttagggtactgagcacgaatccgaccttatttttgacaaattctgaaccccgaacccggaatcgaacatttttcaaacaaaaaatt

SEQ ID NO: 26944 - DNA, 1829 bp, Heterodera glycines
aaataaaaacaggtaatgggaaaaaaatgaaaaaatgtgccaaagtcaaagaaaagaataattaagaaaagttaaacaaacctcaaggaaaaacacttaaaaaatgcaaataaattaataattatacatgaatagagaaatggaaaaccaagagtacaaaatcatcccgatttgaaaattaaggaaaattaaaaacaacaagcaaaaaaagtctgtatggcgtatgcatttttttctttttgatcattcaatcgtgctttttttttttttgcgcaggccaagcagttctgtgttgagtgcgagcatccggttgaccggcgtacgcacccgctgggctgccgcgctgtgtgtggcctgtgcatgcgctacgacgagctgcgcttctcatgccggcgccagggcggcgacggcagcagtggcacgttctgccaacagtgccgcttcgtgttcccgaacgcggactgctttgaggcgcaccgccggcgcgtggatgttgcgccggcaccgcctccgggcgtcgccgccgccgctgctgtgcctcactgtggtgaggaagcaacgggtggagacggtgacgacgcggtttctttagctgctgctgttggcgccgctgtcgcgccagcgtttgcggaccgccgtcgcgggcggccccaccgttcaatgtgtgaggagcggcgcctgtgtgagtggtgcaatgtggttgtgtgggcgagaagcggtccgcacgtgtgtcgccgccgtccgcagcagcaacagcagcaggaggatcgcgcagttctgcagcagcaacaacagcagaaccaccacaatcagcagccggcaccgccaaagtgtgagaagtgcggcggtccacacgacccggaacgaacgccgcacttcatccagcccaagcaatacgcgcgccagtgccagtggcgacgcggtgcggcacgtggcgcccacgacaacgctgacgacggagcggttgctgatgctgctgatgctgcagccgctgttgatgacgatgacgatgatgatgtcagtgaagaggaaggggcggaagctggtgccgcgcgtggtggtgttggagatggcgctcgcggacaccttcggaagccaaagccggtgcgcttcatcttttgggatgttgaatgcgcacaggagcgcgtgggagagcagcaggagcagctggaggacggtaatgaattcgtttttaaacgatgatgattatgcggctttgcttacgcagacgaggcagaggcggcacacggcgctggcgacgaggcgggcgcaatggatgcagttcaacagcagcagcagcagttgcccgaactgttgaagcacgtgccggtgctggtgtgcgccgaggtgatctgcgagcgctgcatcgcctacggggtggacattgagcgtgagccgttgcgccgcgcgccccagtgccagtgcggtgtcccgtggcgtggtgcgaaccggcgccggtggtgctctcgcatcggcgaggagctgtttgacgacgacgacaccggcggaccagcgaccgcacaacaacaacaacaacaacaaatgccaccggatggattgaacccgcggcgactgcgcttcttctgcgacggcgagccgggcaccggacgtggcgcaatggcccaatttgtggactttttgctccacaccggccccaaagggacgcgcaccgtgatgttggcgcacaacggggtaagagcagcgagggggtgggatggcaaccgattggtagtgaaaaaataacattttttcagggtcgttacgacgttcacctgctgttggaggagttgcagcggcggggcgagcggccaaagaaggcggtccagcat

SEQ ID NO: 26945 - DNA, 1071 bp, Heterodera glycines
attttgtcaaataaatgagtcgagtgtccgttgtctccccccaatcgtcgcttttatcccaccgggcttcatgcgaatttccacttgctgcggttccaattggatcactgtcactccgtccgctcttctgctgcccaatggcaaattctttaaaaaagcaaaaatctggttgtttttttgttgataagattctttccatcccattattttcaaccgtttttaatgaccattaattaatcggtcagtgcaattccttctgcccttcgtcacactcacgtgttgcggcgccactttgatctctgtgcttggcgagtacagctgcgtgacagcgcaccgttcgttctccgcaaatgcccatttggcatcgcatctttgggtgccgttgaagcgctgacgagaagcgggcaaattaattaattaattgagccagatgaaaatattaggagggtgtcaatggtcaaatacaacggagtgggcggagacaccgaccaaatcggaacaccacgcgcattcgacgctggcggaaacgcacgcgccgcaacttttggacgcttccgccgaaagacacttttgccgggattcgtcctgtgcaagggcaaattctgaagcattttacaattatcatgaagaaaggagaagcaaatgacctgctgaaaggcaaagggaaaggagaaggaaaaaggcggcgactgagaaaattggggggcaaacggctgacaaagggaaagtgccatctctgccgaagtgccgcctcctctcccattgctttgtcggtgccgcaacgtcccgctccatttggggatcattagcagtggcagaggttggcattattggaagaccctccgaacaaaggtccatttgctgacaaattatcaataggccaaatgattgaaaattgagttttgagggagtgcattaaaatagaaagttcaatgggggagaaagtgttgaaacggacggaaaatgcagtcaattagggcaaaatgtgcaagaaaatggaaaaggacggccgaagggggggggggggggagacgaagggaatgtgtcggaacgatgtgaaagaatcaacgt

SEQ ID NO: 26946 - DNA, 959 bp, Heterodera glycines
  misc_feature (853)..(853): n is a, c, g, or t
atattctttcagaatataatattacaaaatttttatcttaagtataaaaagagttatctcaaaaagtcttatgtcagaattttttgtacagaacttttttgaaattcaattaaattttctgaaattttaaaggtaaatagagaattcttagagctatcgaatatataaattaatttggctcaattgcattttatagatttaaagcggcttttcctttttttatagagtgaaaagaaagggaaagcaattgagcagtgatggcgcagtggttatacttgtggctttactttttccccaaaaagttcgaatcccacgattttaatttaatttttttttgtttccaattaaatattttttatcagatcattatcaaaatacattgttttgatcaaattatttttttaaatttttgctaaagaaattaattcattttttgtacgaaaaatgtatgcaaacaaaaatgacctagttcgctcatcagcatggggaaagtgctttcgggtggaccttttagatcataattcagaacaaatacctcaagaatttccccccccccctccccaaaaaatgccaattcgaagatgggctttaaaaataaacaattcagcagaaaataaaattccaaatttcaaagccggcaaacgctggttaaaaaacttcaaatcatccaggaggattgtttctcgaaaggtttttgaaataatttaacaatttaaattgggccaattaagatcacaaaattttgaattgtgctgaatccgtcatggcaagatgtgcttggtgtgataactttctctgttttattaatttttaccaggattatcatatatgccaaactctttagcaaaaattnttacttattaatcctgtagatacgagtcaaaaagtgcgacatttggtcattttttggacaaaatcagttaagaaattgacaaattttcaaaaaaaaaaaaattccg

SEQ ID NO: 26947 - DNA, 1503 bp, Heterodera glycines
ctaataagggaacatcgcgaactgtgagtgtccaaatcgctttaaaaacacttttatcgtgtagagcatagttgatttgctattgtgaattttcggcttttttggctctggcgccaaaatgatcagaaaaaatcgatgaaatgaaaaaaccaacaaaaatttgttaatttgattaattttttcctcttcaccgcttgccttgggttcggatgcgctcgacagatgatgaatttttttgaatttttttcaaactattattccactagccattttattcagttattttagctaaaaatatgtacaaagagtggtcaaaatatgtacataaataaaatgacctaaataggattagaatcacataaaaaggatttcacattctcctgaaacaaaaatagaaattttaatttaattagttagaacaattaaaaatttataaagaattaaaatctaaattaagcagaaaagcaaaataatatatacaattagtattaaaaatccaaattaatcctggcattaacgatcataatttataaagcaaaattaaataaaaaattttgatcaaagcaattacaaattaattctaacaattgaatattaaataatttagtgattaaatataaaaatgtgccacgccaccaatcatttatatgaaaattatataaataaattgaaaagatttacttgaacgaaattcgcacaacaaaattttactgaaataaaaagtttaaattgaattttctcataaaaattcaaaaaaatcaatttatttttcaattgacaatttttaaaagtaaaataattatacaaagaaagtaaaaaaattcgaaacgaaataattaagaccaaggctctcaagttttaaacagagttggaagatgaattctaaaggaaatgaactggcttacgttactcaaaaaaccatcaaaataaaaaattttttgaaataaatttgctcaaaagagtcgtacaaaacagaagaggattgttgtcaggagcttttaataatgttgttgcactgcacacagcaaaagacaacagcccaaagcaaacacaaaacaatacagcccaatgccgaagataattatttatttcaaataaattaaggcgaagacaatcaataaaaactgacgacagcataaactaacaactaacacttcacaaaaatcacaaacaaaaatgaaacaaattaaataacaaaacgccaaatatattttaaaatcacaatattagcacatcctcgccctctaagaagcgatgtcctcagcgctttgggctcatcggtagtgcattcggcgttgaaaggggcggcaagggtgtcagcagtggatcggttcggcatgtaatcgcgttgcaaggtcagacctgtaaaaacaacggacaaaacgggtctccgacttttcatctggacttataaattcatcagcggtagcttcttgcgcacacctgcgatgtccatttggaaaattcaggcttttacccattatcaacaaattttcatgattg

SEQ ID NO: 26948 - DNA, 963 bp, Heterodera glycines
aaagaatgtgtttttcgtgcatttctcgatcgagttaaagccgcagaaaaaaaaactaagaatcccatccctattgattacaaatgtctaaattaatattttttagatttttaaattgatcacttagttatataaaagtgataaaaaattatttttatttatttagatattctccttttttcaattgaaagatgatgatgcttcgtgttttttaaaatattttaaggtattattcaagaatgttgttttttcttatttttcattttattttaaattgtcattttgctttattaattaaagaattttatggtccaatataagaattaaagaatcatttattttaaattatagactctcatcttaatgatattaatatattttctgttacattcaattattctttttcttttaatgaaaatttattaaatgtgttgcaatcaaaaattaagaaatataattatttatttatgtttatttaaattatttattttttatttattgtcaatttatttaactaaatctacatttatattatcttataaaaaatcaaaaataaatttatatcaaatactataaatttaatggttggttcacagtatacaaaaatgagaaattaagtatttttatccaatagtaaaaaaaagtttaaaattaaataaataattacgcataaggaaaaaggaaacaatattttttataagagatacaaaactcgaaatagtattttataaagaattaaaagaaatgatttaattgacaaaaattatttagaaaaaatcatttcattcgacaaaataataagcaaagcaatcaatttatacataatttcccaatttacacaaaaatagaaagttttgaattaattggttaaaattaaatgtcctctccccccccccccccccggcgtccctttcctccccaaacaccacagccacaccaattcattctcttctaactttccaa

SEQ ID NO: 26949 - DNA, 986 bp, Heterodera glycines
aaataataaaaattaaacgaaaatccaatcgccaataaatagttaatttttgagaaataattaaaaaaacaagaaaatagggaatacattaggcatcaaccagacttcatttttgcaatttcgtttggttctaccaaagataatcgctaaaaattttaaagaaaattgttttttggatttttattttctaaaatgttgaataaaaatgagtggtaaagtatatggtgtttaaacttttaagtttattttaaaatgtttttcaatttccccaattaaaacccacataaaatgggatttctttgatccgtagccatgtctccaattggatcgccgccggggataaacttggggccgaatcggtgtgcggaaattgcaccaaatacacaacattgggcttccaattttgtaccaaaacttctgaaaattaaaaattcaaattgaaaagatgagcaaattttgccataaaatttaatttggccattgggaaaaataaaaaaaaaaattgtttaaatttgtgccacctttgtcaatgtactgctcgtccaactggtcaattgtgagtggacgctgcttgaacagtttttcaacgccatttttcattccaatcataagagtcactaccattttaccgaatctgttgtgatggacgaaatgaagtaattactgtacttatcagtgatcagggattaaaactaactctgattttaattaattcaattcatttcattaaattgatcttttccttattgatgtcgcaaattaatcttaaactacaactaatatgatattcaaacccttatataaccaacctatcaaataatagtcctaaagttatattgcgtcatttctttctaattattattttttaatgagtaaccctttttgatcaaaatgatccctaatctggcggaagactaattagcccacataaattttacaaaagaactgattcaatcacaatgtaatatcttatttgatattaatga

SEQ ID NO: 26950 - DNA, 1337 bp, Heterodera glycines
  misc_feature (216)..(216): n is a, c, g, or t
taagaaaatgttccattttcctaaagtacttggtaaacctcgaccgacttgcataaataattcaatacaattattcgtttactgaaatatcttataccacttccgccgcaagacatttagccgaaaactcggcacttctttgctctcggtggaagtgatatgactaaagattaaatggccaattataaagaaagataaaccaactatttgtgtgtntagctctctgttaattatgacacgttgtctttaccttagtttgggttaattgccatgagtcatgccattttgaggccagcattcttttatgaacctccgacaccttttaaaaataatatgcattcactaataatgcattcttcaattcaaatattagtatatttgatgcgttctgccaaagcaatttaagaaaatgttccatttcctaaagtaactggtaaacctcgacagacttgcataaataatttcattacaattattcgtttacttgaatatcttataccactttccgcgcaagacattttaccgaaaactcggcacttctttgctctcggttggagtgatattgactaagattaaatggccaattataaagaaagataaaccaactatttgtgtgtttagctctctgttaattatgacacgttgtctttaacttagtttgggttaattgccatgagtcatgccattttgaggccagcattcttttatgaacctccgacaccttttaaaaataatatgcattcactaataattcattcttcaattcaaatattagtatatttgatgcgttctgccaaagcaatttaagaaaatgttccatttcctaaagtaactggtaaacctcgaccgacttgcataaataatttcattacaattattcgtttacttgaatatcttataccactttccgcgcaagacattttgccgaaaactcggcacttctttgctctcggttggagtgatattgactaagattaaatggccaattataaagaaagataaaccaactatttgtgtgtttagctctctgttaattatgacacgttgtctttaacttagtttgggttaattgccatgagtcatgccattttgaggccagcattcttttatgaacctccgacaccttttaaaaataatatgcattcactaataatgcattcttcaattcaaatattagtatattttgatgcgttctgccaaagcaatttaagaaaatgttccatttcctaaagtaactggtaaacctcgacagacttgcataaataatttcattaccattattcgtttacttgaatatcttatacaactttccgcgcaagaacattttaccgaaaact

SEQ ID NO: 26951 - DNA, 424 bp, Heterodera glycines
gaaaaatcatccattttttaaattaagatctttaattttaaattaaaaaatattgtcatttgttaatttaaatattgtcatttgttaatttttcttaaaaaatccgtaaaaatgccaaaaatttccacaggtctccaaaattccaattaaattttcaaagtttaacgtaaagttggccattttgtgacttttatttttttcaaaaaagaattatcaaaaattttttttaattcctaaaatattgtgaaaaaattagattagaaattgttgtctacgtatttttccttcggtgcatatctgcagcgccggactctaaaatccttattttcctgaaaattttgctcaaaatcgctaaaaaattttggtttttttggacaaaatctgttaacaaatcgcatccaaaattacaaaaaatttttcccgg

SEQ ID NO: 26952 - DNA, 1663 bp, Heterodera glycines
  misc_feature (19)..(19): n is a, c, g, or t
  misc_feature (78)..(78): n is a, c, g, or t
  misc_feature (96)..(96): n is a, c, g, or t
taatttctaataaataatntattatcaaaagccttttctttagaaaattagtgatttattttcatgttttgtatattntaagttaataattttctntaaacctaataatagtctgttaataattaataaattattataagtttgttatgtttaaatttattcatcatctaaatttactgattttaaaataataattcatacggtctttatcttaagtaattcatgagatgctttgggcttaatttttgtttttttccttgaaaattttacggtttgttccagcattaaaattttaaaaaatgggaaatttttattttgacttagaattgaaatgaaaattttcaattacaaatattacattactaagttttccatgatgaaaataataaaaaaatattaatcaacctgtgtaacaaactgcaaagtttttttttgtcttgtaattcaaattgtttagttaatttatttttaaatttaattaatattttgactattagctttatcaattattttatttataaaatcaaacaattttaaccctttttaatattttttataaatgccaagtttgtacaattgttgttataatctttttatgaggccaatctatttaatcccagtctactaataacattttcctctttaccttttgctttaggatttttcgcttcgtgaatcattttattttgtttcctttttctaattttcgcgattcacttttagcttaattaaattaagtttttactttttgaacgcattttttaattcgagtaaaaggcttacttaattgtaattattattatttgcttgaattttactgacttcactactaaaaagttattgctcttttttaaattcttcaataattcatagcttataaattaaccattaatgctcatgtaaactcagactgaaaacaaatagtgatgattctggtatttttaaattgaaaagtttagtatcaaaaaatttttgaataaatgttttttaaatttaattaacataaatataattcaattttaattaataaatttactattttaagtttggttttttcacttactccaattttgcaataacattgatgctttttctgtgtataaatcatttataaacaatttttcaatcagtaaatttacaaaaaatgaaatctttttaaattaaaaaaaacaataaattaataatttttatgactgtactttttttttcaatttgcgatattttttaacttttttaaatttattttctctatattaattttttaaaaaaaaaagttatataccaaagaacaacaagacactttcaagtagtgaaacttcgtttaaatttttattttacaaaaatataatattattaagtttaatataaatcattctttaaaggttttttccaaaaagtatttgatcatttattaacttttattcattaattgacaatagttattacaaaataagatttaagatttttttaaatatcttggaaaagcaagctttttaaaaatatccttttcttttagtcagcgttattcaattataaatatttattattaaatatttttcatcttttatgcttatttttttataaataaacattcttttggaaactcaaagtttttctctaaaatatcacaatttataatgtcgctatttttttattcttttaa

SEQ ID NO: 26953 - DNA, 214 bp, Heterodera glycines
aaaaatgccaataaacaagaagagatgatgaaaatgccaagaatgttgtgccataagaaaatgccaataaacaagaagagatgatgaaaatgccaagaatgttgtgccataaagagatgccaatagaagggtgcgaggccgcgaagcggccgagccatagtcaattttatcattcataattctacattacaaccgtactgcctagcggttgcga

SEQ ID NO: 26954 - DNA, 652 bp, Heterodera glycines
aaaagcttaaaaaatttaaatatagtgccgtccctaataataaaaaatattaagcttattaattaaactcttatatgtacacggaaatatcaaccgactaatgagaaacaatggcgatttggatgggctaccaaaggttcattaggagagaacaaaaaaaaacgattgtgtgatcgacttaagattttgtaatagcattcacaatcgcatcggttcgattattacttcagaatgatatcgattcattttgggagtaaaaatctgccaaaagtattcctctctattttgtctacacattacaatatttatttgatatgcagccacaaaaaaatcaaatgcactcatccgtcagacccaatattaacagtggttttgtattttttttgttggtcattccttccgcttcccctccccctccccgctctctccctcctcgtttcccccttttcaatcatatccaaattaagtttttttatggagtgaattgattgcccacttttttcctttacattgacccttttaacacttttatacaccttattcttcattcttcctctttctgctgctgcttcgtccatttgttgatgataaccaccgcttccaacagcaaaggtcgtccctcgcccccactcccccctctctctctctccct

SEQ ID NO: 26955 - DNA, 1339 bp, Heterodera glycines
acgcgtaaaatgtcattggacgcgtaaaatggtatgggacgcgtaaaatgtcatgggacgggtaaagtgttgttgggacgcgtaaaatgtcatgggacgcgtaaagtgtcatgggacgcgtaaaatgttatgggacgcgtaaaatgtcatgggacgcgtaaaatgttatgggacgcgtaaaatgttatgggacgcgtaaagtgtcatgggacgcgtaaagtgtcatgggacgcgtaaaaccgactagaaccaattttaattattttttccgtttgacgcacatccgaccaaactgacaaattattgtagaagatactagccgcaagaaataaaaaagttaagaaatttgtccgaattcgggttcgggattcgaaacatggatgttttgcacaaatccgaccaatttcagtcctaaacaggtactcacgcgaaaatggccacgcgaaaacgaccccgaccggtttttggggtctattccttcaaaataaaaacctagaaaataggccctaataactcgaaaagtagcttaacaacagccaaaaaaaatatgtttttcgtgcgtttcaggccacgctgagctcaggaaaaaatatgtaaaaacctaaaaacatagccctatttataacacatgaacaaaaagatacaacaaacttcatcaatccctcccttttcatgactataaaaggtaaaagtgaaggatactgacgggatggaaaatgtatataaattatataccaatcgactccgctcggtctctaatgaaagaatccgaaagaattttttggcggtaaccaatcgctgaagagttacagacccgggactgaaatgacaaaatggctttgggactgaaccgtccaaacccttaaacgcatggaattgcgacaaaatgcatataaatcgattccgcacggtctgctaataaagaattcgaaagaatttttggataaaaaagaaattgacaaaagttacgggtccttaaaaatctcaaaaaatgacttaattcaaaaattaatttaggtgagccaaaaaaacgtaaaaggtttttgaacttcgcaaaattaaaatagtcctaaaattttgaatatatttttatgttttttatttataataagtagggatgcgatttttaggcaaatgcctaaaatttttgcgcacttaatacgcacagataagcacgaaaaaagccctttccgcttggtttggggtgtctacgatgacttttataatgcctaactttggctatttcggggtttttgtgcctaaagtgcctattttagggtttttgaaaaaatccttaacaaaaatgcaataaaaacaaaaaatacacccctaagaaatg

SEQ ID NO: 26956 - DNA, 1711 bp, Heterodera glycines
tataaaatacgatacaatgtgtacatatgtctgtgggggcatacaacaggacaattatacaatacaatattacaacaatacacgtgtttgggatatacattggattttcatgtcactaaacggcacaatttcgacatcgatatcactaagagccctccgatgaagacgatgatgcgtcggaagttttgtcctcagaagtagcgtccgccgaagtcgaacctcccgagccagatccagagcccgatgctgaggacgatgcagagccggagccgctttcggaagtctcagtggtcgcagtttcgtcggtcgtctccgtcgtttcctcggtcgtctcttccgtggtcgccgacttctcctctcctccgccggtctccgcggctccctctttctgcttctcctctgctgccgacccgccttcctctttcttctcctcctcagctttgtcgccactgtaaaagaaaagcaacattggttgaaaacaacaattccgccctttttgctcacccatcgtcctcctttggctgttcatctaccacttgttcagcaggcactgtcacgccttcaccagcaggtggagtctcctttctgaaaatggggcaaaaaccgttaatcctcttacaattgtagacaaatcaaatcggacttgtcgtcttctcccttctcgacatcgccatcagctgttcctttggcttcttcgtctccttcttcgtcgcttgccgcactctttggcttcatgaacaggaggtagatgaacgcgccgatgacgatgaccagcggaaccaacaaaatgaaggtgagcatattatatgcagcagttgcactttcgccgttcttctccgctgccagcgacacatcaagcgtacagagcagcagcaccagcgctgacgacacaaggcgaagcggaagaggtcggcgacggaaaggcgttgtgttgacgcttttcatcgttggtggtgtgaagaatttgttgcttgtcgaaggccgattctgcaaaaaaaaaaaaggaaaatgtgaaatgggaaaaaaataaaatctgaaaaaagaaaacttacaaaatattacagcggatgatacgctttgagaaaagggcacttgggagtagcgaatgtgaaagggaaaggaaaaagcatctgcttttatatccaatgactgacacagagaatttttcttccatcacggatttgaccgattgtatgggaggggggtataaaagggtggcaaatatcacattcaatcaatttctttaaacattaattttatttttccattatgtttttgctcggctccacagacgcgcagcggcgacggcaccgacaattctatcacgttgtcaaatcgcttaaattgtgttatttgccagcttcaaaacatgaagtcttagaatgacaccaaattaaaaatagcagaaaagattatctgaaaaactattaaaaacaaaatcagttaagcggaatttcaatccctgctgtgaattgatcaaataacatatagtgtttttaggctaaacacaaagcaaataagcaaattttaatactaatttttggcagaagcgtcaagccaagttaaaaacatgtttttcgtgcgtttcaggcctcctacagtccagaaaaaatatggatttctatattttttcgaacctttgaaaaatctcaggttatttaagcacaaggaaatttatacaaaattaaaataaagaaataaatgaggacaa

SEQ ID NO: 26957 - DNA, 1421 bp, Heterodera glycines
  misc_feature (8)..(8): n is a, c, g, or t
aaaaaccntgttaaaaactagcccccttcaccgaaaatttgttaaaatctggttttttgatcccgactgcactgaaatatacgatttgctaattccctccccaaaattgttaagagagataatgacaagcgaaaatttatataaaaacgatgaagaatttatcaatcacttacatgaactccaatatcgaaatttggcatgatggaattagtaattataatatataatttagaaaattgtattggttaagcatattatttttaatgagcggcgaaaaggtcgattttgttatgcggcgcaaatggcacggcacacgagtaatccgattaccttgggaatttggaattgagtaaaattaagtgttggtcaggtcagattcatagtgaactgcccgaattctctaagattactggtcaaatgtctcactgcttaaattatttaaaagtttttcaagaaccttccaagaaaatagagactatttttcgatttccaaggacagcattgggctgggcctctgctgaattatgcaaacaaattatttgttatttacctcaacagattttccaatttggcaattttcatctggtgcttgcccatcaacggattggttgcactggcaacattttggccattttgttggagaaatattatatttaaggaccaaaatattgcaaaataatgcatcatttttattttaattttttaaatatatatttttgaatgaattgtgaatacccctaggcaaaaatgcaataacataatttattttcgcgattttacacgtaaaaatcaatacgtatcctatgcaggtttttccaaagcaatgaaaatatccaattggtttttcaattgggtgaattgttgagagaaaatatttttttaaattggcagaaaaagaaaatttatttgaaaataaataataatttaatcatttcttttaaaatagtaaacaacaagaaacattagccttgtagctgaagctccaatcgttttttgatttttgacttggttcgactgacccccacacagaataaaattattttcattatttttttaaatattcattaaagtaagtaaaagtaaaactgttttaaatttaattacaaaattcccaactcaacaaaaactaagaaacttattttttaaattgtatcctcaaactgagaagggagatcctagtagctggaaaagcggatgtggctttaggatgttaatttttctaagtgttttaaaataaaagagtccggcagtggcgataggcaccgccggaattgcatttttttgactttgaattttttaaaggattggcgtccggtggtgcccatagggcgaggtgaggccaggaaaattgaaaaaataaagctaatactccaattggggcttagaaagttcatcgacgaaaaatgagatggacgttttta

SEQ ID NO: 26958 - DNA, 1878 bp, Heterodera glycines
gagaaacgaaaattagagcgattgttggtcgtcgatatggcaattggcaatgcagagcaaagaattgtcgtaaagggacgggacatttttcgaaggtgtcctcattatgttgaccaacggccatagggtgtactaaaaggttctaaattgtcgaccaaacaaatttttgaattgacgtatctttgggcacgtaaatatggcacaatagatgatcttcagcaagaaaccggacacagtcggccaaccataatcgattggtttaacttttgtagagacgtttgtgctgaattttttatacgccagcccattgccattggaggcccaggtttttgtcgtcgtattttttctgtcgtaccttgtcttgaagtcgcttcgtcgagattgacgaaacgctggctgtcaaacggaagtatggcgttgggcgaattttagtgaagggcgaagtttggttatttggtggcgtggaacgcgactccaattgggaacgcgtcttcttggttcctgtggaatcgcggaccgcaaatcgtctgatcccacttatccagcaatacatccttccggggaccactattgtttcggatgaatggcgttcgtaccgtggaattccgaatttgccataaaattacactcattggaccgtaaatcattctcagaactttgtcaatcctgccaatcgtcaagcacacacacaaaatgtcgagtcattgtggaagaaattgaaaaagaatttcaaacagcattttggaaatactcgggaaacggctagacttggactcagcccacccgaaaaaatgacatgaatttgttataaaactgcttaatatgaatattattcacaaaaatgtatgaaaaagtgacgatatatagtgaaaatttttttttatcaacatttgaaatttttcaaaaaaacgtcatttttgagtgtaatatctcttaacagccgacaataattggtcaaacgcatcaaaaccattctttttgacctctctgcgccattgatactctaccaacgtgtcagcaaaccggaaacctgggacgcgccgttcgcggaaccaatcctttgcaggacgccactgagcctcaatacgttgtgtgtgcgtcccatcctcggctaaactttaaaatttatcaaattttacttgactttaaaaaaccaatgaaacggtgttcggggtccgagtggttgacaattttgtggagaaacccatcccttaaaaaaaattgacttcgcaaaagggagcatgcgaagacggagcaagtagtggggcgagaatcacggtctcatttcataatttcgagaaattccgatcaaaaaagcaataataaagtgatgattaaaaggctgatgaattgggaaaatgttggtgtctacgttgttaagtggtaaataattttgaaccatcgtgagaattcggcggtctgcttcgcgatatttctttgccttttgcggtggttcttgtccagttgaacacttcgcgaagtcatcatcggataacttttgatcctttcgcaaaaggtcaatgaaatgccaaatcgatggatgtgaacaggcaaatgcgcattgcaggcgtctgttcgcggcttctgaatggttattcgtccggtcatcgccttgcagtgttcgagtgtaaacactccaaatgtttgcgtcaaatcgcgggcgtattaggcttacatcatgcttaagacgacccgtgtagttcatgatgaacctaataaataattaaagaacaataaatagtaaacaatttctgagattgtcaatttaccagtcaaggacgggaggaagttcgtctggaagagccatgattgctcgctctgttcgtccgtacgcgaatacattttgtttgcgtctgggatgattaagtctgtgagcgt

SEQ ID NO: 26959 - DNA, 298 bp, Heterodera glycines
tataataacgctgcggacatctacatttttgaattgaaaaaaaattggtatttactctttctttttctctatattgaccatcatactcatactccccccaccctttctcctccttcgttttttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatatatgacgccggactcgacaggatcccc

SEQ ID NO: 26960 - DNA, 1243 bp, Heterodera glycines
  misc_feature (86)..(86): n is a, c, g, or t
ccgtgacggcccaactgagcggttccgctttttttggggttgaccaatttcctggaaatgcgggggggcggagggggggggggggnggtggcgagagaaccaaaaacaatgatcaattggaatgggttttggtctctttttatggcgacgaatgaatgaaattttattgagttttaaaaaagatagggtcaaaatcattgagtctaaattttcatttagcaaataaaaataaaataataagttaattaaatattacaatcattgatacatttgtcacttcggctcaccacggggagaattcgttgcctttccgataattgaaatcgaaaatggagaaatgaaagggcgagttatagattatagtaaatgctttcgtcaattgtcaaattttcattaacaacaacacaaaacgacattaatcaaatggaaagaggggcaatgcgaagacggagcaaatggtgggacggacgcacgccgagcgagcacggatggttgagagcgcatagttaaggtcggcacgagcaggcgggatcgccattctccgttcccggtcaaatttggagaaaaaaacggaataacatgattcagttaaaaaatccaagtccaggccattttcggcaacctggatttttgccgccccctaaaaattcttattcttttaaaaaaattggctcaaaatcgtaaaattttgtcattttttgaacaaaatcgttaagaaatcgcattaaaaattacaaaaaattccccggcggcgcctatcggcaccgccggactctcttccctcacccatcccaaaaaaatttcggaaaaatgcgccgaaaaaaattgttaaaaatctgtttttttgattctgaatgtactgaaatttacaaattgcttatgttttccacaaaattgttaaaatcgattttggaaatatataaatttctcatttcaaagccggaattgctcagaaaaaattggcgttgataaatatgttgctaatgcttgattttgttgaataaaaaatgcaatttaggttttggaagcgcgttttaaaaaatatccttattttttaccctaaatcttatttttgaccagcgatgtacttattttgcgaaattttcaaggataaccctgaaacaccaagacattttcattatttgagagccaaaaaccgaaactctgaaagtacacccctaactgatccgataaaaatttataattaaaaatttaaataacatttttgcaaaaattaaaaatt

SEQ ID NO: 26961 - DNA, 2101 bp, Heterodera glycines
ttccactttttaatgagtcttttttggcatttagtgcctaattgaaatagcacaaaatgcacagaattgatgggcaaagagggaggagcaaattaattaattttttgaaaatgtatattttgagtaaattaatttctatttgagggcgaaacgtgcatcacgcagctgagatctgtctgccggtcgattaccattaccgcgctgtcccatcccgtgaaagtcaattttgtggatcaattgtacgcggataagttgtaataaaatgtaaacatttaattttataatttcataatttcttttggcattgtcggaattgccaattcaatcgaaagatttggcggaccgttcccgagtttggatgtgtttggtctcgaccgtgacgatccaaattatgtaagtttaacacctgtcgtgcagctgtgcagctatctaaactgatttaaaaattttcggcaagtatgccgcaatttttgtgtgccataattcacctcccccaaccatcatccattttgcagggtttttgtattaacgaatttcgttgttaatggtacatattttaggcgaaccgcgtgatgaaagaagccgccgcaattgtcgatgattgctgcgactctcagctgtcaactgcggctgatattcatgtgctttctgagtgtgagttcatttttttgtaaaatattaattgttttggtattaaaaaataagcatgttttcaaaaataaattaccgtacttactgaaatatgacccccgcgggggcagaggtgttcgaaaatttatggacgactctatttcattgaatacagaataataatactttttataaatgcaaaaattgaatattctatatttttatgtaataaaactctccctcaaagatgtgatcgggctcaaaatgcagttgagtggtttgagcaatggaagcacttaattgggctcaatgttgttgaccagaagtggaaggatgatgagtggaaggatgatggtgttgagaaaatgttcgaagtttttgaatttatttaaattgccaatttaaaggggctgccaaattctttgataaggaaaaacagtgattaaaaaaattttagattaattaatgcaaattcaattatgtttaaactcaaaattaaagaataaatctgaaaaacatagaatatttcgcagccgctcgcttaccctaaattttccattttatttttcaatatttttttatatcgccataacccaaacatatatttttgtcattttgtcattgtagcaatttagaataacaataacattttatgttaaattaaagtaaatgttgtcagtcaaatttaactcattgattatagtgaaaaaaatttaaaaaattcttaaattaaacattcacaaaaactttataaaaatattggtaatttaaattttggaacttaaaagaatgcaataagattctttttttttttaaattgatccatttttccatttgagaagcaaaagtgaaaagcatttgagttcaaaagattcgcgcttcaccgaatatttatggccattaaaaaaaataggacaaatcttggcagcacttatttgttaggaagagtagacagaactcaattgcccaactaaaacatttatcggaataattttaatttatttatttcattaaaaaatgtgaaaatttttaaaattattttacataaaaatatttaattttttgagcagcgataaacagatgcaatggcgaaaatgataagggtggggatccgtttttgatcgaaaggaaagttttttgtaatctttccatcaaatcacttctcctatttgggttttccccacaaaaataaaatgaaaaaaattccccccgaacttttgctggaaatgatcagatttattcgccgcaacaaaaaatgggcaaaatgccgcgtttcctttgcgtttgatcactttttgctctcttgccattatggtgcctgtggttgaagcaactgaaagaaatggggagaattgtttaatcatatatataaaatatattttaatacgataatttattttaattcgatttatcattttcatttttaaattaaaacaattttgatttattatgaaaagccatgtttgaattt

SEQ ID NO: 26962 - DNA, 770 bp, Heterodera glycines
ctccccaattcttctttccttttgtgaatttttccaattattctcaactatccacatatcattgatccatctccttttttttcgcccatccatccgcacaccccccaccctaccctctacacaaacagtctccgtaccagtcacccccttcgactgtgttgtgcacgacttcttccagccgcccccctcccaatataatcgatcgtacacttcacataacgaagttccgaaaatatctttctttgctctttctttttcgtttttcagttatcattttaataaataatacaatttatttcatttatgtaaaatttggtcaatttcaataaaaattcagattttttcttacaatagaaattttttgcctttttttcccctattttttacaattttattccgttttgcacaccggatcattttgaaacaaaatataatgttccaaattttcgtcaaaactctcaccgggaagaccatcacccttgaagtcgaggcgagtgacaccatcgagaatgtgaaagcgaagatccaggacaagcagggaattccgccggaccaacagcgcctcattttcgctggtacatccgcttgatatgccgggatattaaattttttcgcgtaatccttatttttagggaaacagctcgaggacgcacgcaccatggtcgactacaacatccagaatgagtcgacgcttcagcattgtctgaagcttttcgggggcgcaaggacgggcaaaacagcacactactcgcggagcgtaagtcatgata

SEQ ID NO: 26963 - DNA, 1221 bp, Heterodera glycines
  misc_feature (1181)..(1181): n is a, c, g, or t
ccgcaaaaaaaggtaaaatttttgatgaaaatcattgaataattttttaaagcaaatatgtttttaaatagatcaaaaaatttttgagtcatcttttacttggttaagaatttaaaatttagcctattaaatgtttagaaaatttttattattttttatgttttttgaaaaatttccgatttccgaattccgaaaaagtttttgaaccaaaaatactaaattcgaaaatttggactttcgacttttattcgagttcgggtccggggttctgaattggctgaaattgataccggattcatgatcattgatctctaaaaagcaatttttctactgacgtattttgcgatagcaaaaagggcaggtggttagaaaaaagatttagtgaaaaacagaggctgttatggaaaaactgactaaaccaaaaataaagccttaaaaatgtctaattgtaaacacatgaaattcatacgggtcgaaccaaccgcaccccgttttgagcggtgtaaaaatcttgtgacaaacccgtgttgggacgaagtccgaatagggcaagtaattaaatttaattaaaaaataataatattttgtaaaaagttaatttttcatttttatatttaaaaatttggatacacttgttatctttttaatctagaaatttatttttaaaagaagttaaatatataaatatgttttaatgaacggtcattgtcatgtgtttacgacactcccattttattccgtaattttgtcaaatgacggttagtcttaaatgatcttggtatcaaaaaataccttaatcaaaatctcatttggcttatttcggcatttttttggaagaattctgttaaaccgggttttaaaccggttaaaacttaagccagtgtgcttaccgaagaaaaaagttttaggtataaaaatatataagtttttctatactgaattctctacaaaatgcatgaaccatgtcccaatcggttcagtattaaaagtctattcggtagagaattttgtcaactctgataggcccactcactttttcggaagttttcccagtttcaactaattttaggggtgatgaaggagtgatctgaccaagttagtgttaaaaacttttgattagctttaaaagttagctttcgcctcaaattagattcaaatagtggttgtaaatatatgactangattatggtaacaaaattaaaattttgagtgatttgggaa

SEQ ID NO: 26964 - DNA, 1108 bp, Heterodera glycines
caccgacaaagtctcatttgtaaactccaccatcacttggaaactctcatttgttagggccaattgagctgaaatttttacattttgtttttcacatcacacttaagtactggtctgatcatgacggcgtaagactcttctgatcagcatcgaaagtgttattagactaatttactaaatttatgtatatgttgtttttgaaaaaaagttattcttattttcaagtaaaattataaaaatttgggcaatttagtgaaaaaattcataaagaatttctttcttttacactgcaattttttgtgtgcttttaatatttatggacaagatatgattggtaaaaatttcagcttgattggcccatgtaaagttgagaaatttaagtgactttatctttggctgtgtataaataaaatttcaaacataaagaatatgtatgtatgcacaacccttattcaaagaatatttttattaataaatatttttaggggaacggatttagttgcttagatttcaaaacataacaaacattcattaaaaaaccgaaaaacctctcaaatatttctaaaattgaataagaaatgagcgattgttttcattaaaaatgctaaaatgttgccttgcaaattgactaaaataaattttcgaaatttataaattatacttagtgcattttctttagaaataaatattacattttgttaaactcaataaaaaaataaagctttttaaaaactggaaataatattttaattcttactgtttctcttttcacgtaaaccattttctgcttcggcatcttaacataaattaaaaaattaacattacttaaatttcctattttaaaatttcttatggttttagggctataaatttttagaaaacgtggaaataggcgtaaaataataaagttgtaaatcattgcttaaaaaaacaatttttaatcaaaatctcaaaatatgcaatccacattaaaactattggaaaatataaaacaaaaaatgcaaaatatggagaaatggtggtcatcttttccttcgaaaaaattctcaaaatttatttaataaacccactcaaagttaccatttttacaaaattataaaattacaaa

SEQ ID NO: 26965 - DNA, 1010 bp, Heterodera glycines
ctttatgaaagtttatatttgcaattatacatgcacttttgctccataattttataacgattatataatttagagctctaaatttcaagaaaaccgcataaagtaggccaatttttgacttttatgaaattcactgacgcaaaagtcgtacaaaaactaataaaacggagatttaattttgttccagaattttcgttctttgccctatttttaaggtttgtatttcaaaaaagttgctcataataaaggccatttgttttgctttatgaaagtttatatttgcaattatacatgcacttttgttccataattttataacgattatataattttagagctctaaatttcaagaaaaccgcataaagtaggccaatttttgacttttatgaaattcactaacgcaaaagtcgtacaaaaactaataaaacggagatttgattttgttccagaattttcgttctttgccctatttttaaggtttgtatttcaaaaaagttgctcataataaaggccatttcttttgcttatgaaagtttatatttgcaattatacatgcacttttgctccataattttataacgattatataattttagagctctaaatttcaagaaaaccgcataaagtaggccaatttttgacttttatgaaattcactaacgcaaaagtcgtacaaaaactaataaaacggagatttaattttgttccagaattttcgttctttgccctatttttaaggtttgtatttcaaaaaagttgctcataataaaggccatatcttttgctttatgaaagtttatatttgcaattatacatgcacttttgctccataattttataacgattatataatttagagctctaaatttcaagaaaaccgcataaagtaggccaatttttgacttttatgaaattcactaacgcaaaagtcgtacaaaaactaataaaacggagatttaattttgatcacgagaattttcgttctttgccctatttttaaggtttgtatt

SEQ ID NO: 26966 - DNA, 1057 bp, Heterodera glycines
  misc_feature (1033)..(1034): n is a, c, g, or t
  misc_feature (1042)..(1042): n is a, c, g, or t
  misc_feature (1051)..(1051): n is a, c, g, or t
ttcaaacttaaatttcatttgtaaattccaacattcgttggccatccacaaaactttcgtcgttaaatgtttcgaaaaattggcactttcgtttttggcatttttctgctgctgctttttgcattgcctttggtcaggcaaagtccgccgcggctgagccaaatggaaagtacggtagcatttcgcattttagtgttttactgtaaattaatggtgatctgctggaaaaagacgaaaactataggttgcgaacgaatatacctgagccgtaacatgaatatctgagattcttacaacccactgttgccgagaggcgccttgggaataatctcccctaattaggctgatctcgcccccctcctcttggacaggcgtcgtccagcagcaaccgcccgcacctccgccgccgtctcagtcctcccaacagcggcacatttccgttgaggaagacaactccaacgaattggagcagtcacagcagcagaagcaccggaaaaaacaagggcgaacgcagcagcgcccctcttctgttggcgatgtccgtgccgccgtttgtcccttcggttggctgaacttccgggacgagcagtgcttttacgtagggttgcgtccccgaccccgcccccgacccccgacatttttggccattttcggggaaaaccccgaccccgaaccccgacgcttcataccccgacaaccccgaaccccgacccttaaccccgatcggggtcgggttaaatatacacccctaagaatggcattttcgtgggagaaaatgcaaaaaagttagacgaaatttgaatttttttaaccatttgccaaatttttattaaataaagaaaatttgctcaattttggacatttggaatgtggtgtagaggttagtgcattactttctgtcgtgagttcgataccgtttgacgttttcttctttaattattttctttgtgacaaattgtttttttaaattaaatactcatagaaatcgaccaatcttggcatattttgacaaaaagacgatatcgaagaaaannacaaaaantttaccganaattca

SEQ ID NO: 26967 - DNA, 949 bp, Heterodera glycines
aagaatttgccgttattgttgatgtacgccttgtcaaaagacaaaaaattggacgtttatctttgtgattagccatttgctaacttttattagggttttatcaaatattagcgttaataaattgttgaaaattaaaaaaatatttttttttgcggcgcaaatgtcgatttggctgggcggcgcaagtgtctgcggcgcaaaagtcgcggcgcaagtgtcagcggcgcaaaagtcacggcgcaagtgtctgcggcgcaaatgtcgatttggctgggcggcgcaagtgtctgcggcgcaaaagtcgcggcgcaagtgtctgcggcgcaaaagtcacggcgcaagtgtctgcggcgcaaatgtctgcggcgcaaatgtccgcggcgcaaatgtcgcgctaccgttttttttagttaattttgttcataatcaattaaattttatttattttcatcggtagcattaactatttattttctattagctagtaaaatttcaaaaatatttcgttaagtttcgactaaaaatgttcaaaaaaccattttttgagttcttctggttcagaaagctaatgaaaatttttgagaattttgcaggcttatagagaaagaacacttagtgctatcgaatgagatgaggatttaaaaatctagttaatctttagaaatattatgtttttaccgctggaaccattaaactttcgaattgtcccattctgacccagaaaaattagcgatagtttaaaagtctataattttgacttttattaaaaatcaaaggggggcgtccttttggttttcaatttttttatgataatgccttgtcataaaaatctgttctgttcccgtgttttttgagtgcttgatcagtgatcacgaatacaatattttcaacttattcgagttctaaagattagaaaaattgtcaaaatagatgccagaatcatgggcag

SEQ ID NO: 26968 - DNA, 1316 bp, Heterodera glycines
cgctttgagaacaatattttctcgcattttcatggactgttgacgtaaaagtagtgtaatacatgtactaagctcacgattaagggtcggcaaaatcccccaaaaaataggatttccaactttgaaaatatccaataccgaacccaacggcaaaaaaggaacagtgagaggatagtgatttcgattaagcgcgcggcatattaagcgctaatcggggggatgaaaagcgtgaatccaatctcgtgattccttatgtaaatggaaaggcatcatttaaaattgcccttgtaaagtttaaatggagaatttttgaagataaaaatggttcttgcctgtctgatcagatttgatgcgtcctgaaatttttatatttttaaaaaaattaatttttaaaataaaaacattaaaaagcaccttttctgtgtacgaccctttggccacaattcggtcgaacagttcgccaccggtgaccagcttaaggcacatatttattgatataatttgtatcatatcaataacaaattcaattacctccatcaccaaatatacgcaatgcttttcttcttaaaaacaatttaataattaatcattcgcagtagcaaaaatataatttaaattcaaaaataaaatcttttaccaaatgtgtcgtacagctgcacaatgttgttgtggcgcagtctgaacaataacaatgaactctgtgattacgtgtgtgtgtttgatcaacatgctcaaagtgattcgattttacggattcaaaaaaacgcggttgaacacaaaatgatcggatttatgttttattttaaatgatctgatgttcttaggttgggagagcagggtagttaattagttacaaattgggcaatacgtttttttccgatcagttttgagaaatcggacaaaatgcctaaagtcagtcatttggcggtaattgttccttggtctcacgttgccctctttcaaactcaattttggcaacgcaccttttcaacacccgtatttcgttttccaacgactcctccttgcccttcagtgccttcttgtcaatgcatttgatggcgacaaaagtgccgggcacaaagcggcactcggccaggaacactttggagaaggcgccggtgccgagcagatccttgaactcatatctgaacagaattttgtggggtattaaacgtgatatcatgacatcacagcatcatcatcaagaaatgagatcagtgatccggccaagaccatcattctcttgtaccatacaaaattcacttaatttggtcctccgtgaacattggttttcgttaaacccaattttttttttg

SEQ ID NO: 26969 - DNA, 1742 bp, Heterodera glycines
gcaaagtttttggacagaagctgctcaacttggaaatactcttcggcatccgaatcgtccaaactgacagagggggagcaaagctcttcgaacagacacggcactaactgaggggaagggacggcataataaactgtctcgaacgcccacctccgaccaattttgaaaacctaacaaaactgctgatcaaccatttctacccggacccattgatcaattggacttttcattgttttggtttggcccttcccaccgatcaaatggcacttttaccgttttggtttggcaccattcccccccccccccctcccctcccccttcccaatcgccgtaccttttcaatgcgtcgccccaattcaaattgccttttcaccatcttcacaaatcgctgcactttttctgtcctcgtccgtctcttttcttcagcttcttcctctttccctttctcttcgcaattcactggaaattccttgtgcaaattgtccccgtctttccgtttgaactgctccaactcttcgaccacagcgtttccgtccaaaatgcactctctgagttcgttcaacagaacatcaagttccggttgaaggcaatcgccgtggatggacttttttctgatcgaaagttttggcgagaatttggtgccgacatcggcgactttgctgccgattgatgaggttggcaagtgcaggcaaagtccatctaggcaccgctggtgccgattaaaatggtgattcattgggtgccgttttgcgacaatgcaatttttgattagtccgcttggcattttcggcgcgacctttcttaaaatgtcaaacacaaataaatgctttgtttttatgcttacatataaacaatattattaaaatgttgtttttgaatgtgagaccgggactcattgtcccccccccccccgggcaattccgtcgtccctttccattccattttcattcattgtcagttcacgctttgtgtggaatgaacggaaagcgaacgattgatccatggttatggtgggtggaaagtgctaatctgagaatgaatgggtccgcttcaacggatggacgattttgtaatggaaaagcggacgaaagaggagcaaaaaaacattttgcaatttaatttaaaaaaaaattgacaaaatgatcagtgagtgggttttgcataataatgacagcgcagagaccggcggaatgaaaggcattaaaaaggcggggggggggggggggggacactgaaacggaaacccacccacccgcccttttgtagtgaaaaatacaaacaaacaatgattaattacaattattaattaataaattgtttttcattttaaattcctttaaatccatctgactcatcggtcggattaaaagctccttcaaatttaaacgttaaaatgaacgaaaattatgaggagaggaaaatgaaaaatgattgtggtgataaaagtgaggaacaaatgaattatttgaaaaggacggaatgaatgaattaatgaaaagcgaatttcggtgggggaaatgtcaaataaaaatttatgataacattttaaattgtggggggggggaaaggcagaagaaagtgatcgaacggaggtgaattgggaaaagaagcgatgatgggatggaaccgaggagaaggaaaagcagaaaaagcgggggagggaaaagcaaaaattgtcaagtggggaaaggggggggggcaattagcattttaaatgttttcgcggttgtccccccaatgaa

SEQ ID NO: 26970 - DNA, 959 bp, Heterodera glycines
agtgcttcccatgtcttctgcaaggcacgtttgacgagttgcacggcccgctcgaaaattcctccggcccacggcgtgtgctggggcgtgaatcgccacttaatgcctcgggagtccgcaaaatcgatcggattgtctcccggcatgccgaactcggcgagcgttttgccaaccacagtgaaggttggcgcgttttcactgagaattcgactcggtgctccgcgccgggcgatgaatctcctcagtgctgagatgaagctgttggccgataagtctcgagtcgcgtcgacataaatggccctcgtcgtcaaacaggtgattagcagcacccatgtcttcctttgttgtcccttatcgtcgagagtgactgtcggcccgaggtagtcgagcccgactgattcaaacggcaatcgtcgtctcactcgatccattggcagttgtggcattgtcgggagggggtagggcatccccctgagccgtcggcatcgtttgcattgaccaagtacttgccgaacttgttgtcgtgcactgggacaccaccagctcctcaagaattccgacagagtgccgtccgttcccatgtgatggagtcgcacatgtatgtcgtcgataatgagcgctcctgctcttgatcttttcgggagtatcaccggccgactgagttccgcttcttcgcaccagccgattcgactgatgagccgttgcaccccgttttcgtccagctcggttcgcatgccgtcccggggttggcaattccgttgtgttgcccgtacaattgcccattttgcgtccgtctcttcgtcgtgggttgggagagccacgatttgtccccgaattgccgcttttcgccgtgaggggtcagatccccccattgttccgtgcatatcctcggcttttcttcgtgcgttgttggcaaatcgtcgtgcccaggccatcacgcgcagtgctttcacccatct

SEQ ID NO: 26971 - DNA, 344 bp, Heterodera glycines
gcagaagggcgatcatgttggaactgagtgtggagaatgcgtggaattcctccttgattttctgtggaatgaatgcctttgccctattcgtttctttgcccttcgcttgcctttgtgtcctcctccgaagcaaccggcgattgtcccccgtccaccggcgaactcttcgaagggctttccgtttcggaattcaaattcggagagacggaaaaagttgatggttcgtccgcggttaaacactttgacaaatcatccaaattcttagctgagtaaatttgacgttcgcgccaaaccttcgaaatttgaaaacttattaactaggggccgattatgtgtggaattcc

SEQ ID NO: 26972 - DNA, 1209 bp, Heterodera glycines
  misc_feature (1138)..(1138): n is a, c, g, or t
  misc_feature (1156)..(1156): n is a, c, g, or t
  misc_feature (1168)..(1168): n is a, c, g, or t
  misc_feature (1174)..(1175): n is a, c, g, or t
  misc_feature (1190)..(1190): n is a, c, g, or t
tgaggattaaattccataataaatttattaacgaaaaactataaaattttacctaataatttttctttaatttttcatgactaatttttatttatatttccttatttttaatatattaaaattgcttgtcgcgatgtaggaattaattctaaacttaatcattattattaaaatgtattttctttaggttttttaataaaaaaaataaaaattccatttttataaaatattaagtgagttaattggtaaaattaattgaatataaatttcaagaactaatgaagaattttcatgattttttatattttcaactatttattaaattttaaaccattgttaagtagattaccagatataaagattttttttaataatttgtttgtaaatattatgcaattccgttttatgctatttaaaatatattttttatttttataactctaaatttttgctgtttaaattgaagcattattatttaagtgatttaaagattatattttatttaataaataagtttggattcaaagtaaatatttattaatattctgtcaaataattattatttattttgtatttaaatttttaataatttttaaatccttctattgtacactcattattctatagagcttaagaactgattaacattttttaatataatcttttatttaaatttaaatttttgttttagtaagaagcctatcaaatttttataaaaatttttagaagaaaaagaatttctaaaaaagatttaaatttttaaagaaaaatttatataattttattgtacattattcaatctaaatttcgataaaaatacaatatttttcaaaatgtttcatttttaaaggtaagacatgaacacttttctaaatttctttaaatattttttaattttaaatttaatgtggtgtggtccataaattttcgttattttagtaaaaattggagttgattatagaacaattggtaaatggaagaaacaatttggaatgggtaaatagtttcataaagttttaatgattatgtttctattcaaatataaaaattgtttaaaaatgataacaattttttggtattactttacaaattttttatttaaaatattaaattctcataatttaatcactgttctagnaataatttaaatttgtanaaaccattttanaacaanntttaagacagagaanaaggttttatttttgctgg

SEQ ID NO: 26973 - DNA, 1167 bp, Heterodera glycines
actttcaaaggattttcaatccaaacaaatatttaattaatgacccattttataattttgtagtaaggccgagcaccactaaaagcatgcattcctgagaacagtaaaaaaattcttaaaaaattaaaaatgaagcaagacaaccttcatttattcaaataacttatataaaaaggttgaagatctacaatttgtttttaaggcacttataatagcaatagctaaaaatcacaaaattggtttcatatgttaagccgctcactaattcattctacgtcaatcctgtttaaatcttccgccaaattaattgtgacaaaatgcttatcagatacttatattgtcctcgatagagcaatttttgataatgaaaatcgcagccatagccgctacctcggtagtgaatgttataatatcttgaacatggagtgtctatcttcccggaatcgtcggaaaagacgaagcgtacagatcgggcggcaacggcgacagcgaagtggcggacgcacttccgtcgtcggggccgccgcggtgggcgcccgggggaaacagcgaatcggtggtcggcagggacaccagcggctccaccattttgaccagcatttcgccgcagacgaccattgtcggctgtacaacaaatgtcatcattagcgctaattagcggatcgaattgaaacggcggcggtgtcggcggaacagacctcgacaatgaagtcgatgaagccgatttgcgagtctgccacgtgaacggtgtgccggtcgcaaaggggcgaatagggaagacccatggacgccttttgggaaaccgttaattagctaattaccacgggaaaaaatgtgggccgaatgaaacgcacttccaagtcgccttggcggaagaactcctcgagcacaccctcagtcctcaaaatcaaaaggccatttgtcaattgggacaaaagggaagggaatgggcggggggaaagcggacaaaaagtatcactaatttgaacgaaatgccgtattttcccaggcctcgtccgaatttttctgctgattatggggctgcctctgatcaacaaaccaaaaaccgaccagcgatagtgcaattcccatggcttcgatgcgtgtgatctgaaaagggaagggccttcgatcggttctttttccgtcccttttcacatgtcacac

SEQ ID NO: 26974 - DNA, 1013 bp, Heterodera glycines
ctaaattgcttcgttccgtcgcctattttttacgctttgtctcacatcttaaagcaaaatttcgtaaaattgcttataaatcaacatcaatagtgattactgtatccgaactacgctgtgcctttcattttttgttaaaacaagaacaatcttcccaccctcctaatgaacatgaaaaggaagccctaggattattttctgatgattcgggaataatcaaaagcaaaggtcgcataaaatactcaaaattaaataattcagcaattgaaccaatttttttgcctgcaaattcccttctcacccgccttattattaccgaagcgcacctaactaaccaacattccagtccactccatactttatcggccattcgatttaaattttggataccaaagggtcgaaaaattgttggacaaacaatttataaaaattgtatttcttgccgcagatttaaagtacaaccttttaaccttcctccaattccgcagttaccttccgaccgagtttgtctgactccccccttttcgacagttggcttagatttttttgggccattacatgtaaaaacacttatcccatcaaatgtccgaccctctaaaatgtgggtgactctttgggtatgtctttcaacccgaaacatttcgttagatttagtcccaaaccagtcaaccttgtcctttgcccttgccttccgacgaatttcggctaaattcggtatcccaaacactgtatactgcgataatgcaccatcttttattaaatttaaccaattttcctaatcatttacaccaacaatttggaagttccgtacaccttcagccccctggaaaggggggcattatgaacgttttgttggtttggctaaattccatctcagaacagtgttaattggacctcgtcatcggattctcgataacgatcaactttctaccttgctttacgaaatttcaaccacagttaatacgcgcccaattacctttgattcagcaaacccagccgatcctagacccctc

SEQ ID NO: 26975 - DNA, 570 bp, Heterodera glycines
tttaatttgcaccttcttgttcacgcataaggtataagcccaaccatttctcattgtcagtgcttccatttttcttttcaatttatgccaatattttccatggaagcccatttatgtaagtgacagattcgcttttacgttcacttctgtcgattcccattttttgtgtacataaaagaaaatacaacgctacaaaaaccaaattttatatgaatttcgcgccatttaagccagcagaatcatttatacttttttaattgattgtgaaaattttgggctcggtgattgcgagaggcctcccttattgattgttattttaatttaattttccattttcattgaaaacagaaacgcgcgcaatccgtctgaaaattttttttttggaaatgggaaaatattagataatttttttgtggattttttcccaccacctaccccctacctgcaaaaaaagctcaacaagaaaaccttaaaattttaagtcaaactccaattttttttcaagtttcattttagtcgtgggttcgagaataataattatgccaattaaggaattacaatatgtacaat

SEQ ID NO: 26976 - DNA, 1422 bp, Heterodera glycines
  misc_feature (53)..(53): n is a, c, g, or t
ataaaaaaatcatttaataatgggattcaacagaaacggaaatattagcactnttgtggaaaatattttacttacagatttgaaggtttcagacgcggtgtagaatcttaaaaaattaatattatttaaatcttttataagatttacgcgataaaaattaagtaaatagtgaagttcatgtgatcttaatagaaaatggataatgaaaaggtggtttattgaaaaaaatggtgttaattcgagtgcaggatctataaataaattaatattattttaatcattaaaaatattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaatgtcgtggcgacaagaaatttgcgtcgaactctgcggggtgaaggggacgggaaggggatgaaatgggcgaggcgcgcagagtagccgttcgggggaatgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaatcacaaatggaaaaatgtggcaaaatcaaaaggggtcagaacggcgttgggaaaaggaagggcattcgggcaacggctggtccaaaaggggccacacaatggcaaaggaaagggagggcactcgagtaggcgcggacagggagggcactcgcacagacagagagcagcgaaggccgggtgcagtgaaaggcggtgggcgggtgccgggaaacttcggagggaaccgtttgtctcgaatctgaaatttccggaaaagtccacccctttaaatacgatttttttgcaccaaagtacgctacaatttctcattttaattaaaatatgtttttgtgtgttatccgtttggatttgccattttcccattaattgtttgcttttccgttttcccttaacattccatttctttatatattaattattaataatttgtttacgaacaatcttaacagatttcccattttatattaaataattttcgttcctttcattcctgaagaaaggacttttccttttcaaccaatttccgtttttctttcaaaaagtttttttctttttttgaaattattttttccaaaggttttttttaaaatttattttccaaaa

SEQ ID NO: 26977 - DNA, 1800 bp, Heterodera glycines
agagcagaaaaagagtcaaaacgtgccgaagaaattgagttcgaaaacgcccaaagtgtctgtgccgttgatcacaaaaaaggacaccgacgacaaatcggacaaaagatatgaggcaaaatttgcggtgaaatcggaggaggaaattttcgaaaagatcagagacaaatttaacatcagtgatgagcagttgctggtatgagttgcaacattaaaaaaatttgaaatttataattgagttgttgacagttgtcgctgtctgagcttgtgccgttgaatggccgcggagggagcggcggagttttttacaaaacgaaggacgacaaattcatcttgaagagtctgaacccggatcatgatgagcctgctaaaatagacgaggtgttggacaattattcgaagcatgtgcttggccagcagcccgagaagggcaagcagtccacggacagccgctccatgatgaacaccttcttcatgtacttcgaaatgaatgtttacgccaagctgaaggagggcaagggaaaagagaggaaaaaggtaagaaacatagggaagtttatttatttccttttgcactttacccttcattttaagaaacttcggctgcacatgttacaatttgtggtactgaacaacgtatttgagggaatcgacgagcaaactctgctcaagttcgacatcaaaggcactttcgcgccgggcagtgccgtgcagcacgaccagaagcagaagtggtacacaggagagacgggttggcagaagagtttgtaccgcgagtacgacttcatcggcatctcccgcgaagggagagagatttccgcctttttcccggagggcattcagctgcatcctgaagcgtatagacaattggccgacggagtgaagaacgacacgagcgtaagcattagagtggagaccgcattgacaaactatattaatctcaaatagctaacagaaactcccatttacagtaccttaccgagaacggagtcaatgactacagtctgctgttgggtgtccaattcatggacccatacccagactcaccaaaagacagaaaagacttcgagggaacaaaaaagggcgcaaagtgtgtggaagcaaaatgccataattgcaaacgatggcctgatgcagaatacgaagagaaggcgaccctttgtctgtacatgggaatcattgacattgtgacgccgtccaacgaaaaggcggagaagcatttctttgaaatgatgtatcgaaggaaagacatagcagattttatacactacaaacgcatgagcgagttcatcccctaccacaatgttggcttttctaaatcaaagggtgcccgttgtgacagcttcccgcctcccccccccccactttgcactttgtgcgtctgccatcagctggatgagatttctgtaaagcatcctattcctagaccgccattatttttggaaaagggaacttgtgggaaaaaacctcgttttaactgaagggtttgttaaggaactcttgtaaatccgtaatgcaaattttgtttggaccgaaagtatttataatggcatttttaccttctcaggaaattgtgacgccagtgccgccccaaatgtatggaaaacgctttgttggcactgtgctcggctgcttgttcagccccgagtcttcaacatcggtgggtggagaatcggaacgccaatttcaattgggcatgaggcaaagcatttgtaaaacattcggcgagaaacggggaatcaagacaaaccatggaattgaggtgttcggactgaacatgttcaaggagatgatggagaa

SEQ ID NO: 26978 - DNA, 1594 bp, Heterodera glycines
tttacgcttactgttcagcaattcgcgatgtgcatctttcaaaaaatgcgtaatcacttgaaatgcggaaataaagcaaaagcattgcctgagatttcgggaaataattaacttttttaaatatttgtttgagtctaagcaaaatattttccgattaaccgaggccctaacggaatctctggccctttcttttcccaaaaatgtccaaaactaactatttcttaggatttaacgccaagttttgaaaaatttcaaggaacttttagattcggcgatgctgatttcctttaaaatacaagttacaaaaaacccaaagctaggatatagttaaccctgtaaaaatgtttaaaaaactctctgaaattaggagaaaatatcaacaaatagggctcaaatcgcatccctgataccgaatagtgtggtgtttgggaccaatcgataatggagtgaactttgttcactgatttcccttaggcacaattccttccctcatataagcgctgtctttcctccctccctcgttcattctgtcatttattcctcccattgcaattcccatcgccttgaccattttattattatatttgtgcttcaaataaatatttgttttattcatatctgttgttctcggacacaacaaatagtgcgagggaatggagacggatacaatgcaaatggcacaaattgggtgacaatgtttacctaaaatagtatcaatcatagataaaaagaattttatcggaaaaagagatgtacattatcgttacaacaaactaagatactgtaagaaaatgtctcaattgcacagtaaaaaaaactaatacactgtaatatgttatttattccgtattttttacaaaaataactaagatactgtaatttgatattttcgttattatagggtcatgagacgacattcattttgatgaaaaatggtttggcctaattataattaattcaactttgactaactttgccctttttgtagtaacattcgttgcaagaatttgtcagtttgacaagtccgttggacaatgcccaatctttggcatccaaactttgttccaacaaaatttgcagatcattctcaatgtttgacacacaatattgttgcggttgttcaatgccatccttttcatctcaaatggcacaaattgtggttaataaaaataattgatatttatttaaaagaatttaattgaattaattttgagaattttttattctgaaattttttttgttacgatccaaatgaaataacgtctttttaagaagaataactggtttttagcataagtccataaagcaaagataaattaaaattagaaaaatttaaattaattcttaatacctctattttgatttggtgatccaattgccaattgaattgaaacaagcaaaggcaaaaattttatcaaattatagaaaaaaaattttgccttttcacatgaaaataacacaaaaaattaataataaataaaagataatcaatgaattttactgaaacaaaatatttggctagaaacaaatattattccggcggatacagtgcagaaatagatgccaatgccaaaatattagctgaatttcataa

SEQ ID NO: 26979 - DNA, 195 bp, Heterodera glycines
cgccacccaccacccgcgcgggagagggcaaacagaaggcgggaaacgacattcagaaccccaccaagccagcaccagcaggcccggcacgagcggccgcccggggaacgaaccccgaacgagaaacagagaggacaccggacgcaagaggagccccggggaccgagcgcgaaaacgcaaacagggccagagcgg

SEQ ID NO: 26980 - DNA, 1279 bp, Heterodera glycines
taatgatggggtggcaatccccccccccccaattagagcaattttgaattcgaaaaattaaaaaaaaaacattaatttttcactattcgtactcattaatgatcgtagtgagatgtgatggcaattcttctcaaataaaggaattttttgcgaaaatttaaaaaagattaatttttcaaagaaaatttaaatgatcaaatatttcacatctttttttgtttaatgatctctatgccatcgatttgtagaaattaatttttaaaaattgcaaatctcctaaaccaattaaattaaaagccttttcctcttttctttattatgttctctttttatttttgtttttccccagaattttcccagactttctgattaagatttattgcattttttatcaagagataaaaaatgtttgctaattttggaacatttctgttaatattattttccatcaaagaccttgctgtttctgactgttcttctcaatttcctatttttatgcatttctctatttgcattgcattatcacagtattttttaacattttttattaaataaataataatttttttctgtttttgattaataaatttacaaaataacgaatccttttctttttcaaaaaccctgtaaaaaacgaattcactataagaacagcttattgctcaaccagtgctagatacaattcgttctttattcgaacatctcgtctctatagacttttgcctaaagagacgagattactaaattctaatgagtttgccaaacttcttgaaagatctgatctgaatttgttgatttctttgccaccccagctccaaaagtgaccaattgtttgttttatttgatattgtttcattatttcttatttttcggcgtcacgcttatgcgtataaatgaaatgtaatggtttgtcgtgtcattcgtttcccataagattcccttgcccttttcacatctttatctaattcatcatttgtctgtcttatgctctttatttagcgtttattcgtaaaaagttaaaacttcatcaatcgtttaatgagtggacgcggcggaggcccaagacgtgatggtggtggcggaggagcgcctcgcggaggatacggaggagggggaggcggaggagcgcctcgcggaggatacggaggagggggaggcggaggatatggaggagggggaggtggaggatatggaggagggggaagcggaggagcgcctcgcgcttactagatgaggcggtatgatttgactcattccggtagaaatatgcaatgattat

SEQ ID NO: 26981 - DNA, 959 bp, Heterodera glycines
ctgtggcttcactgttggaattccgtcaaactctccgcgcaaatattcatatgaaatgtccaaatatttgcgatatttttggcattctccccgttcatgtgcttcaaatttctgctcaattttggcacattgccaattctttctcataaaatacacaatgccaagatgtgcctcatatttttcctcactgatttggatttgcggaaggcctttcataaatgcaattagcattttgtcgtcggcctaattaaaaaagaaagtctaatgatgaggcaattaatattcaccagtgtcgttgcatttgaaagtggaattaaaaaacgaaatatatgctaataaaataaatagaaaaagcagaaaaattcatttctccgcaattgagcttttttgaacctaaattaggctaattctactcaaatgcattcaaatttcaaatgaaagatagaatacagttaaatgtataaaaatgaatataaaaaatatatgtagaaattattttattttttactaaatttttttactggcatcgtgctttttggatatttattataggttcgctatctctatttgagtcactgacaactcgtacaaaaggcaagacatatattaaattttacaaaataatgcctaaacttaggcctaagcctacgtataaagctttaggcttagcctctatgtacgagttgcctgttgtacaaatgacttttgtacaatgtccatgacaccctaaatttagagaaaaaataaaaataaaattattttcgaatttcgacctccgggggaggcacgttgtttttgagtaaaattttcgccaaaaaatgtgatcgcggcaaaaaggaaatttttatcgctttttgttaaaaattttgaattgtttaaagggaaaattcgaaaaatgcaaaatatttacaaattttgacaaacccccccaaatattaaaaatattttttttccaaaaa

SEQ ID NO: 26982 - DNA, 825 bp, Heterodera glycines
ataatttttttgaaactttgaagggaaataaagaatacttagggttatcgaataaagtagaaatttcattcaattcaatcatgaattttaacaattcgtccttggccaaaatttaccgtggggttggccacttcatggccaatacaattttccaagtcgtcgtcattggccaaatctgttgggcaacaaaattcgtaaagctctggcagtacagtcatggcaaactgtgaacgtgtgttcaacttttttgccactttttgcagctgaatgctgaatttctttaacacatttttctcatcacttgtccatgtttcgttggcgttgtgccaaaggaaataattcaaatatgccttgcccataaacaaatcaatgtggtgaatttgggcatcggcttgccaatgtgcaaaaaaatcgtccaaatatttgaatttgtctatgccatggtagtgcacgtcacacggatcattatcatcgatgcgatttttatcaactaaaaaagatagccaaaatatttgggatttatggcataaaaaagcccaaaattttgccatgcaatttatcaaaaaaataaataaaataatgctatttggcttttctctgtgattctcgtcaaaaaaagacactcagactgtagtatacttaatttaaatttattgatgcttattgagtgcttaattatctttttcttcaattttttatactttttaaactgcttagttttttttttgattttttgtccataagaccaggtctcaggggtgaggcgcaaccgcgatccgcggcctttttaaattttttataataggaaaatttaattaaatgcgc

SEQ ID NO: 26983 - DNA, 1035 bp, Heterodera glycines
ggccaagaaggaagaagaagctgctagctaatcccattgcaaaaacagaagagaaagtgccattttgaagaaaatatccccagtaaaaaataaaatttgttcaaattcaacgccataaactcatttggcaattttgaaaatttagtgacttaaaatgtcaaaaaacggtacgcttcatatatatctagctcaatactgacggttttggttaatcatttaggtgatttatttatttatttttcctaaactccctgggacctgaaaatgaaagcaaacaaattttttctcaatttaaaaaaaaataatttctaaataaaaaataattttttatttgaaaaagctttccttaaagttgaagccctggtttatcaaattaaaaaacacataaattatttttagcttttttttactaattttaaatttataaaaatccctcccgccgcttttccttttatttctcacccgtacgctgcacgtcatcaccagggcggcgcaaaacggcagcacaacggcggcgagcaggtcaagcaacacaacgctatcagcagaagaggaggaaatggcaacagaaggccaaaatgggggaggagagaagcgcaacggcgcaaaagcgttgtggaagagcaaattctgaaaagcaaagcgaaacaagcaaattaagaactaattaattaattaatgtataactaagccaggggtgcgatctgtccttatttgaaagatttgtccttatttggaggttccaaatcttataaaataaaaatgtccttatttataagatttgtccttatttggaggttccaaatcttataaaataaaaatgtccttatttataagatttgtccttatttcgggctatcgttaacaaatcgcattaaaaaacacaaaatttttcccagcgggcgcctaatcggcgccccccggacgccccctgtccaacccccaaaaaatttttaaaaaaattcccccgcaaaaaaagcgtttttcaaaggaaaaaaaagggcgtccgggctgggtttttaaatttcaaaaatt

SEQ ID NO: 26984 - DNA, 1605 bp, Heterodera glycines
  misc_feature (151)..(151): n is a, c, g, or t
ggtcagtcatagatacgtttccataataaaatgctatgaaatatagcggggataatacaaaaaacaaacgcaattagggaatttgacaaactgcaaatgtgacattgggaacaaatgctaacatcgaaaaatgcatagaacggcgctgctntatctttttaagtgactgtgtgtgacttattcttcttctgccgttggctatgcaattggtgccaacacaatgcctccgtaaccggccaatgtcgttttgcccatcagatagtggtccacttgtcgggcggcctgtcgtccttcgtgaattgcccacaccaccagcgactggcccctgcggcaatcacccgcagcgaacactcgcgcgcaattggtgttgtacttttcgttcggagttttgatattttgacgagggtcatagtccagcctcagttgatcgatgacagtctgcacaaattttaaatgcattttgaatttaaaaaatttatttgaaagtatcagggtttttgttacggagttccgcctaagtccgttttcctagaccaaatgcccggttgcttaaaaattcctggctatttaatgtgtgaataggtgccaggaactgccattttaccttttcaggtccaatgaaacccatggccataatgcacaggtcgcagtcgtacaccttttcggtgccctccaactccaccattttccaagccccattctcgtccttctcccattcgatgttcactgtcttcaagccgaccaacacgtgcactccgttcttctcttcagtgatgaattcctgtaaatcatatggttttgctgcttgtcccgcaccatttctccccacctttgtgctaattgcgtaagtcctcgggtcttttccgtcccgcaccttcgcttcctcgtgtccgtagtccactcggaaaatcagaggccactgaggccaagggttctaaaaaggtcgaaggggtaaacaaccaaagaagctaaaaaccccatttatttacctcgagctttcttatctctgccggctgcggcaaaatttcgaaggcctgcacagttttggcgttaagtctcagcgaagttccgatgcaatcggtggcggtgtcacctccgccgagaataatcacgcgttttcccgccgggtccaacccctcccattggacatcatcgccggcgcgacgtcgttggcttttctccaggaattccattgcgaaacaaatgcctttcgcctccctgcccgggatacgaatgtctcttggtgtcgtacttcccgtgcacaccacaaccacgtcgttctccttcagcaacaattctgccggcacgtgtttgccgatctctgtgttcggaatgaaccggatgccctcctcatccatcagcttcaaccgtcggtccaacacgaacttgtcaagtttcatctgcggaatgccgtagcggagcagcccaccaatcctattcttccgttcgtataccaccaccgcgtggccaactttgttcaattgagcagccaccgccaaccccgcaggcccactgccattgatagcgatgcgtttgccggttcgggcgggtggcttttgcggctcaatcaattgttaaggaaagcgtagtcaataatggcacatt

SEQ ID NO: 26985 - DNA, 976 bp, Heterodera glycines
  misc_feature (12)..(12): n is a, c, g, or t
agagtctgtaanttgaaatttatgaattttttttaattgggaaagatatcaaataggtatataggtattgaacactctaataaaaagaaatctttcaaattaaaatgtgaatttccaataataaattaatgagttagtaaattagtaaatttttaaggctacacatttcatatttgctattcatatgaagtaacgaatgaaaaaaaaatgaaaaaagaatgatcgttggattcttaatttgttttcattctcaaacgtcgcccttctctttcccttccttttccactttcccatttccctcgtctctcttctttcttcccttctccgtccactggaaaaaattggctgaccaaagatcagaatgaaaataacaaaactagaggggtcggggtcacttcgccgcggccatctcgccgcgagaaactcgccgcgtggccaactcgccgcggcgctatctcgccgccgcccaactcgccgcgccttgtttttttggctatctcgccgccagatttttttcattgaaaggttacctcattattttgatataaaattaaaaaatgcattaatttatttcaaaagaatcattaaaataacaaacactggtccataacacaatttgaaaccagaaattccgaaccccgaactcaaaatttcgactttattcgaattcaggctggtgttataaataggttgaaatggagtgctcagtagagaccggaaatttcaaatttgcggatcccgctgcgggattggaactcaaaattctttgcgggacgggatcccgcgggattaatcccgcattttaaaaaaaaatgtgggattgcggactgggatcccgcaaaacgcgggatcccgtcccgcgccggactctagtgctcaacgcctcaaatacccaaagaaacttgttaaaaaatcccaaaaaaaattaaaaaaaaaaattcgggacccatgatcaacatgattggtctttaaattt

SEQ ID NO: 26986 - DNA, 1261 bp, Heterodera glycines
  misc_feature (1241)..(1241): n is a, c, g, or t
ataaaaattggtaaattttttttacactttaaccaactgagtacacattttgagtctgaccaaatataggtattttcgagattcaattttgattccctttttataaatttggcggctcttgcggctatcaataaacctaataattcgagtttaggaattgttaagcctttaagtggagtaagtcttgtttttgcgaacaataaatttatttgatcgtttgtatgtaaataagctgatgtggcataagccaactcagaagcgtcagcgaaaatgtgtaatattgaatgttttaaatattggcttgtgaaaggtgaacgtggtatggctatcatttcggtgtttgaaatattattccattcaataatttcttgatcatctaatttatcgtcccaatctttgttagatcgccatagtttttggaaaaatagtttatatttcagtattactggtgaaatccatcccattggatcgaaatttttggcaatcatcgttaaaatttgtctttttgttgtgtctttactcattagtggaatttttatttggagttcaagttcatctgaatcgacattccattttatacccaacatttttgttacttttggtatctctgatccttccaatttttgaatttctttattactttgttcatgattagacacaaattctctcagattcattgatgcaagtttaaatatttctttgctccaataatgtttgaattttatttccttttcatcgtcgcacatcattacgaaattatcaacatatgcattttgtttaagttctatgcaaagatttttaaattcttcttctttatcatttagacataattccttattaacttgaattgtcttgaatttttcaaacatttcatttatctttgacaagtggagattaactacagcagttaataaaaatggtgaagcgttaactccaaatggtatccgtgtgaatcgtctcaattcgatgtctctcatttcaatttctcgataattttgtcttatttcattcaagtatgatttgtttacccataaaaatcgtgttgtgtctctgtctaattcatttaatccaactcgtaaaaatgctttttccaagtcaccaattaatacgtaatttttgagtctaaatcggagaatcattccacacaaatctggtagtaattttggtccttggtgaatttcatcatttagtgaattatttcctttaagttttgcggacgcatcaaaaactggtcgtaattnttggttgtatttgaactctc

SEQ ID NO: 26987 - DNA, 1075 bp, Heterodera glycines
ccccccccccttttgcctccccccttggttacgggcctgggtgcattatgtttccgtcgtccatatttttgcatcccaccccaaaaatttttcaaaaaaatcttgtccattttttataggaaaatttcaagtaagaaatttcgaaaaaattttctaatttaacagctgggggtgggggggggttggatgacgagctgctccctcatgtttagcgctcaaaaaacaatgaactaattgccctaaggcattgtttcaaattgccttaggcacccaagaagagggttttcaatgttttgaaaacattttgacaggtttctgtccatgccggaaacattatgtgcgcaagactatgcgaagcattgtgggcacaattccagcagtggagagccagcacaaaagtgtgtgtgtgcaaaaaaaaaattaaattttaaattatttttaaatgattgaaatagtgcgccattgccactatagtgctgctggtcgagactgcaaatctctaccgagaattctacttttttttgccctgaccctcaaactgatcagaaaaaatcgatcaaagaattccgtcgatataatattttaatttgataaattttttctgttcagttttgtgatcagagaaaaaaaacccccgaaaattcacaatagaaaatcggccagcttccatcaaaacgcttcacgcatttttaaaatttccgatgctccataaagtcatttgcttttgccaatttaacattttgtcaggtgctgacaggaggcggtggaagaaaggaatcggcgggcagtatggcggcaccaccgcccgtcgtcgagctggtcactggcagcagcagcataaagcagcaaccggcgccgccgcttggaagcagtgctcggctacggaaagtgtccggtgaacggaggccaccgccgagcggagaaagcggcggcggcggattggttttagctgcttcatccccattggcaggcaaaaccgtaggaggaggcggaggaggagggccaattgttggcacaattggagcaacaaaaagcccaatgtttggcgacatgcggccacattatgtgtgatttg

SEQ ID NO: 26988 - DNA, 925 bp, Heterodera glycines
  misc_feature (884)..(885): n is a, c, g, or t
ctccgcgcctgcctcggacggcgtcggataaaattcccactccggaggcattgcaaattcgacgaacggatgcacacaatggtcaaattcgacgaccgtacaaatggtggaggcattgaaacggcgaaggaatgcgctgacaaagggaaaaattcggaacagtgatcgaacaaaatgatctggactatatataactcagtcagtatgatctgatccggacactgatcggggaatgccaaagggagacccaaaggatgccgaactcgtcaatcaacaaaaccgagacttaatcgctcatattggaatggttatccagcgactgatcaaacactgctgttcgtccgtaatttgatcattatgccgactattcggagtgtttttaatactgatcagaccagagatccaattattagggaccaaattaggagatgtgtggagcaacaaacactccccggttcgaaccgtgccgaaacatctgaaacatcttcccccccccccccgcccacctgtccaaatcgccttgcaaagtccacagaacgacaatcatcggcacgcatgaacattgttctgcaggcataatacattaaacgtgcgaaatgatttgatcagtgtcccgtcacggcaccacccaccgactgccctctccaacagacaaagcaatccgccgacggcgcctgagatggcacttccggcggcggcaccttttgttgcgtcaaccgcagagggtggagatgaaccagcaatggaatcgtcgggagagcaaatgctaaatgccgaaggaaaatagaaaaggaaaaatggcacaatttgaaaatttgcatttggacgaaagcgcaaaagaattcaaaaaaggcaatcgaaatttaaatatttatgcttgcttnnttacagattttaagacttgtaacagagtcagtccctctca

SEQ ID NO: 26989 - DNA, 1338 bp, Heterodera glycines
  misc_feature (1223)..(1223): n is a, c, g, or t
  misc_feature (1288)..(1288): n is a, c, g, or t
tcaaagaagagtgaggacatgatcgaggcttttgatcgggtgttcgacaagtcgaagattatcccgatgaaaatatatagcgacagtggactcgagtttcaggcgggaaaaatgaaaaaatattttgaggaaaaattcatcatcaaaaatgtaatgtatagccccgacctccacgccggagtcgttgaaagggcaaatagaacaataaaggagcgtttgtacagatattttacaaaaacgaacactctacgatgggtcgacgtaatagacaaaataataacaaatattaacaacagtgtgaataggacactgggagtcaaaacatcttcaattaattttgaaaatgcccgtgcgctctgggaaaaattatataaggctagggaatttaaaattttaaaaaagaaaaaatttaaaatcggtgatatcgttcgtattaccaaggaaaagggaaaattttcaaagggatacctcccaaactttaccgaagaattgtttaaaatcgttgttgccaatccgacgacacccgattcatacaggatcgaagatttggaaggaaatttaataaaaggcatattttataaccaggaattagtgaaaacagatggatgatttttacattgtactaccttcgaacacaccggggcaggagaacactacgtcaaaattcacagtacgactccccgagactctggaattgggcacaaattggtcagtagctctctcatcaattatttacccctactcattcaccgctctcggtataaacggtcaagagtttattaaagtatgggaaaacgacagcagtgtcccgactcaagtttatttaccggacatgaattttaaaaccgccgggggcctgggaaataaaattaacgaggcattcagccatcattacaaaatcaaaaaacaacgtggaaggagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactacgagaaacaaatcctcaaattttagaagagcctgatataaaaatttggtttgacaaaatggttgagatgggaaccgaaattcaaacatcacgaaatgaacttaaggcttttcaagaagaagtagataaagccaaaaacataacattggagcatgtggaanagaatgacttgaaaaaagcaaagaaatcagccgacgtcgcaaagggaatcgccagacaggcaaangacaaatatacatcaactctcgagggatataatgataatccgggaaaggg

SEQ ID NO: 26990 - DNA, 1323 bp, Heterodera glycines
tttttaattgttttgtaagaaataatgaattagtttttctttgattcataatcagaattttactcaattttaaaatttttgtagtttaaaaattcaattgattactattttcttttttcaaatttgaaaaaaacattgataatttataactaatttttaacaaatatttgtaataaaaaacgcatttctaataaattaattataattattttatgtacttgtattgttttttttgataattcactgcaattttcgatagaaataatatagaataattagtttgattgaatttgttcatttatcttttcacaccataaattttcaaaaagtcaattttaaattctttacattttattctcatggctcaaagacgaattatttaacattgtattgtttattgcttgatatttcgatttaattaaatttaagtaaattttattaatttattttttaaatttaaatttcatttaaatttatataaaaataatttaattttaaatgcatgtttatatacatacttgatgaatattccgtcctttttaaaattttctgttatataagcaaaattacttggagtttgattttttctattttttatttaattgcaattaataaaagataatttaataatttatttataattttatatttattcatttaatattgttcaacccatcccaaaaggggcatttacttagggtgtaacataagtttccgcactaaattttttctgacaaattcaaaaattcataactccgtaatttctgcagttattttaataattctttttttatttcgttctaaagaaattcttcttttatttcatgccatcgtttcatttttttatttgcttgtcaatttttcagaattttttcccgaccatgccaaagttgaaaattggtccaataatttttctcgaattttttatgatcaatactaaacctgattctgtaaattttagatcagtaaaatccgaatatgcctttaaacctgatctatattaaccctgagcttgtactactccaactcgatacacgaagttggagctgtattatattcttatagtcctaatttttctctatttactcttgttttctctacctctatatctcttttcattttctttaagtcagccatcaaaatacctagctcgaaaatgaccatttttacattatcaactataactaccttaaagacttttctaatgggatttatctcttgcctgataaatagtaaactcattatcaataacggcagatatttcaaatcatgattgtgtttttttaatttatattcaaaaaaattctttaaaaaaagttgtgc

SEQ ID NO: 26991 - DNA, 807 bp, Heterodera glycines
gagttgccgaatcggaaaagttcgtgaattgatcgccctttttccgtcacccagacgggaatgaaggggtttaggctcctcattggtccaagacgtgcgaccagttcttcgtattcatcgtgcttgtcatggacataaggcgggcatatccagaagaacttcacgtgtgcaaaacgacggcacagattcgcgatcatttcgtactgttccatcatcatttcgacagtttctcctctcagaagagagtcgcgtccggcaatgatcagagctgccttcactttgctcgacagtaccactggcttcagagtgcgcactgtttccgccaatgttccgtttttgggcccaatcactgccgtttggtccaggatttccgccaattggtgagcagactgatcaccgattatgacacgagggtgtgccatcagttttgaggccttgtgcacgatttttgccctcaattgttctaacgcccatggcgtttccttggacgcttcttcccactttttcttctctgattcggccaagtggttgagtccagcgggcgccgtcatgccaatcttctcaaatttgctttcctccaaggcgcgtctggccaccaaacactttttgaagaaacattccaaagacttcttttgatcttcctccgttgggtactgtccggtcgccacaaaatctgcctttttggccacaaataagcgaatttcttcttttggctcgccttctattatcgcgttgaccagacttcgcgctgctgtcattgacttgactgtacccgctttcagcaaaaacaccgccaaaagagcctgt

SEQ ID NO: 26992 - DNA, 1102 bp, Heterodera glycines
ttatgagggggggggggggtaaaaacacctgaataaagcgcaatgcgcaacggaatgaaattgagtccgctgacaactatggcaaaggtgacgaacgcactgcactcctggatcgcggtgctcagcccgttcagcgcaatttgcacgttgcacgcgccccggagagtccttttgtgcaaaagccgtgcaaacggaaaaacaaaatgcccaactccccagtgccaaattcccccgtcgccgttccctattcgcccccccccctccgcgccgacttggttttgacagtgacgtgcacaatggtcaaattcagcaccacgccaatcaaacacaccaacgctttgcacccaatcagtgccaccaattcccaggagacgcccgagtctttgaagtgttcataagcctgaaaagtgtcagcagacgttagttagttaccctttccaatcattttgggggcgtttgtcaccgggtcggcctttgtatttgctgccggcaacaaattggaagtgtcgtcggatgaattcattacaaatggcaaattccctcccattggtctttttatttccctttctttcccacaaattcatacgaattaaaggcaattatcattttcatttttaacctttgggaaaaaaggcattctcagaagaaagcgagcgaatacaatttattaattgagtgtaaaaagagaataaaagttaatgaaatggaaatttgcacaaaaaatgaaccaaaagaatcacgcaattaacggtcggggtcgttttcgcgtggccgttttcgcgtggccgttttcgcgtggggacgttttcgcgtgagtacctgtttaggactgaaattggtcggatttgtgcaaaacatccatgtttcgaatcccgaacccgaattcggacaaatttcttgactttttaatttttttatttcttgcggctagtatcttctacaataatttgtcagcttggccggatgtgcatcaaacggtacaaataattataattttatcaaaatataacaaaaaataacaaatttcagaacaaactacagacgcatttcttatttatcgggaaacaccggtgagaaaattgataatgttttcatcattcac

SEQ ID NO: 26993 - DNA, 770 bp, Heterodera glycines
acatttgcggcccggacatttgctgctccagccaaaatcggacatttgcggcacgacttttgcggcccgctatttatgtcctggacatttgcggcccatttcttaaaggccagccatttccggacatttgcggcccaatttttttgttgaattttacggcccaagccaaaatcagacatttacggctcgacatttgcggcttcccatcaataaattaaaataaaaagaaatgagctcactttatgtaattattttctctctatccaattaacacagaaattttttaaattttctaatggcatgctcaaaaccgaaccagcaggtgctgggacgttagtcaaaaatcatcaaatgtaaattttatttttttgatataactttgctcaaaagcaaccaaattttataatcttgacatcattcgatagccgtaagttttttctattattctgcaaaatttcaaaaaaattcattaattttcaaaaaagttataaccaaaaatgttaaaaaaaatttgcgtttttgagctaaattaattttgtgatacaataatgatgacgaacactaacggcaccgccgacccccattttaccattttttttgaaaaataaagatcaaaatggcaaaaatagtattttttggcgaaaaacgactgaaaattttgtaaaatacaccccataattcgggatttcaaaaaccaaaaaaattttgccaaaaaatagtgacccaactttccactaaaaacagattaagactaataatgctcggcatgg

SEQ ID NO: 26994 - DNA, 1260 bp, Heterodera glycines
gttatttttatggatttttgaaccggtttaagtagattagactagaaaaaatgaaaattttgaaatcatgtttccccctcccttttcccaggggtattttttgtaaagtcttttttcaaaataaacttttcaaaccccatttttcgcaccgtgaatgtatttttatgaattctgaaccggtttgagtagattagactagaaaaaattgaaaattttgaaatcatgtttcccactcccttctcccaggggtataattttgtaaagtctttttttcccaaataaactttttaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattatttgtaaagtctttttttccccataaacttttcatacccatttttcgca

SEQ ID NO: 26995 - DNA, 1288 bp, Heterodera glycines
  misc_feature (7)..(7): n is a, c, g, or t
cttaccnggcgatcccccaggtccgtctgcgcctggcggcctcttggggcccggctctccgggcggtgccttaaatttggcgatttgtaatttgcgcaattaaattagaaattttgtttgttccagcctattgtatcagtctgctacagtatctataaacattttgctacagtacttcgcatgggcactgcggcgggaacagcaaagacggctcgggcccgggcggtgaaggcgggccggggggaccaagctctaaaattttagttggcatttaaacattagatttttcaattttgaaatccctacgtcctggctctccgtctattccacgcaatccgtcacggcccggcggacccgtacgaccgggcggtccgcgttggcatgtgcctaaatgcggaaaaattgaaaaattgtgtgaatttggcactaaaattcagagacaaattgacgggtcattttataaaaattccaatttgatgcattttccttacagcatcccgtcgatggcgtctccacaaattcgtcacgcgcccctcgcgcgtacgccgattgtggcacatcccgcgcggtcttttctttggactaaattttatcatatggagtgaacgcggcgtttccttttcccgctatgccctctttttctctgccctatgtactaccttcgctttggctgatgcccctgcactctccgcgcgcggtgcattctctttgctgctgctgcttccgccgcgtgttgacgaagtgccgccgcttttgcttgcgttcgacgtcgccgccgttttggcgacgccgccagtggtcggcgcctggggcgaggtggcaccaccaccgctgccgccgagtcgtccgccaatgccttccgcccgctcgtccaccgggtcgtcccgcaacgccatgtcgtgcaaacggcgcgaccaatagtcgccgagcgtgtcacgcttctccaactggcgacgctggattgcctggagacggaaattgcatgtttaagggtcaattagggtcgattactgccaattaaaacatcaggtgccgattttgcccctatttagggggaattgcccttatttctgaaattttgccaccgatttaatccccggcactttattttgagggccttttcaattggcactttccaattgtcaaatgcccactttaccatgttggccaatcgcgcggccgccgcttcgccgccctttccgcccgttttaatttcgaacatttcctgcaatttttgaatatttaaatttatttgtttggcgttttgcttttcgccccaccttgaaca

SEQ ID NO: 26996 - DNA, 1014 bp, Heterodera glycines
  misc_feature (754)..(754): n is a, c, g, or t
tttttttttttgttgttgggggggggggcgcgcccccccccccccccccccccccccccgcccctcttatttgggggagagaagggaagatgcaccacaccaataacacacacccccacccccccccccccgcaccccacataggggggggggggggggggggggggggggcgcccgcctcccgcgggggggggggcgccccaccaacccacaaaaaaaaacaaaaaaaaaaaaaattttattttttttttttttgttttttttttcccccccccccccccccccccccccccccccccccacccgagagaggggagaaagaagagaaaaagagagaaggggggggcccccccccccacccccaccccccccccccacccacctttttttttttggtgggtggtggtgtgtttttgttttcttccttcctcatcacaagcgagcgccccacccccccacaaacaaaacaaaaaaaaaaaaaaaaaaaaaaaaaaataataatatttttttttttttttttttttttgtttttttttttttttccccgcccccccccccccccccccccccacacaaaagaagggagggagggggaggggggggggggggggtgttttttttttttttttttttttttttttttttttcgacaccaccacacccccggccccggcggggggggggggggggggggggggggaaaaaaaaaaaaaaaaaaaaaaaataatatatttttttttttttttgtgttttnccccccccccccccccccccccccccccccccgggggggggggggggggggaggaaaaaaaaaaaaaataatctttttttttttttttttttttttttttttttggaaaccccccccccccccccccccccccccgcggggggggggggggggtataaaaaacaacaaccaccccaccccccccccactctcctctctactttaagcgggcaggggggggggggagcggaaaaaaaaaaaaaaaaaaaaaaaaaaaaaaa

SEQ ID NO: 26997 - DNA, 1246 bp, Heterodera glycines
aaattccaaaatatattttttcaactaaataattttccaaattaaatttaatagatagttgctttgatcggcgcgggattttgggatttgcgggggggggggggtcccatttaatttcccgggatcagtgaattacaattttatgtcgggtcccttaattgcggtgcattttgcataaatataaatttaaatttcattattttccccacctttttccgcctttggagacatttttttgtctggctgtcgcattttattggagctgatgacgacgggagaaagaagggatcatcggctgaaaatgggggcaattggtgcgacgacggcgccgcaaaaagacgaaaaggcggcaaaagggggaggagcaaagagaagagggcgaaagtgatgccgacgccgctgaagaagactgaagttcttgttgttgctgcgtgtacaggttgaaaatgttggcacgggagggaagcgaataagagagcaccaaacaaatgccacggcacgtgtgcaacaccttaaatggcactaatgataaaattaaaagtagacaactaatgatgttcgagagaccttatcagtcttgagtattgtaaaattttacagggaaattgccgatggggggggggagggagaacaaggcattacatatggaagaagctcagtatttgaagtttaaaaatttaagaattttttgaaaagtcagcattggcattcccgccatgcaatttaactaaatttttttaagaaatggataaatttaatgacatgtttcgtattcaaaattaaagttttattagcagattatagcaaacctcactgctgggtgtgtttttgatcagagatggcatttaaaaacggatgcgaaaactatgcaaaagtcaccccccccccgggttaaaatgcgagcaaaacaatttgggatcgatcagtaaaattgcagatgaattggtctttggcttattttaaacaaatttttctactgattggaaccatcgggagcagcagatgttcgctttggaaatgagcacaaaatatattagtaattaataaataattaggggaaaaacaacaaaatgatgattaattgttggtcaaattggaatcattttttaattaaaaatttgttgaaattgtttataatgaccccattgatccattgattcggcttttcactcatcaaagtcatcctcttcaaaaaaaagttaaagcaaatcgacaaaaaattaatcggcttcttcccatcaaaagg

SEQ ID NO: 26998 - DNA, 1465 bp, Heterodera glycines
  misc_feature (46)..(46): n is a, c, g, or t
  misc_feature (54)..(54): n is a, c, g, or t
tttaataattgctttccctttctctccgtccgttcgcttttttccncacttttntagggtttttaaatgccttggcactgtgtttaatcattgtttttcctaattacattttatgtccctttgctctgattgctcagtgatcgctgcgtttgttccgccgccaaacgctgtgccgttgcgaaaggaaataatcggagcgtggcaaagaataaataaaatgatgatgaaaatcactagaaaaagcagaagaatggcgagagtgatcggctcgaaaattttcattaatttctttcgcttgcggcggcgatttgagtcttaatttgttttgggttttaaagcccaaattaattagtgccatttacttttcgaccgatttaagagcccatttccgtcccaatcaatttgaattgcttttgaaataaattggagcaatcgctttcttctcgagtaattctttcctccgctttttgtctgatcgttcgcacaattttcacagctaatacattttttgggctaatgattcggaagaattggttatatatttgaaaaaatatatttaattacttggcttattaattggaatgattcttctaaaaagtcctttagactttgttccgtcaaaacaattcgctctttcggatcactcagccgaattcggtaacgtttggccaagaacagaagcacaaaactcagatgctttcgcatcgttttgacaagcagaaaagcgtcaacatcgaaaaaggaaacaaattaataatggtaattaattaaaagtgttatttattcacccggaaataattgcaatttctgtttggcattcattgcagtgacaaataaaccattgagcacttcactcaaagcgggatcattgtggacaagcatttctcttctacttttgataaattcaaattcatcatccatggaaggaggaacaagggcctaattaatggtggtggactcattagttaattaattaattaagcggttaacttactcttggcaatgttccaaaaactgcctcaaatattcgctgcttttggctcaactcgcaaataaactctttcaatttgaagtccgcgctattgagctcaatcttttggaattgctcatgccaaaaggctgtgtctgctaattgggcgggagagaggcggcgattgggcccattttgggcaaaacaattgaaattttgcatttggcaattgaatgatttagcaaaaatcaacagaagacagaaaggaaaagtgagaagcattttgggaagtagtagaaggattgaattagaaattggatctgctaaaggaaagaaaattaaattaaatgaaaataaaataaattaaattaaagttattttttattggcaacagaaactcttctttaaatattttatgaatttcaattataatgaataacaaccaacgaattggttatgccatttgctcgccttttattgtgcgcattttggggg

SEQ ID NO: 26999 - DNA, 2189 bp, Heterodera glycines
  misc_feature (1291)..(1291): n is a, c, g, or t
tgtacatatgtaatatgtagaaaatcccgaaatatgtacttaaaagtcccaacttttgtccgcaaacacaaaaaagaaagtgttttcccactatttagagcatgttagagcatggagaagccaggaaaaaatatgtatttaaataaaaatgaaagccgtgtttatcgttgacaaaatttcattatggtttactactgtcaattattcttgattgtgagattacacgaataggtggcccattttgccgaggtacgacttgattttggttgggagtttgtttgaacacaaatggaaattccttttgaaatgcctgccgatactccgtactaaactttaaaaataattattaaaacatttttaattaaaatgacacctcgtaaaatataaaatgggtccgtttgacactgcgccaatgttcataggaattgcggccattaaagcgaaaaaccaaagagtgaccggagaagcaattggaattagcagaaagtaagtaattgctgagattaaatagccgccgatattcacagtgataatgcaaaaaagggcacgaaaagtgcgacgattaaacgaatcagcggacggcaagcctatattttttattttaattaccatttattaggttgaatcgcaggatcaaaaaacaccagtaaaaaagcacaaaaattttgataaaaataaaataccggcggtgtatcatatttaatatgttttacctgatgcttttatacgtattgtaatgccaagaaagatataaatggcaaaagtcattatagtaaacaagttacttattgtaacaaacagaggaatgatctgaaaaatataacacagttaaaatatccgacaaaaaagttgccataattttttcctaagcaactaatttaaacaattcttggtattgttcgatagatttgagtgtcctctattaacaaaaacgccaaaattaaaaaaaaaattatattgaatcttttttgaaacctggtctttggttgtttacaaaaaattatgaaaatttttgttaaaaattcgggacctgaaaaaaccgggatttcccgccccggtcccgctcaactctaatcagaacgaaacaatattaattattacccttaagacatctatgtatgaaccagtgaccattagatcgccgtcctgttttgcttcttggtaactcacaacagagaaaaggaatccatatgacaaggaaatgacagtagtcattgccaaatacagtcgcgtttttaaaaagtcgtgactaaaattagtaattaaaaattaaattagtaaaaattttttnttacatttccgaaaaagcaattccgattagtcggtcaatgccagtgaaaaacatagttggagtgattgcacctgaatttatattttaatataatttttgaattattatggttaattttttaaacatatattaccgagtccaatcgtggaaatgaaaagaatttttgctgccagacgattctcaatgaaattctgtccagaaaatgcggtgtacacaaacagaaaatggccactttgatgaagcaattcaaaaagggaacaaagtgccaaaaggtaattaacggtgccacggaatgacctaattaaagtttttcaaaaaatttaaatcattttattcccacgcctttcattaagcacatactttgttaacaaagtcacaagaatgacagaagaattcaaaataatcccaactgtagcgatgagtccgtaaatcaatccacatccaattagtgaccagcttggacggacatctttgaaggccaaataaaactaaattcaaaattatttaaaataatttaattatattaatgataccgtgttgttcgctgaggcattcatttaagcttttttaaaatttaataatgccaatgcaatgatgaattggttgaaaaagtgcatgttcgttcaccttaaaattaaattaatttttttgaatcggaaatgtttatgattttctgtctgtccatcggttctccgaaaattttttagtattccatttaataattaatttttaatttggtggcaaaaagtaatttaatttgaataagaaatgaaatgcagcagctgttagttttatgaaattacaacccttatttcttaaataattaaattgcgctttttggcggtgtttgtttagcttcataaatttgacaaatggtaaaaaaattaaatatcttttt

SEQ ID NO: 27000 - DNA, 1441 bp, Heterodera glycines
atttttgacttcagcccccccccccccgaagccatgggtctggctacgcccttgccgagaatgtaaaatttggttgcttttaagcaaagtataccatgtttggtcgataaaatagctaaagactattcaaaatatgccaaattatttggaaattaattgaattatttttaactttggtatggattaattaataaataatgaatgctttacatattttgttcattaatttgcctttttttgtgaatcattcactttccatccaaacaaatgcttctcgttctgctgcctctgttctgatgattaattgaaaatgatcataattagtgactccatttttaggcacaaaaaatcgcgaaataggcaaataaatttttttttattacgcattactcatcagacacgaaagtgattggacggccattgagaatggctttattgtctgggatcagcttccagtccaccgggagggcataatggaccattaagagttgccttcctaggaccaattgggtcccgttgtctgaccatactcttttgggagtgcctcgccttgcgacaaaacgctggaaagcggctagaaaatcgctggcactgaacgattcgacctcaattgcacttcctttcattcaaatccgatgctaccaataagaaaatgtggctttatttaagggacgactgaagtgattacaaagaaaatagcgaacattaaatacgagtgaatgggaaatgtgatcgatcaattatcgtgggatggggcgatacaataagcaaaagggaaataaatttaattttttgaagtatttcactaaaaaatttttactaaaattttcacctttagaaaaatagcgatttttaaaatttaagtaattgaaaaaaatataacaaaagtttggataaatagtctgtgactaccattgtcaaatgttcccttgacgtattggccttttatttttatgataaaagtcaacaaatgatccgcaagcaattgctgcaaatttggcaaatattgttactttactccgacaatgatcattctcagtttcttggaccgtaactttttttattgctcaatatatacattcttggcgtaaaaagaaggcttaaatctattgaattttttctataagtaaatctgggtaaaattattcttaaataaaattgaaaaaggagaaggagaattattcttttcctcagtgtattcttgttctaatgcagtatttgctagtagttagttacggtgtaccgacatttcgccaacttgacatctcgccaactgacatctcgccaactgacatttcgcccactcagccaaaaacattcatttcgccaactcaacccaaaacattcatttcgcccactcagccaaaaacatccatttcgcctactaagccaaaatctgacatttcgccactgacatttcgccaatagttaaaaaaattaa

SEQ ID NO: 27001 - DNA, 1254 bp, Heterodera glycines
agcttacctattttgcttttttgtttctcgaatatttgataatttcttcgcagttttaaaattttttgtatttagacgaccatttcgaaatttctcttgtccattacttgcctattcttattattttcttattcactataaatacacagataacctttcatgggcgggaattcgagtgtgccggaatcgatggcgaagaaagttgacgaaaaccaaatcaggaaggaagtgagtaagcagcgcagcagcggcttgccgatccctcccccccccctccgaaatttaaatttgaaaaggacaacagttgaatgtgttttgattttaataaaataaaaaaaatttccggtcgccagaaccgtgttaagacttttgcggcctgctgaaaatcggacatttgcggcccgacaaatgcggttggacatttgcgccttggacattttcggtcaatttcttaagggccgtttttgaatatttgcggcccgacatttgcggcctgctgggaatcggacattttcggacaacggaacgccaaattatcactttattccaaaaacgatatttgctgcccgactttttcgaccccaaccaaaatagggttcatttatcgaaaatcccttttcctcttaaaatttacgccgaactttattcaatttttcaaaaattgatgtcaaaaccccaccagagcttgaaagttgctagtcagtctaccaactcttgcagcggccagttgatactgtagagatctgagatttcctaatgatgttcatacatctttctccatcattttgggagttgtttcgttgatattcttttcctcctcttcgttgcttccagttggatgggggttaggattttttttagaagacttgaatcggcttattagaaaaagcatgaaaatcggttaaattggatggaaaataattttccgaggtttatatctttttggggtcgaaaaagttgagccgcaaatgtcgggcggggacaggtagggagcacatagggtggtggggagagagggacagacatagggaagggggtaagggaaggggcacggctcacaaaaatggaaagcagccgtattgcgacatttgcggaccatattttcttgattgaagtttcaaaaaaaaatttatttttttcttaaattggatgatcatccaatttgaattatatgtgatttttcggagttaagcaaattagggcgaatgaaaagataaaaatttataaagtttattcaataaagttcttttttca

SEQ ID NO: 27002 - DNA, 1511 bp, Heterodera glycines
tggcttttaactagagaccgagatttccaaaagtgccggatcggaccggtctgatattttcagaagcaaccggtttccgggcccggcctctcaaaaaccggtgaaaccggattttcaaattgccgggcccggaaccggtttggtaaaaatttaaattctcacatgtatttaaaccccaaaatcgacaaaaatcgtgccaaatgttaattttttttgaaaaactttgcgataattcatcataaaattgaaaaatcgcttaaaatttttgaaatttctgtttgaaatttaaaaaaaatttcgagggaaataacagaagagataaatgaattgcgtcagatagcaccaccggggaaaatttttatttgaggtgaattttatcagattttgacaaaaaaaaatgctttttagttttttgattaaatcttttaccggaattgtgtggatttttgggacacatttcggttctattgcagtttacactaccataaaaaaagacacgaccataaaataattttttgaaactttaatacactataactttttctagaagcatccaaattaagcattattggtatcatttgatagccctgagggtcctctatttgcctttaaaattaaaaaaatttggttatgtttcaaaaaagttgtggcttgtaaatttcaaaaattgatttggtaaacctttttgaccacaacttctttgaaactcaacgaaattttttgaaattttacagaaaaatagaggacactataagctatcaaaagttactaagaatgtttaatttgggtgcttctataaaaagttatggtgtatgaaatttacgcacttttgtcactcgacacagcaccataatttgtcttggttagtcttttaatttttaatttagcgcgtttgatggatggtattttggtggtagactaagaaaatgggagacattaggcgaggcaaaaataaatattttagcctaactaaattatgttttttttccgttcgagagcggcacccatcaaattggcaatgcttgaaatttcgtcaaaatgcttttacagagatttcggggccccgacaaaaatggataaatcgagggatcagtcaaagccttcgaagtcgcatttgatcaagctttagctttacacttttacaccttcttcctgctattttccatgtgccttccattcccatttccgtctgtttttttagtttacttttgttgtcccttcacaattcccattttatttaaaatcaatttgtaaaaggcttattttgtcccccccctcctgaatgtccaccttttcgtgcaatcttccaaatgaaaaataaaagaaatgttcacgggtcttttaatatttggatacggtaagggacttggtaaggatgagactattaaaaagtttcccgttcctgcccctttttggcataaccgcaatatgggtccctaaaattgcaaaagccatgcaatactttctaccctttttttgtttttttaggtcaaaaaagtcaaacagttgtg

SEQ ID NO: 27003 - DNA, 1185 bp, Heterodera glycines
aaaagtgatcaaatcgaacggaaatccgtgccattttcgcgccgttctcttctcctcgagtcgatgtcatgcaaatcgaaggcatcgccagggacaggttgcagctgaaccgagggcgcaccccgcaccaatttgatgttttctaacacttctgctttgatggcagccaaatactaaaaagaaactgcgaattaattgttttataatttacattcagaacattactaagatagtaatctttgtgtttaagtattgtgaataaaatggctgtaatttaaaacagacgctaattgacccaaaattagttacaaatccctcttttaatacattcctcccccttccacccattatcaaaaagggaaatgtccaattagcagaacgttttttacatttccaacataaatccctcacttctttgctattggcattttctatgcgtttgggcagttcgggacgaagagtgaattcgggtgcaaaatactccaagtattccgaattgtccgggatttcgttgctgatctccgagtctctttccacgagaatggcggtctcgttggcccagcatcttcacaccaaattaccccacttttaatattgtgctcctcttttttcctttgtgtatttttacctcgccacgttgcgcagtgtgtagccgcccccgccgaggataagcaggggaaggccgagggacttgacgaaacggacgcattccctgagggaatgaatttggaagagtattccaaggcaaattgcccaaatggtttggccatagactttttctcaaccactctctcctttctctctctctctcccccttttgtgccattctaaacatacccgtggccgtcaaagctgaggttaaaacagccaagccgatcggagcccaacgaatcagcgccacattggagaacaatcaccgaaggattgaaattgtccacgacggcctgtatgacgggcttaaaaactgaaaatgccaaattttagaaattgccaattttgataaataaatttgcaattaccgctgtggtaactttcgtcgtccatcccttccctcagcggaacgttcacagagaaattagcgccatggcccatgccaacgtcgtacatgtccccagggccttggaaaaccagggaaaggcctgactttccacatttttcccataaaaattgggtcaaacccgggaa

SEQ ID NO: 27004 - DNA, 822 bp, Heterodera glycines
aaatagtacgccaaaattagagatgtatttttctctgcattctctctttcttggcacatgtctcgtttttgagtcggtgtgtttataaatgtcactcaatgtccatatttcggttaacattgcaaatttaagccgaagcttttgccacaagtgcccagtgttcaaatcaagaacaaaaacaggccgaagaaagttccattgcgcaaatcgatttcgcccggaaccgttctgatcattttggctggccgtcaccgtgggaagcgcgttatctttataaagcaattgccaaaatcgggtcttcttcttgtcacaggttcaggcaaagaaaaatgagttccagggccaacagacccacaaaaacacctcttgcacatctatgttcgagaagcgttgtttcaagattaagtcgcgagatatgtcattaggagattacgtagttttgagacgtcatttcgagattaagttgagccggattttgcttcaacataggcgggataagtgaatgctcgaacgaaaacgaaaggttgtcttttagagaggagacaaccggttatatgcttaagacagtaaacaaacaaaaaaagttaatattgttgaaattaggataggccgggtatttgggcaaaaatcgggtctgggtccatgattttcaaccggatccgggcatcgggtccaaccgggccctgaaaaaatccgaaaaatcaatttctcaaaattttttttttatgaaaatagttatatttttaaaaaaacatgaaaaatataataaatatgtttacagtagggtaggtctggacccggaatctcgggcaaaaccgggac

SEQ ID NO: 27005 - DNA, 1245 bp, Heterodera glycines
atcagtaaaatgctggtaaaaattttttctgaattaaccaagaaaaatccgaaaatgcctaattatttgaatgaaacatatatatacaaattcccgaaaattcctcccctggccccctccctcatatacagccaccccggcccattcgcggcagacctccatttgttccgtcaggcccatctggtcaagtgagtcgtccaccacttcgtccgccaatttcttacaccgccttccgccggacggaggtttgtaggttttatctgacaaatgaggaaacaaaaaataaatttttttatatttttttgatggttttttgagtaacgacccggcaccatcaatatttgattaaaaatagacatttgtgttgccgacaaaacccatttgcaccattcaaaagcagatttaaactttttttttgcatttctttgacgtaccctttttcctcttaggtgatggggacggagactcgcttgacggtgatgacaaaaaaaaacagcgatgttcatcgaccaattgctccactgattttgtgccatttttgtgtgccaaaacttggagccatgccaacagagcccagagaacgtctgtttcactgtgaaaagaaaaaatactagttaaatgctacatgttcaacggattgacactgatcttgggtgtatcaaaaattttgaaaattttttggaaaaaaaatttcgaaaaagcaaaattttttaaataggagatgtaattttgtcctgttcctctgaggggaggggaggtataaaaagtgaaccaatttcgacatcggcttttcatttagccaaaaaaatgaataaaatcgaactgaatgtggtccaatccggtgccgaatgactcttcaccgcgcaatggcaattgacggccccgcaccttggcagcacggtcaaaatacggacggctccgcaccttggcaacacggtcaaccgcacacgcagttggcattgaacgggcatcgcctgacaaaatgtgaaaagttaaaatggcattaaaattgcaaaaaaaaaaattattttaaatttgaaagaaatttctttaattttggattgtaaatttaatttaaaaatgaaattttaaataggcaccaattttccaacaaattttctatttataaaaaatggggggggtgggacgagttattacgtacaaaagatcgttttaaatgaaattgtactatgtcgaaacaggaaaaagtaaaacaaacaaaccgactgcgcagcggtggtgtgc

SEQ ID NO: 27006 - DNA, 992 bp, Heterodera glycines
tatgggcccgggtcaccgcgccatcctttcagtcccggcactcccgcatttcctggcattcctgaaacaaaagcattttactgaaattgaatgaccctctttaccaggcagcccagggttgcctggctcgcccttggccccttttacgccctccgaatttacgccgccgtctcccggtggcccgggccttcccgagcggcccggctctccgtcagggccccgtgggcctggcaatcccggcacaccaggggtgccggggacacccttaaggcgtgaaaaagatttttatccacctcttttcggtccttacgtccgttccattgcatccgggcgggcccatatcgccgggcaaacccggcaatccgtccaagccgggaatgccctctcggcctggtgcccctggtagtcctcggtctccacgtggtccttttgggcccatatcgccgaaatcgccttctgcgccaaccatgccgggagcgcctggctgtccttcgggtccgtcagtgcccggcgtgccggcaaagccgcgagggcccgaaaagccgagttctccctgtgacaagggaaaacatcaaattgagagaacgaacgaaagtgaatgtgtcggacacaattgagtcattagtggtcattaactgtgttcttcattggcatttctcttaatatttgtctcgttgacttaccctttcgcccttttcgcctgggcatacgcatgggcggcgtgcatcctttgcatgcaaatgattcgacctgccgcaccggcagaagcagcaaaagtacgccgaccattggcactgtccaaaagtgccgccgccgttggcactttcccggtgcgttgtctttccctctgctgtttttgccgttccctttgattgtcgtgccaattccgttggtacctccgctctgtcaagcaattcgttgtcattgttgtcgttgttgtgctgatgaccattctgacaatattcgctttgtcatcgtttttgttgggctga

SEQ ID NO: 27007 - DNA, 1274 bp, Heterodera glycines
  misc_feature (36)..(36): n is a, c, g, or t
ggtaaatttgttaagaggttgaaaaaagaaaagatnttatgtcaaaaattttaaatttaaatttattatttgtggaaaaaactgagttttcaattaaacagcaactcaatctacgggtgacgagaagccattcaattttgaggagcttgaacctttgggagggcaatgcaaaacggggcaaaggcaatcaccaattaatattcgtaaagaatgggtaaatttaagtaataactaattacataattagtgagtaagaacatatttcatttttacttttgttagcgttccagttcttattttcgagtgttgggcagaattttacaatttatcaatattctaaaatttgctaagccagcacttttaccctgaagatccaaaaaggctgtcgacatcaaatttttatgaaaatttttggttttggtaatgaaatctcttagaatagaatttaagcaattttttttaactaattctagaaaaattcttgatatttctatgttttgaactattttttagtttactgaaaacaaaactccgccaattcgattcgtaaattatgaaaaacaaaacaatgtgacattgcacaaccatgggcattcaggtgaaacagaatgaatacaaaggtttcatcgaaaattccataaaataagcatttttttaaaacgagattatattgagcgtttttggttaaaatttttaaaaatttaatccaaaaatagacctttttaaagagtttttaaaaacaaactcaaaagatttggcacgacagtgccgacaagtgccgctttttgtagttttcataaaaaattaaagaaataagcacgccaagaaagaaaaagcacaaatgtgcggcctctgattctctgattaaataatttttttatatttatttgctaataaaaactaaatttgccaagtggaagtaagcggctttgacacttggcccgagcgacctttcatcaccgacggtggcctgggaagcaaatatttgttgatcgaattccattttcactggtcccaaaagaagaacggaagtgaacatacggtagacggacagcactttgacgcggaggtactgtagacgaaaacaaaagcgagagtgaaagcgagacgacagtgagagagggcaagaaggagacaaacatagagagagagagagagagagagaaagtggagagaaagagagggggggggaggcgcgagaaagagagagagagagggaggaaagataagagagcgagagagagagagagtgagaaagagagagagggaaagag

SEQ ID NO: 27008 - DNA, 1260 bp, Heterodera glycines
  misc_feature (1224)..(1224): n is a, c, g, or t
atatgcgcataaatatgcaaaaaaaaaaacttgaaaataaagggtgcaaattaatttaaaaattttattcctcataaattttatcggttgttgttgtaattgcaaatcaaaaattcacaaggttttcgacagtgaagctcaatgttgacccactcgcggatccattcaaatttggatttaattttaggcataatcaaaattttttcctaagagatattcaaatcggaaaatatttgaccaaacatggaaaatatacaaaaatctaaaatttgtacaaagaatggcaaaatagcatgaaatatgcagaaaacccaaaatatgcaaacaaaagtcccgatttttatacgcaaacacaaaaaaaagaaagtgtttttcctactatttagagcatggagaagccaggaaaaaatatgaatttgcatatttttgcaactctgcttattaggtagtttgatggcacaacgatttctaagaattctgtccaataatcagaataaaattgttgtctacgcattttccttcggtgcctatcggacatcaccagacccaagaacccattattttcttataaattagttcaaaatcacaaaaagatgaacagttttaggataaattctgttaacaaaatacatttcaaattttcaaaattttcccggcggcgcctattggcaccgccggcttccccctagtttttaaaagcttcgctgcaaaaaaaaatcttaaaaaaaatctgattttttgattccgattctcaaaattttaaaaacgatcatctgaggcgaaaatataaaatggtattaattaattaaattataaaaaaactatttaaagctatgttgttaaatgttctatgatctaaaatctgattttttgggcatgatattcgaattttataaaaacctatagttccaatccttatttttctcaatctaattgatcattataaatattagataagcattgaacaaaacttggcgcaatgaaaaaaattgagttttatcaaatcccgataatcccgcgggatcccgaaaaaaaattctgatcatcttttgaaaagtcgagacgcctataggaaattctgtagcaaattttaggcgtggcagctcaaaaattacaaaaaatttcaaactcaaacgaaagttgattaagtttatgataataagatattaattaaaattaacttcgaatattctgtgctactatttcatgaagaatcatgttccnaattaatgtaacttatttttctacaaatttattttc

SEQ ID NO: 27009 - DNA, 876 bp, Heterodera glycines
tgttgtgtcgtcgacttccggtggtgctgttgtgccgtcgacttccggtggtgctgttgtgccgtcgacttccggtggtgctgttgtgccgtcgacttccggtggtgctgatgtgccgtcgacttccggtggtgctgttgtgcctcgtcaagggggtgacgcgggaaatgccaataggaacttattatcagccaggtgtgctagggcggtagggcatttcttagtgttatttatcaggaaccacagctgcccggtgtatttcgatgtggcatgtggttggtgattgtcccaactagtggttggtcgcaatgtgttttattatggagagtacttgaacagtttaccattttgttattccatcactgcgcattttctatttattcatcacattgtttttttcacgattttattttatttattatttgttacgattttctttttttttattttggtcttttttgttatgatttggtaaatgcttttatatttgtctctttttgcctctaatagtttgccagaattttttgcattcaaaagagctctggttaatagtgccaataatattccctttttcgaaattttttgttaactttctctaaataacagggtgaccaagttttttttgttgaaaactcaaattccaaatttccagcttgtctgtaattaattatacgtatgatttttttttttcttaggtgctgagaacgatagaaaagcttaaaattgggcgcggaaaagcatttaaaccggtttaaaactcgaaaatttggatgaaaaagagggctcctgaccttttaaaacgctcaaattcggacaaatttggtatcattcgaaagctcttgatgagctaagtctaaaaaacaaggtataaactcg

SEQ ID NO: 27010 - DNA, 49 bp, Heterodera glycines
ccgtggcgcagcatgcgcaatatgcgtaatcgcatggctcacggctatt

SEQ ID NO: 27011 - DNA, 872 bp, Heterodera glycines
ttgttggtgttgctgctgctgctgacgaggggctgttgttgcggcgctctgtctgagagccggaggaggcacttgctgcacaggccgttgatggtgaacgccgccctcgccggcaacaacattatcgtgcccatccaaatccacggcaccgctccgctcccaattcggtttcccacgtctaaacaacggtggcgaataacagcctaaggattcgaatttgtcgctttatttgttcttttgggtaataggtagttaaacacagattgaaccttccctctttttcgaataaaaatgcaactttcaaagtcctctcaaatatgtttgctgctggggcttctgctcacgaatatgatcaggttagaaaatcattgatttgaaaatgacattttcgaaaattttgatcaaaatgtctattaggctaaaaatgagacgacgttaacagtgagatgatcatcgaacaatcacaccaaacacaaacaatcaacatttattaaccaggcccgtgaagaactgataatagacgagcctctcatagacttcactgttttccaaccgttataaaataggaatatttgatcatattgatcagaatttcaaaaatctctgatttccaaaatcaatgatagcaagtctgatatcatattcgtgatcagaagccccgaaaacctccgagttgtcttttataacagaaaaagtcattctccagttgtaccccgtttcctgaggatttctgctttttacagcgaagcaaggttttaacctttttgagctgttgtagaatatcgacatcaacaccctcatcaaggaatgcttctctcacttgaactatcacatcattgattacgcctcgataagtgtcgtctttttattag

SEQ ID NO: 27012 - DNA, 2077 bp, Heterodera glycines
  misc_feature (2010)..(2010): n is a, c, g, or t
  misc_feature (2018)..(2018): n is a, c, g, or t
  misc_feature (2032)..(2032): n is a, c, g, or t
  misc_feature (2038)..(2038): n is a, c, g, or t
  misc_feature (2052)..(2052): n is a, c, g, or t
catgtttcactgagtgtttcactataaataaattgaacttttcatagaattatttaagaatttttattattattttttgcggcgattatgttctgaacgacgttttggggtgtatcctccaaaattaatatatatatatttttactgaccaatatacgtcaccaccaatgttgtaaatgcgggcacctaacacataagaaaaataattaattttaatgtagagtaaataaaatgattacctttcccaatgcatttacgtgcgtccaacacagcaccagtccgattaatattcggcaattggccttaatagaaaaaaaaatcatttaatttatttttttaaaatttacagaccaagacaaaaacggtcctcagcagtaggtgaagtatagctaaattttttaaatagaaatttaaaatttgttccctggttaaatggggtcatacttttatatgagttaaaatggccgaatggtttcgcagattaaccaagttaagcattagttttttttcaaaatcaaaaaatacgtttttttaatgagccaattattccctttaaaaatacaataagtgcattaattttccatttaaattggtgagttcagcatcacacacccgtcaataataagcgatggtttggaggcgtggaacacttcgccgacccgctggtttagctcatagtatgtgaccttgcaccagaacattggctcctcatattgaatgacggaaatgccattgggcagcgacagggacggaggtgtgctgcaaaaaaggttgtcagaaaaaatgattaaaatagaattctgcaaaatgccgatcattctgcctaatttgtgatgacggaatcagccaaaaaattcacttttattaatttttcgcacaaaaaatgtcgacttcactccctttatctgaacggcccattttccatattaaaatgttttggaaataaataaaccaaattagcaatcggatcgattgaattcgatcacaccaacgggaaaaaaacattgtatccaatcaaccaccaccaccaccaccaccataaccgcactgacttcggaacattttgttgttgttgctgctgttgccgtctttgtaccccacaatcggccaaatccttcataatgctgtcaaaacgggccgcttcataaatcatctggtaaaataaaattataaaaaatatataaaaatgatttatttatttgtcataaagaccgattgcgggtcagacgacttgtttaacacatcattggacgttgactgtctgttggagttgaatatgaactgatgcttaaatttaagattttaatttagtatttgcaacagatgtttcccactcccactgtatccatattttatattagaaaattgttgaattttacaaaattaaaatattgcaagccggatttcgcaataatttatcatttcaattagcaaccaagcaagcgccacctgttggacaaacagcggactggattggccacaaacatccgagcatggactcatctgttggtcaaaatcgtcggacaaatagccctgaggcgatcctgaagagcattcatttggcataatcaacaagtaagtaggggaaattgaataccaattacaatttttaagattcgtgcttatcattattgcttacccgagtgccagttggtaagattagcataaataaaataaaaataacatttctgcaaaataaatttctcaaatttcgattttgtccttaaagatcatcaaaacgagtcaatcattttgtgattaaatctagagctggtcgggaccgggaattttgacaaaaaaccgggacccgaaaagccgggaccaagtttttcgaccgggaccgggatcgagagaaaagccgagaccgggaccaaccgggaattttcccaagagaaaattttttgaaaaaaatttggaaatttgagtgaactttgttatgaaaattgcctatattcaaaaatgtacccataaaattttatattttcgttttgggggacgaattcgaggaanatttgtanaaatttcttcaggngggtgngaatcttgtaattntctgagtcccaaattctgatttttt

SEQ ID NO: 27013 - DNA, 247 bp, Heterodera glycines
ggtgtcatctatgttactagatcggggatcgatccccgttctggcgctcgagcaggacctgcagaagctagcttgatggttatcagattgtcgtttcccgccttcagtttaaactatcaggagtggttcgtaccgtgggacgtgggtgttggaagaagaacagggtgtggggagtatgagtatgatgttcaatatggataaaaagaaagagtaattaccacttttttttcctttcaaaagtgtagat

SEQ ID NO: 27014 - DNA, 1814 bp, Heterodera glycines
  misc_feature (148)..(148): n is a, c, g, or t
  misc_feature (168)..(168): n is a, c, g, or t
  misc_feature (200)..(200): n is a, c, g, or t
ttgtaatttggttttttgaatgttaaaatataaaagcttatttaaaatcgaaatatatttctgcaaaaactccccatccataattttattttacaatgtttggacaatggctagagaccacccaaaaaggcaccactttcttttgttnggcaatgatgaaaagagttnagagcatgagaatgaacaataagcttcttttntgaatcacatcacagaaatgccattttttcatatctgaccgattaatgacagtcaacaaattcaaacaatttaatttcatatttaaataagtcattaacagggctgtcaaaaatatgcaaatttttttttctggctttcccatgctctttatcagggttacccttgaaaatttcccgaaataagaacatcgttggtcaaaaataagattttagggtcaaaaatgaggacattttttaaaacacgcttccaaaactttaaatcgcatttttattcaacaaaatcaagcattactcaccgccaactattttctgacaaatgagcaatttcggcttaaaatgagaaatttatacatttccgaaaatcaattttaagattttaacaattttgtcgaaacataagcaattggtaaatttcagtgcatttaaaatttaaaaaaacatatttttaacaattttttcggcgcatttttccgaaaaatttttgggtatgggtgagggaagagagtccggcggtgtcgataggcgccgcggggaaatttttaagaatttttaatgaattttgttaggaattagccaaatttttcagaaatttcctcttttaaatgaaaataagacactaccccaaatcagaacatttcttagaaataagaacagatacagacagctctaataggcgccgccggaaaaatttttgtaatttttaatgcgatttcttaacgattttgttcaaaaaaagacaaaattacgattttgagctaatttttttaagagaataagaaaccgccgagagaaaaatttgaatatttaactgaatcttgtcaagattttgcatattaattcgcttcaaaaaacatttctttcaaaaattatcattaaaaatctaaatttctccctgaatccaaaaaataagatgaaaataaggacaaagagcttaaataaggacaaatcttacaaataaggacaaagggtaaccctgtcattaatttgtcttcaaatatagcagtagaaaaaagcccctggggattcaagagcagaatggatggagggcggtaaataaaaattttaattatttttcgcattaatttaaaagtgtcatttaaattttacgcaaatgccccttccccttattgacagaacaagagtaaagcattgagagcgaattcctgtgggtttcaggagagaggggcaatctaaaaatttgacatttaaaatttttttttaaatttttaattgtctttttaatttgcacaaataccgccctccccctccaaccccacaaacatggcaatagaagaagaaaaaaaggaattaaagcagcgaacccccaggggattcatggcggcgcaaaataaaaattgccatttttcttttttctttcttttcctctgcaatgcgatgagttgccaatgcttaaattggttctagactttccaaaaatgccaaaattcggaaattggcgtggtaccccgaccacaaaaaaaattcttggaattataacttggagtgccgacctcgtgccccttaaaaatgtaactgacctttcgacccaaaatgcagggatcaggaatcggggcaaggcttccccgaccccccaaaatgccgggattcggaaat

SEQ ID NO: 27015 - DNA, 1078 bp, Heterodera glycines
  misc_feature (105)..(105): n is a, c, g, or t
  misc_feature (1045)..(1045): n is a, c, g, or t
taatcaaaaagttaaaatttatattttttattttatgatttaataagctccaaaaataaaattaaaatattttattatcaaaaaacttaatttcatttcatattnaatgattaaattatgtcaaaaatttttattaatctcaaatatttaaaataaccatttaaaaaaaaatttatttagatttacatttaaactccaaaaatacgctcattggaaattttattgcctaatttgaatttttttttgataatttgttttttttcaccctttccattgcaattgccactgattttcgccgttgctgttccctcaattgtgccaatctaaatttattcatttttttaaataccaattttcatacattatttttctcactttatgcgtgcattttttgacattgccgatttacgcaccaccgcctccaaatggcgctatttaaaaaaaaaaaattagctgtaaattctaaaatttccttaccgtactgctggaggggctgcctgatgttggcgagccattagcggcatgatgatttcccattaaaaaatttaaaatctaaaaatttattcattcaacaagagagcagagtacaattagaggaaatgtttagtgggaggggggactaaagccaatccatccatacccaactcactcatccccaattcatcaatgcccaattcatcaatgcccaactcactcatccccaattcatcaatgcaaaaatgtcaccgacgcgggtcgcgcaatgcaaaaaaaaaagaaatgccacgacgacgacccacttcatgctgtggatgaattggtattgatgaatttagtttggatgaatgggggggggcatggtccttgttgttaaggtaattccttgtttaaaaaagagaattccaaaatagaaaatccttttttgtccctccccacacatagataaaaatgttaatttgttggccattgaaaatgtgaaagatgaagcagcagctttttgcccgcgggcggaggggaggggggggggcaaacttattgaagcattggcgaaacatgtatacgacanaaatgtttgggggagcgggggggaatccaagct

SEQ ID NO: 27016 - DNA, 1372 bp, Heterodera glycines
ggaagaaaagaaaatttctagaaatggccaattctaatgaagccaattagggcaaacttaatggattatatcccagacaaaaagtggctgattgtgagtctttcggtttctataaatccctcataattgaaagatatgaggttcgcaagtgctaatttgatgctgccgctaggaatttttggcacagatgcaaaaaaacaaaatgaaaacagacccttttggatgatcagcttagtccccaaagccgattataaattggaacttcgatattagcttaacaaagattttttatactaaaagatttccttaaaaaatgattattcattttttagcatgtcaatggcaatgaaaaactgcaaagaaatgccgatgaaaaatgcatgccaaagggtcgtggaccgaagaaggagggggcagtacccgccaagaaatggtcatccgctttacgtgtggtcgctgcgatgacacgcttcaaaaacatcccaagggtgggcagcatggaaatcactttttgtgtgaaattaattaagtttaaattatgaaattaatgaatttgaaattatcaaattatttaaattatgcaattaattacataactttaaatcttcaacaaatttttttttattacatttggacatgtggaaaaaaattttaaattttaattgtttcatatgcttttataattataatttacgaatatgatttaattaatttcagcaaatggtcggatttccttattttttggtctcttttcccatttattaaaatatcaatttatttttggcattattcatttaattgtttatcctgcccacttaattagctgatgttttggtggtgttttccaaatgtttttgcgccacgctatgcgccgtgtttggataattgccgcaaatgccgcaaaaggcacacgcacgcaaattggcatcacaatgccaaattacactttttttttattctaacgtttgttgacgtaaaaaaacgatattttagttttttttagtttttttctcttttatgtgcgaaaattacgaaagtgacatttgctaattacatttaggaaaattttctaatagattaattccttttttatactattaaccactcaatttctcattttatttaattgttttctccttccatcagttttcttttcacgcctcctcttttttctttttactcatttttaattaattttttagctattttttaatttaaatttccattcccttccgtaatttatccgtccgttgtcctcctcattttggccttcctccaattttacttttctgcgatagcctttggagttccggccacatttcgtggccattggaagaatttgtcgtcccattccgcccctgtcgcccccttt

SEQ ID NO: 27017 - DNA, 1689 bp, Heterodera glycines
tttttcgaattttgttaaaatatggttagagttcgattggattaaatggatgtcagactcgtgatcggagaccgaaaatttgacattataaaaattttttttgcaaaacaaaagggtccccccccgcctactttttcgaggggggggggataaactgcacaattgccgtaatagatagaaaaaggcggaaaatgcaaaacccacttattttagtgacatataatttgaccatattggccccaatgtcgtccatcatttccaccatcaatttgaactcgtcttcattgctcagaaggattcggtcgccggagaaatcttaaatgaaagatttctcgttgatacaataaaataccaaatgagaaaatagaaaaattagtctggtttgtaccccccatttttggaaaaaaattacaaaaattttttttgctataataataggtgctgatcatgaatatggcatccttttgggccaattccgaatcccggacccgaactcgaacaaaaagtcgaaaatccaaattttcgaatttcgcatttttggttcaaaacaaaaatcggtttagatatttttattggaaggtttgtggttttcaaatgtttccatgtgtttacaccgggaaaaacccaactcgaactaggccaactcataatgccccaactcgtactgtttttgacaaaaaatcgtcataacttttgtaaagtcgaccaaagtaaacattcgtggtattttcgactttttgttcgagttcggatccgggatttctgaattgcccgaaatggatgccggattcgtgatcagcgacctcgaaaagcccaggaaggggaacaaaacacagtattaccaaaagttcaaatgtttgatttttgcacttttcgtcggtcgcccaattttgcaatttccggcacagtagaaaaaggatcatggatctgatttcgcatttttgcaaaatcattgactttaatattttcatcaagttaattttcacattgcggaaacaactcgtagccaagcggattgaatcactgactaccgcctctggcctttacaaatacatacataagtaatcaatagttaattaaattccaaaaaccctaaaaattcagcttcttcattcatttatgtatgaatagggctctaatttttagtttttttatctacagattataaatttttagaacaaatttatttatatacacaaaaaatagaacatttctcataaatcaaaaatattggtaatagttcagtttgtccccccccccttttttcgaaaaaagcgatatgtttttttctcaaagaatgttaaaattgatattgggaggcctgaaatataacagatacatttttaaacaaataaattgtaactaatattttttgacccaaaaatctgatttcgaaatttttcgatgattcttctaatcatacccaaaataaaagctattaaatttatcatttatttttcagtttttgatgaacgtgctcagcgcctcaaaacacccctagaaacgtgttataagaattttcagaaaaaattagagaaaaaattttcgggaccaataatctagatgattgccccaaattggacaaatttggcatcatttgaaagctcttgaagaaggagaagctttttctaattttgtttttgaataactcatgaaaaagtgtataaaacataaaatgactggattact

SEQ ID NO: 27018 - DNA, 1341 bp, Heterodera glycines
ccttttccctctctctcttttcatttatatttcttaatttcggacttttgtccctctccatccgtcactcctcaaattgtattaatcacttccatttgccattttcccattcagccaatgtttttgaagctgtcccccctctctttgcttctcttcctttcgctccttttgctcatttctttcgccattggctacagccccgtgggcaatgccaaaagtcacccgctgaaattgcgcaaacggatcagttacagtgacggcggagtgatggcactgaacagcgcggcgcggaagacgcgaatgccgacgcgcaaaatggtggagaagccgcggatgcgctttaagggaggtgagagaatctggggaaagccggaaatgccgtaatcagccgaaggaaaaactgatttaaatcaccattcggtccattgaatgatcacctttttctctcaggaagcaaattggcacccaaacacagcgcagtgacgacacaacgccaatgagccaatgtttgaattcggaaggacaacggcacgcacagagagagaaagaaaaatcagtcaatggcaaaacattggccaattcctttgcattttgtatttatattcagagaaaattaataataaaaaattaatatttgaattcaattggaaaaaatcaaaaattttattaaaagtgattttattacatataatacaaaaaaagaaagaaaaaaatgggactaacgaatgctaacaaagaattggtcggacgggagcatcacaaagaaatgaattgtgagcaaaataccctttaagctgtggattggtaaataaagtcgagatctcctttatcccttttatctcctttatcccctttcctcctctccctctctctctctcttcaatatttcttttcaccctctctctcttccgccgtcttcttctcatctttcttcccattttcattgctttcctttgctttttcgcgcactgtgccaatggattcgattgtggcaattgtctgacatgaggagacggagcaagtcgatgggccacgtgcccaactttggacatcggctgaaccccacctgaacggggcgcggagtttggcattgtcattcattttcacccaccaactgaacacaaccacgggaatgagggcgattacggtggagacgtagaagacaatgttccactcagtttgggtgccattctaagtgggaattaaaatcagatcatttgctgattgtgatcagggaatgatcagacaataatcactgctccgattagtctctgataaggcaattccgaaatcaccgtctattctgatcagattcatatctgatcagtttctcattttgat

SEQ ID NO: 27019 - DNA, 951 bp, Heterodera glycines
aaaccaggttcagaattcaataaaaataacattcacgttgcgaaaaatggggtatgaaaagtttattggggaaaaaaagactttacaaaataatacccctgggagaagggagtgggaaacatgatttcaaaattttcaattttttctagtctaatctactcaaaccggctcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggctcagaattcaataaaaaataacattcacggtgcgaaaaaatggggtttgacaagtttattggggaaaaaagactttacaaaataatacccctgcgagaagggagtgggaaacatgaattcaaaattttcaattttttctagtctaatctactcaaaacgggtccgaaattcaataaaaataacattcaccggtgcgaaaaaatggggtttgacaagtttattgggggaaaaaagacttttccaaaataatacccccctgagaaaaagggagggggaaacatgattttcaaatttttaattttttt

SEQ ID NO: 27020 - DNA, 1797 bp, Heterodera glycines
aatctactcaaaccggttcagaattcaataaaaataacattcacggtgcgaaaaatggggtttgacaagtttattggggaaaaaaagacttcacaaaataatacccctgggagaagggagtgggaaacatgatttcaaaatttttgttgaaatatttgtcgtgctctgaagggcgtgggaggggggggggcggagggcccccccacggaggccggaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacctgaaaaaatcgattttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaatttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccatta

SEQ ID NO: 27021 - DNA, 1686 bp, Heterodera glycines
  misc_feature (42)..(42): n is a, c, g, or t
  misc_feature (53)..(53): n is a, c, g, or t
  misc_feature (87)..(87): n is a, c, g, or t
gaagcaatgtatgtgccagcatcattagtaaatggggatacngaaatatgaanggaggttaagaagcgagagcagaggcgaaatgcnaacacaaatgtaatgccaaaattgtaattttaatttttttattaaatttaaatcctttcaggatttggccaactgttgggcaaaagagaacagcagatgaactgatgaacactttttttcccattttcaaccttgtatttcctagggattattggatttggaaactttcatatgtttattctcctaaattgtttattttttttgttgaaaattctcttttacaaaaattttttgtattctaaaaaatgttttggctgaacacagaagccctggggggcttataatcgagtaaataaggtatattatttaaatttactgggactgcccgaagcacaaacagcgcgaaaaatgaattatgaaattgtcgattgcgacagatcgccacaatttgcaaacagtaaattaccaaagaaggaatactgatgcaaaatgagaaatagatgaacacattggtgtattggagaatggattcaatcatcggattattttcagataatttatttcactaaattactttttaattgcattttttttcatttcaacatttaataaagcttggattgccatataaaataaaagttgtagcaagacttcataaatgtgcaattatcagatatttaaagaaaccagcacaaatttggtattcgaaatggaagaaggatttcaaaatgctttgtatgaccaatactgaattgcagcaccctctcatttctgcgttgtctctctcccaaatgatatttcccgccaaaagaaattttaaaaaattaccgaaattttaaaattagcgttcatttatacgttgttggcaaaatgcacattgttaataattaaataacaagttaaaggttgatctccgatgaaaaaatttttttcataagaaaaagttgttttgcctttctctagtccctatgcataaaataataatttaaaactaatatttgaaaatcaaagtaccatactcgcagaatttgaacctccggggggttctatttttcaagccccctcaaaaaggggttctaattcagtaaatacggtatatatgtcggtcagggtcgttttcgtaccgccgttttcgtcccgccgttttcgtacggggacgttttcataccgcaggggggtcgttttcgtacgggggacattattttcgtacgagttcttgtacaagcgtcagattcaaatagaaaaacttaagaactaataaaaccaaaatttatcattttttgtttcccattcataaaattttgtagaaaattcataactttaaataataacaaaatccgggacaaactaggtcgcatctcataatttcggaaaataccagcgagaaaattgttaaggttttcgggattgacattggcattggcataattgtgatcattttgagggacaatattgttattgatatcgttatagcgttggacgagacgaagaatccgtgcgtcggcatcgcgatacttctttttctgtgcaccatcatgcaccaatttatcattatttagttttgttttaattacttgctgctggttcattttgtagttaataaaagcttaactgtcaaaacattaaaagtaatttaaaaaatattaacaaattatttga

SEQ ID NO: 27022 - DNA, 859 bp, Heterodera glycines
ttaatggggctaattattttcttttttaggacccgagcattttcactgtgctcaccgtccctggccttcgtaagggcgtcgcactcgccgattttgtcattttcccgccgcgttggtccgtcgccgagggcactttccgtcctccttatttccaccgttcgttttttgggcctttctatccgataataagcaaatccaggaaattgtatgagcgaatttatgggtctgatcgttggccgatacgaagcgaaggagggtgggttcagcgcaggaggcgcgtctctccattcgatgatgacgccgcacgggccggacgcggcgtgcttcgaaaaggcgtcgacggacaaattgaacgccggaaggattggggacgggacaatggtggactaatgagggaaataacgagcaaggagcgacctaattaaggcttttatgttcgaaagttcgctcagtttggttgtgaccgattgggccaacgaagaatctgtggatgagcgataccacgaggattggcaaccattgaaaagtcattttgagaggagcaaatgaaagaggacaagccaaggagagagacaggaagagtgagagagagagaaaaagagaaagaggggagagagagaaaaaagaggagagagagagtgagcaagagagagagagaaagaaagagagaggagagagcgagagaaaaagagggagagagagagagagcgagaacgggggttaattagcgacagttggtttattatgattaatgtacgaacgaattaataaatgcaaattgccatgtcttgatactccgcattggctgagaatgacttcattttgccttttatttcggccatttttctccccccccccc

SEQ ID NO: 27023 - DNA, 989 bp, Heterodera glycines
  misc_feature (32)..(32): n is a, c, g, or t
  misc_feature (909)..(909): n is a, c, g, or t
tctgacataaaattgacaaaaaaggacataantcgtttcaaaattaacggctgaatatgaaagcgcttaaaaaaataaagaaataaatttaaccgtaataatttttcgcgaaaaaaggaactaaaaagcaaaaatttcccacttttttttttgcttatttttcgtaaaatttgttagtttttaagaaaatttcaatttaaatttcgaaaaactgtttttttttgaagattttcggatttttttgggtaaacaggccaattgataatgggaatttagatatatgtagaactacatccttgaataagctaaacatgcttttcgtgcgtctcatggctcccagagcccgcaaaaaatagtgaattctataaaattattttacgcccaactcataaaataaataaataatttctgagacatttttgaaattttattttcctaaattgttgaggacagcagctttttgacggatagtgccgatgaaaaaagcagttttataagcagcgcagaaagtttgctgatgaaatcatttgaggcgcttcggaagagtttttgtctgcccgaattgggagagaaaggggagggaagtgaaaatagaacagaaaatggagaggaaaatgaggaggaagagaaagagacggaagaggagaaacaaatcatacagaaatattgtgagcagttgaaaaatggagacgaaactgcggaaaatgcccacattttgttcaaaatcaacataataccactgcaaagagatggggtaaaaagccaataaaagaaaaagacactttaaaaaaatttaattttaaagaaatttcataaaaatttttgcaaaaaaatttagggaattttatgcaatttcttttttttaaatcttatttttataaaatttgtattaaagtagaagtgtacggnaccgggactggtactgaaaaaacgggtacaactgagtacccagtcccccgtttgaccattttgaccgggaccgggaaatt

SEQ ID NO: 27024 - DNA, 1551 bp, Heterodera glycines
aactttttgtgagaattacgaattgaaactgtacaatcatttgaggctgaattatggagcacatttggacaacaatcatcacaaggaaaagttccagggaatatttgttgaaatggcacttcaaaatgccaactacgcatttcggcacaattttgacacatttttggcggaaatgctcaaaagagcggaggaagggtcactatacttcccaattctgataaccgataatgacggttcattgatgattgaacagatggcgtttgaatcgtactttttggtaatttcttattgaagcgaatattttcagaccggagagcgcctatttgtagaatttgttagaggtcagccctattttgaacaattttgctgcgatttggaaagagatggtaaattgagggattttgtcatggcccaagaagccactctcgaagaaaagcaaaattatttggcaaaacaatatgagacttacttcggcattttgtatttgatgcgacacaattggcattgtgacaaaaaaggggaggaaattggggaagaaaaaaggcggacaaaatgcgaaagatttcgcaaatacacagacattgtgtacgaatatttgttcaaagtctatgcaaaaagtaaggaaggaattacggtagaatataatgttgtttggcatactgtaggtttaaaattaaattattatttttaggaaattaattaattttttcaaatttaaagctgaagagcctttgttgggtcagcaattccccgtatttaaaccaacgtttaatgtctcaacattaataaatgaagtattgctttatctgcacaaatgttcagtgttattttttgacgaggaactcagaaatcaaaattattatatttttaaaatacaattgcaaaatgggcacaaattgcgcaattataaggctaattttggcactttggaagaatcgctgcgcaaaaaatttgacaaaaaactgaaaacgatgcttaaaaaggcgagagaaaacgaaaggaggacgagagaatggagtgccaattacaatgacagcagcaatttgctgagggaatcgcccttttttcacagagttttgcgggttcgtttcaatttgcgatgcgcgggacagactttttttcgaggcccgggaaagagacattttccaaaaacattccgtaaaacttaaagccttgcaaacacttttcgggaatgcacccggcacggatttcatgattagaatcatattttagggtcctgatccgggtgcatttctcaaaaactacctgggtcaagatcagggttcccaggaaaaccctgacaagatcctaacctgtcaacttcctgttcacccggtcggtactagggttgtgcgagagtctcggttcttggttcacgactcgggaaatttctcgggtttttcgcttaccggtctcggttcccggtctcgagtttttagtctcggaaactgagaaatttttacactgttaaggatgaccctttcggggagtgggggtcgccaggaaggggaaagagagaaaaaattattaaattttgaacatattttttaa

SEQ ID NO: 27025 - DNA, 1371 bp, Heterodera glycines
  misc_feature (957)..(957): n is a, c, g, or t
gacaatgggcttacaaaggtattgcaaaactgaacctgtgatcatgtttttgataaagtcgcgatggccaggagcgtcaataatggtgacatagtacttgcttgtctcgaatttccacaaagcgatgtcgatagtgataccacgctcgcgttcggctttcagcttgtcaagcacctagaaaagtatattttaacgtgaacatgattggattacgacttacccaagcgtacttaaatgatcccttgcccatttcctgagcctccttctcgaatttctcgatagtacgtttgtcaattccaccacatttgtagatgagatgaccagtggtagtcgattttccggagtcaacgtgaccgatcacaacaatattgatatggatcttttcctttcccatttcttttgcgggtttgaccgtgtgaaagacgaacgaataacaagacaaattttcttagcttaaaaaacaaaaaataattgcaagtgcatgtacattcatttacgaaaattctttacacaaatttttcggcagaactcggcagaactcaacatcctaaagtaacaataacaattttggtttttcgaaaaaaaggatggactaatgaaaagataaaatctccctcctatccaattcgtttcactagtccaacgccgaaaacgaacacgccctctccgcagtgaatatccccaacttgccacattttcatttttttaacagaaatacagttttaaatcaataatcgagaaaatgtattaaagcgaatgaaaatcattttataattcaatttttaaaaattctaataatagatcctttgagaatttgaaccgaaccggaacgtgatcggaattacgcagagattttcccggaatcccggcaaaagcgggattttaaccccagtaatcctacccgactttttcaaatttccgggctctacataggatagagtaggaccgggaattttntaaaaacccgggaccggggccaggatcttcaacatggattgtgactcctttttgtcccggtcactttttttttgtttacttatgagttaactgacaaaatatattttcaataaatttaagcatatttatttatttaaaatgtcttcgcataatacttcagttattgatgaaaatcgacgatggagtgacttacgctgtttaacagatagggcgtctacatttgccaattcaggattcgtccctggaatcaaggtaaaattttgtgtaatagtttagatggtaaccatcctttttcaaaaaaaaaaacatttttttctcgagattgttgacttttagtttgtttccctatatataagccattttaagaccaaaaatgcgaaattcgaaaattgaatctccgactttttgctcgaa

SEQ ID NO: 27026 - DNA, 825 bp, Heterodera glycines
gaaagtgaactccgcttcgcttttcaaaaccgacgtggcggtagatggcaaagaaatcaaattcgtactcgacagcggggctgaaataattgtgatcgatgaactatcacatgaagtcatcggcagcccccgactccgcaaatgcaccgaaagtggatgcatgttcgatggaacacaagtcaaattcatcggaaagggagtcgccaatttcaaattccgcgatatttgcatcaaaagcgaatattatgtggcaaaaaggggatcgctaaatttgctaagtgtgcaaatgatggacgcttttggactcctgaacgaactcaaggccaaaattaatgcgccagtaaatctgtgccgagttggagacgagacaagaggttttacaaaagctccaaaaccgtcacaaaatttgacagtcaaagcgcacatcgaccatctcaaagcgacatttcccgacattttcaaaaacgaattgggccgatgtatgaagttcaaggcgcatctgactttaaaagcagacgccgcaccggtctacagaaaggctcgcccagtcccatacaacgcacaagaagcgattgatggagaattggagcgatgggagaaaatgggtgtgattgggaaagttgaatacaccgaatgggcagctccgattttggcggtgaaaaaggccgacggaagtgcacgttttcgcaaatcgacctcagggatgcatatctccaaatcgaattggatgatgaatcgagaaaactatgctcgatttcaacccatcatggcaattacgaaagtaagagacttccttttggcgtgaaaatcagcgcagccatcttc

SEQ ID NO: 27027 - DNA, 1253 bp, Heterodera glycines
  misc_feature (1167)..(1167): n is a, c, g, or t
ctgttagttcaaaagttataggtagggcgtgtaattatatcgtatataaaatcgcgaaatatggccataaaatatggaccaaaaatcgcaaaatatggacataaatggaaaaaatgtcaaaatatggacataaatttctcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaaacataaaagctaaaatttattaattttttttagcgcaaaatcaacaacaaaagcgaaattttcgcttttctgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggacaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctccaataatccaggaaaaaaatatggatttccatataattacacgccctagttataggacaaacatacaaatatatttcttttcctctcattttggtgtatcattttcatgtctctaacacataaaaaacatgaattcgctaattctaataattttcgttgcaagggtacaaaatcactttagacttttagaatcaatagaaaaattattagtttttatttagcggtccatgacctgagttataactagggttataagttgtatgatttgcatattttttctgcgcatatgctatgaagaaaggggctcaaaaatagcattcctgcgttaaatttttttgatttggtaaaggtttttagtaaagccccgaattttgaaagtaccgggaccgggcttatttgaccgggagggccgcccgttcaaaaaagcccatntttaccgggcgtcccgggcccgcttttttccaaaaaaaacgggcccgggcagcccggtaaaagcccgccgggcccccgggcccgtc

SEQ ID NO: 27028 - DNA, 838 bp, Heterodera glycines
ttttagttcggcgcagccgatagctgcgctgaagaaattttgaaaatttgagggaatttgttgatagattttgttgaaaaaattaaaataaaaaataaagtttttgggtctttttcttctcaattttccatgttttttccaacaatgttctaactttttttttatgaaaactttaaaaattcatcctcttttatgacttaaaatattttaattaaatttttcaaccatgtttttataattatttcgaataattaattggctacttttttaaatccaattttatatttttgtcagtggcagcactcacgttcaattcgaaaacatctattgcactttccgctgaggagcaacaaagtgccggtgccacgctttccggggatcagttcgagcgccagttaaaagcaatggttgaacagtatctccgagcaacagacattggcacgctcaagcgtgtaactgattgtgcgtttttttgctaattattattattattattaacactctaggcccgagatttgaacatcgcctctctcaggaacggtcccaggatttcggcttggggggggcggtacctcccctcgggcgacgaccttttattttgcggcggtttttccaaaaaacattttatggagtcctttcatttataatgcgatttgttaatgaattttgtccagaaaatgacaaattttgcgattttgatccattttagcagattttcatcaaaaaattgtggatttgttgaaaaaattagagaaattttttggaaaatttgggtgaggataagtctggggggggggggtaccagcaaggaaaatctaaaattttcagcaaactatta

SEQ ID NO: 27029 - DNA, 1054 bp, Heterodera glycines
tcgagcgcctttttaacgtataaaatttttcaaaaataagagatagtcattttttctgggatataggataaatttaaaaattctttgggaaaataaatggcgattgcgcacccccctccctttcacgctcgagagcttttgtaacgtataaaatttctcaaaataagagatagtcattttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctatcacgctcgagagcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagagcatttgtaacgtataaaatttctcaaaataagagatag

SEQ ID NO: 27030 - DNA, 290 bp, Heterodera glycines
cgctgcggacatctacatttttgaattgaaaaaaactttgtaattactctttctttttctccatattgaccatcatactcatactccccccacccttttcttcttccgccacccacctcccccgctacgcgccgctcccctccccttcgtgctccaaccctctcctccctctcttgatagtttaaactgaaggcgggaaacgacaatctgatccccttcaagctagcttctgcaggtcctgcacgagcggccgcccggggatcgacccccgatctagtaacatagatgac

SEQ ID NO: 27031 - DNA, 1690 bp, Heterodera glycines
  misc_feature (24)..(24): n is a, c, g, or t
ataaagcatttatttattaatttntggcgaaaattgaataaaaatcgaaaaatttccattttttaacttatttttgacataaattaacaaatttttaagaaaatttaaattcaatcattattttgacaaaattttgctaaaaaatgtctttttcggaaattttttcggtctttaagagtcaaaaatgccaatttacctcatgggggccgttttaataggggttttttggaaaaatgcccaaatatgcacataaaatatgcatgaaatgccaaaatatgcacaaatatgcaaaatatgcatatggaaagtcatcctaaaagcttcaaaacaagctaaaaacatgtttttcgtgcgttttaggcctcccacagtccaggaaaaaaatggatttccatataattggactccctactaattaggtttgacctttggcgtcgttcgtatcaatttcaattactctcgcataattccacaacggctcgccaaaaattttcatctcaatctgtttactccttaaagaataattaattatgataagtagggatgcgatttttaggcacaaaaaatcgcgaaataggcacctaaaaaggcagaaaaaaatcgcaaaataggcattaaataggcaaataaaaatttaacgtttttaggtagcaaatcacgtaaaaacttaatcaaacaacttaaatttgcttcaattggtttaaagtttttttcgaataaggacaaatttttagtcaaaaatttttatcataaataatattaaattggtggtcaattttttgaaaattttttcaattcttaggggtgtattttctgaattttttttgatcatttcatagggatgtgtttttcgtttttatcgcatttttgttaaggattttttcaaaaattctaaaatcggcacattaggcacaaaaactccaaaaaatttccatttgagggggtggtttttgacaaacgtcccagcaccgttataatagatgggaatacggtgttacaattaataaacatttacagtagtacccttctgccggcgtattgttatcaccaatgaatggttgtttataatcaaaatattgtttactgtgcgggtctctaccacattgcttttcactcttgtaagtaaattgtctaaactcatgatgcacaaatcgcaagcgtttttccaactctcgtccaaaactgatcagtgcacagtccatgtccgcgttgctcacttttctattgttgttgttaatttttatgcagattaattggattaggtcagggccgataccggggcgatataatcactgtctgttttcaggtccccgtacggaatctatcggtcagcaccgttatcggtttaggtgaaatttcttgggttttagggtagctgtctcgactctcggtcatttaagtctcgactaaacgacgaaattttgaaaatattaatctacaaacaaacaaaaaaattgctaaaaagtatcggcggcgcttaacatatgacttggccttccgcgatgcgagatccgcgacgtgtgatttttctgtccgcgctccacccctggtaaccccatccccatcaattaccctgctgatgatattcttgatgacaaaagtgcaattaatccgtgatcatcgcttttatttttctgaattaatgcgttgtcttcgcttctgtttttcagagttgcgttcataattccct

SEQ ID NO: 27032 - DNA, 1729 bp, Heterodera glycines
tgtcaaattccctcctcaactgtcgtgtttccgtctgtgcccctgtccgtctcctgctgtgcctctgctagctgttcctgcagttgctccgctctccgccgcgcctctctcatttcgccgcccattcgctccttttccacttccaattgtttcacttccttcgacaacatttgatgccttaaaagggaagtggagatgcgttggcatttcattttgtctttgctgtgccaaatgctctcacttcagtgcctccctttccgcctccaattgcctttcgcgttccatccgatgggcgagttcccgcgacttggccttttcctcctcgcatttttctgcccacctgaaacaaagaaatcggttgaaaaaacattacgaaatgtgagaatatcttgcctttgttcggtggcatgcaaatgctcctcaagcaaatggactctctcctgcaaaacggcgttgtctgtcctcagcctaagcaatgaaatgggaatttagaatcaaattaaaagaacattctgcggaccgtgacttttcttcactgatcatcattttctcctcctgcaattcggttaacttttgtgccaaaattgacatctgaaaataaatgatcaagaaaatgaatccatttgaattaatttcatttgcttttgacctgattggtggcatttccgaagtccgtactgatggagtcatggtcattgaactgcatcaattcgggctctgagctgaacgaatttcggcgcgaattcagccgaccgttcagataaagtcgagaagccacggaggaggaggaagacggcaaagtgccgttggagagagagggggaaggctcagcctgaaatgggaggagacccagaattaattcagctgccacaatcaaattaagaattcaaactaagtttttgttgataataaattttccgaattggtaaatcttggaatcggaatccaacgaaattcacaatagtatttttgattttgatttttaagtatgcgaagaagtccaagcacctctaagtagtccattggccgcatacgcctcaattggtgctgtcgttgtaattcacgcactttgttcgcaattttgagactttcctcacagaaaatcacaattgaataacggaagggaatcttgaatttggcgagttatgtattcatttgtacaacacattcatttaaggagttgcaaaaaacggggcagaaatgcattcagaggcaaaatgttcccaatcagtgggaaattgtcgcctcttttggtaattgtacatttaaaaaacatcaatttagagggaaaaaaagaagagaaactgcgcagaaaccatcaaccgaactacaaaaagttggagtaccaagagcgaatgcatgacgaaagaggaaaatcaatgaggggaatggagagatttaatcgatcagcgtggatttgtgggaaatggtcggagaatccggatttggatgagtgggaaaaaaaggtgcgcgagaaaaactcacagacgagaagctgattgaaggacggataaaagaatattggcactatttacaaagagcactattttgaaaattttttcaacttttttttggtcaaatttttttttgtttaaaaagtcctgaaaccaagtacccgggtgttttaaaggtcgctgatcacgaatatgacaattatttgggcctattaagcaaacttggcgctagttataaagtgatagattttgaattttatcaaaaaccatagggg

SEQ ID NO: 27033 - DNA, 994 bp, Heterodera glycines
accctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaatcacttgtatacgacttgctactggtcagggggtgttagcagtagagcagcttttacactgcgatctgttgagacttag

SEQ ID NO: 27034 - DNA, 781 bp, Heterodera glycines
ttaattagtgggtttttttcccattcaggttcaggccgtgatgaatcgtactatatctttatttattatcaattttattacataccgacttccactttgtaataaatcccgattgcttttttatcctgactagagaaccgaccttataggcgttattttttatatttaaaatagaaaaaaattttatcatacattgttgaatttattgtatttatagattgtcaaggataataataaaaagtctcattttaaataattttatatttttattaaccactcaaagggtcatttttcgagaaaaaaataatatcacaagaatattaaaagaaatgctcacgaattcaagtatgcaatattaaaattaatgaataaatataaaaagaccgattcgtcagcttatataaaatatgcaagtgcccaataaaatagcaaaaaataaaaggtttgaaaattaaaaaataaagaaacaaaataggcattatatctccattctagggtaatgcaagaaatatgtgcccgatgtttacaagagataatcataaaaaaggaagcagagtgataaaaccaaaaaaataataataatttaacaaagattaataggcaaaagaaattcctatttaatcaaaaatgtgtgacaatgattttggaagcttatttaaataaacagaattattatctttctttaattcgatttgtccattattttaaaaagttatattaaacggctcccggacatttcgaaaatgaccgtttcgcaaatgaccgtttctacaataccttt

SEQ ID NO: 27035 - DNA, 874 bp, Heterodera glycines
ttgttttcacgtaatttctgcataaaatgagattatttaaaattttttattttgggtaattttcacattcttgtacaacaagtaattgcttaaaattctttgcttgtcttataattaaatattgattatcatcttaattcatatcaaagtaaatgcaatttttattaaatttaaagataacaaaaaaaacagaaaatttaaatgaacagtttttgttaaatcattttataagttattaggatgaaataattattaatttgattgctgatatctcaaaacaaatttaaaaggttgtcttaaaaaatttctttaaaattttaatgcttatgttatcaatttttgttatatcatttgaattcatttaaggttatttgaataaaataattttttaaattttgtatattttgaatatctaaatttttaaatcttttatgtatgttattacaattctcgtcattttgaaaacatttttgggaagttcctattacgcatacagaacacataatgaattatataaacaaaaattttttatgttttttattttttggaaaaatctttttctgcgaaatattttcttacatttaaatattttctgtcgaattttttccacttatttatttatataaactcgcaattttagatcatttttaaatatttttgatgataacaattttattactcttaaaacttatgatatttttttgattttcacatttattttattaaaattatattttcccatctattttattataattaattttttatcattttaccagttgaaaaattattaaagcggattgacgattcatataaatcgtaaaaagttcacattgaaaatttttttaacattttataaaaaaacatattaatt

SEQ ID NO: 27036 - DNA, 812 bp, Heterodera glycines
tttgctcctaaattagccaaaatgcatttttatggcctaatttaaggtgctgaactcgaaaatatactttatttttggtttcagactttttggtaagtgtttaaaattttttgaaaaatcttcaaaatttgagccccggaaaatccagtgaaattttgaaaattcataactctcttcgtttttggtcaaatttagtggaataaaatttgaaaaatagcaaaaaattaggagaattttatgagatttatttggaatttctatcttccaaaataaaaaagttattccagaatttctggaaaaattcgatttttcagaaaaaaattcttaactcccttctgaaaaagtattttataaaaaaaatatactcaaaaaatccgcaattttttgctctattttataaattttattttagctttttatcacttttttgaaaaaagttatagaaataaaagtgattttggaatttgggaccacaggggtgtgaccatgatttttgagaggaaaattttttcaccaaaaatcttccaaaaacatgtctttaggggttatttgggccgctgatcacgaatacgtgatcagattttacttttgacatagtcaacacctcagaatccctgtgtgattggggattctgaggggtggggcggcatgttcggacccaggccgtgtttattatttattaaaaaacgggcgcaaagcgcccgtcctgaggccgcgaagcggccgaatgtccccaaaataattaaaagacgggcgcgaagcgcccgtcctgaggccgcgaagcggccgaatttccccaaaaaaattaaaaa

SEQ ID NO: 27037 - DNA, 704 bp, Heterodera glycines
  misc_feature (70)..(70): n is a, c, g, or t
ctatcaattcgttgccgtacaaaggaaatgagcgacaaaaaaccattcttgtctcgaggtataacatttnggggtgacattaaattacactgccagaaacttacaattagcaaaactaaaactattttgggtcccacgccggcaccgtctccgatttggtcaaaagagcctttgccaatgattcggctgccttcgtcgttgaaccggctggtggcgcgggatacaaaacacttcggttaatccgacaaagcgccggtcggtcggtcccttccctttcgttttcctgccttagatttcggcaattgtgaagatcattggtcccaaaattttttaatttaattttttttttatcttaaaattttttagcacttttccaggggtgttttcaggagctgagcacgaatccggcctccatttcgaccaattccgaatccctaacccgaactcgaacatttttcgagaattaaatttaaaattttttaaaaatttcttttaaaacatggttcttaatgttttcggagttgctgatcacgaatctgccattcattttgaccaatttcgaataccggacccgaactcgaacaaaaaatcgaaaattcaaaattatcaaaattcatttttatgttcgtatctttacagaatgaccattttttggatttgaaatggtttttatctgaaattaacagcaccgaaaacactaacaa

SEQ ID NO: 27038 - DNA, 1094 bp, Heterodera glycines
ctcggtaagggaaaaagagaggcggtaccccccccccccccccacaagaccaaccagcgccccagagagaaaaagcaatgccaaatttaaattaacgccaaattatcataacgaaagcaacatattaattttaaattccaacgctaaattacaaagaaacattttgctggcggccaggggcggagcaaaagccgtcaaaatagctaaatttcaaaatccattgtgtaaacgatggaaaaatggtaatttatcgtttcaaatacacccctattttcccagcgtcgctggtatgagcaaaaaaaaaaaaaggtcgttcgggcgaaagtttttcaaaaatacacccctaagaattgacttttttgtcaacctattctaaaattggttttttgaacttttgtttcaaaaatgcgttggtttttcggtggtgccgatggtccaccaagaaatatttttaatgcaattttttttattggctatagccctggcgacccccttgcccttctcacccaccccctggcgctcatccgttcgtaatttggcttgacgcacttttttgcacataaatgaaatgataggtaaggaaaacacaaataaaagacgaaagtaacgccgaaatgaatcggaaaaaccgagaacataaatgaattataggctctatgggaatcactgatcgatataatctatttttgaattttgccattcttttgcgactgactgatcagtgagtgatcagagatccaacagaatggtcagcgggtcttccaccgcctgtttgattttgcgcagaaaagtgaccgcctctctgccgtcgatcaggcgatggtcgtaagtgagtgcgatgtacatcatcggacgaatttcgacctaaatcaatgcgttatttttgctacaaaacaaactgaattgtccgatcttttctcgacttgcctttccatccaccgccacaggccgatcgaaaatgccgtgcatgccgagaatggccgactgcggtgggttgatgatcggagtgccgaacaacgagccgaacacaccgccgttgcttatggtgaaagtgccgccctccatgtcttcaatcgccaatttgttgtcacgtg

SEQ ID NO: 27039 - DNA, 1527 bp, Heterodera glycines
acgcgaaaatggccacacgaaaacggcatggccagcactcgccctgcttctgtaatgccaggataccgcagggaaattttgaaaatttaggggtgtctgtaatcagcggtacagtaattttgacgtgttgcaacgagtgactgtgaacgggcaggacgagtggaggccaacaacaatttccacggcgtgctgctgcgattgcaaagcaatttctttttaattttgttttttgaaatgccgttttcggcacggaatgccaaaggctcagaacatcgtgcgcctgtgaaccaaaaattgaagattttgggaacatcccagctgaacggcaaacgctgagagtgtggccaaacactcaagtgcttgagaacgataatgaaacaatgggatattatggtattgaagataaccatcattatcttgtcaagaacatttgagaatttttattaggtatttaggtttcattgaattattttatttttttaagtgtccaaaaactattaataataaataagatatttatgttattctaatgaaattaaatttattgaagatcactcttaaattcaatttaaattaaaataatatttgaatgcgtcaacaaataagggtgttggataatccgactgatgatagcaatcaacatttttaaataataacattattatttagatattaaatgagtaagagatttggataattctactgaaggtgccatcagaaagtgaatgaatgtgtttttattgcgtcattttttaatataaaataataaatggaccttaaataaatagggaattggggtaattctactgatggtcactattatagattgaatcataatatttgtatcatttttaattaagtctaagaaaaaataataaatatgattaaataaataagagaaattaaacaacttaaaaaacaaaaaatcgaaataaaccgaaatttttatgaagatccttcgttgacatttgagcagctttatccatttgtaaacaaatgctttagttggacgatgaaaatattaattattcatacgaaattaaaaattttatttgctaatgaatttcatattatagaatataattgagcaggaattaaaaatcttcgggattgatcgggttggtcgggatccatattttgaatttcaatgttttggaattcatctcggaaattatgcaacgctttttattggtgaaatttttgaaattttgtttaggctaatacaaaacgttaatgaccattcgagcaatacacggagactttgcaaagaggcttatccaaattctattcattattgttggaatgaattgaaattttgcaggaaaatacttgggattgagcaggaacaaaaaatcaagaataactcaaggcttaatcgataggccggaattatttaacaattataattcactataatatgccaaataaagtgatcattcaattgccaattcactataattctgtcaaattaaagtgatcacttaagtgccaattcaataattcactataacactgccaaattaaagt

SEQ ID NO: 27040 - DNA, 757 bp, Heterodera glycines
gggaaccccgctcccgtcaactttacattccacaattttggggagttttgattaaaaaggcaataaaaatgcgacatgcatctcccccaagcctcaatcaagaaggacaatacacatttttagaaaccatttaacccacacataagttttgagcaacatttttaatgaatttattcaaaataacaacacaacattttgccaacaaaatagaataatgaatgcacaaataaactctcgtgttaaaaactcaatgaaatttcaaaatttgcatgttatagtcaggcctatagccagggggtggaagaggatgagaaattccccccccccccgcgaattgaaaaatgaaagttttcatgaaaaatggacaatttttgaaattttacactatttcttatcataatttactaaaattttgaagaaaaaaaaaatttcccaatgactcccatcggcaccgccggggaccctcatttaccatagtttttgaaattctacccgaaatctggcaaaaatgttatcattttgtttttggcgcaaaacctctacaaaaaaaaatgtccatatttacgcctccgaatttctatttttttttctgactacgggcttgtgattacagtggtaaaatgggttcataattgaaaagagtatagcgatattcaaccacgaagaaacgcacatacccatataccaactgggcttacactgacccatttcacccataagtgttctcttacaaacatcatatgcataaccaataccc

SEQ ID NO: 27041 - DNA, 2299 bp, Heterodera glycines
  misc_feature (2222)..(2222): n is a, c, g, or t
aatcaataaaataagctatattatagaactaattcgtaataagtcgcattaataaataagtaattttaattttaccttaataatacttataatatatataattaatacttttttattatattttaaatttttaaatattttcagttaattattaaatgatatttaaacaatcgaacgcaaacttgccgaggcaaaaacatgaaaaaaaggattaaaaaaatttattttttagtaacaaaataataattgcgcacaaaatggccaataaaaatttcactaatgagccaataaagaattgcgaatataataaaaacaatataagatcacttatgccgattgagttattaagcattttcaaaaaaataaataaaaaatagtataaagtaaaaaccaaatatttactgttcaaatctcgcactcttaatacgcaatataaaaaataaataattaagtcttaaaaaatacacattaaaaaaatatgaataatgaagtattgttaaatgaaaaatcatccaccaaaaggtactgcatacattctatcgtacaaatgaatatacataaaaattgatttttcgatatttagtattcgttgaattactactgaattaaatcacaaatttcattcattaacagaaatttaaaaaaaaaaaattatttttatatattaaattaaaataatctaaggcaaactttccgcggcttagtcatataccttttagatgaggatgtttcgaggcatatttaaaaaaataaattaataacaaatataaaaaaaaaagttttataaaaatataaataaattattttcaaaaaaacatcaacaaaagtttttaaatattttcatattttttaacataaatttattatctaagaattaaaatgacttacataatacaatgataaaacatgcttaattgatgatcgatttaaattctagagagtgaaatttattttaatttcactgacaaaattataattgtttaaaatcgactatttacaaaataaaaaatatgaaagaaattgctaagtaaatttgatttctataataatataagaaattttcacgcatgcgaaacgaataactagaaatttgcggaagagcgcgcataaaacatgaataatacatataaaaaatattctttaaaaatacgattatttaaaaagtaaaatttttaaattatacatttatatatattccaagttccacaaataaaacaaagctttaaaagattcttaaaattccaaaatcagcaagcattaccgtgtgcaaatttgagatcggtgcgacagttaatttgatggaataattgaaaaatgcaaatataaattaaaatactgaaatgaattgtagactaaaatatatcatacttggcttagataattgcttagacatggtggatgaattaagtttatatatttatatttagtaatataaaaaatcaaattataaaaaaaataaaaagtataataaatagtaaaaaaaattatagaaataaagtaaatagaataatacataaagtttgaatatattttaaaacttattatcacatttttttaccataaacgttagaaaatataacgcgagccatccaaaaatcttttccaccaaaatttatgcgtgagatcgcttttaaaagaaaatatttgctctacgtaacaggttgacttggaagcggatttaggacaagtataaaaactaatcaaaaaatcttgccttaaatataattgaaaaaacaaaatataagtaattaaatggcagtgtaaaaattattaaattattatttttttgattaaaattttatgatagcatttattttataatatacaaaaaataatcacaatcatttaaatagctcaagattagaatgcccaagagcaatggaatccgcgcgacttgatgactcataaattcgtaaaattaaaaatgcaaacttacagttttcgtttattccaataataaaaaataaaattaaatcaatttaaaactcataatttaagtccacgaaacatatattttttaaataaactttgagacaaaaagaacttaaaaacacttatggacataaattttcaaaatcgagggtatatttcatcaaaatttgtagtgtaaaactttcaaaaatggctaaatatgatattgaaataccattttagaagaaaaaaaacatgtacaactaaaatttactcatttttagcctggcttttttgtttatttttgacantaatttaccaatttaaaaaaaaaaaaattaaatttaatcaatattttcggcaaaatttagataaaaaaaatgacttt

SEQ ID NO: 27042 - DNA, 1451 bp, Heterodera glycines
  misc_feature (1404)..(1404): n is a, c, g, or t
catggaagattgtgacagaggagggaatgagtacatccatagtttggcaaccataaaggctgcagtccaattttatatttgtatttttgaatgctccaatttctcaatttcccaacggcacctattacactgtctatcaacggttaatatattgtaattgtatattttaaataaaaacatttacggattaataaaatgaacatgatattccaataaaaacatatttacgatggattgaaatgtataaatttcaatatgggatgccactaggactcgcatttgatatgcaatgtatatagtacttttgttctaaaaatttttatatcatcaacacaggttgtgtctgtggactcggaggcggtggggccatcccatcaatttgttgttggacagccgaagccaagacaccgccagggacgagagccgattgctgcacctgaaaatcctctcattaacaaaataagaaatgttttatgacctgcgccacagtcgcattcttgagcaaattgttgtaccgttccatccgagcattgctaatcggtgtaatttggagaatatccgaaattatcgcgatcctaaatggcaaaaaaaggtttttttatgttgaccaagataaattacccctccgtttttgggacaatggcaaactgtcgggtgaaaaatttcatgttcaaaaagttggtagacccatccgacacttctttcccatcgcgaaaaattccttgcagcgataagacgatcaaattgtcctgaaaagcaataaattcctaagcagaaaatttgagtgaatggacaaacaacaatttaattaataacccacagaagtgaaattgaagtcgagtagaaatgattgtttgatgtgctcagtcggaggtaatttgctcagagcgactgctatatccataggtccacgataaatgattttgtcacgataggattgccatttgtgttgttggatgatgttgtgagaagaacggatgtacaggccgatcaactctctgaacagagacagaaaatgaattggaaccaaaattagaagggaacaggggggaggggggatcaacctgaagtatttgcgaagggttccggaggggtagaataattaagtaacccactgcttatgggtgttggtactccattagcacttactgatggtcacttctgtctctgtttccggtcggatgggtatccgccagaaaacacatcgaataggtaaacgtcgccttaaaagcgaattttactcaaatttaacattgcccattttgcgtacatttgcgtcgtatgcatttaacaattgttgtcgcgtctgttcaccatttggaccgtcgtaaaagttgaaaaattccaagagaaaattttcagccatcgtgcgatatgattcttcggtgcaaaaaccgtgcttanaggcgcaaaaagcttacagttagcacgacatgataattttactctga

SEQ ID NO: 27043 - DNA, 1931 bp, Heterodera glycines
  misc_feature (39)..(39): n is a, c, g, or t
  misc_feature (81)..(81): n is a, c, g, or t
  misc_feature (91)..(91): n is a, c, g, or t
  misc_feature (1777)..(1777): n is a, c, g, or t
attaaaggctgtattttttgctgcttggtacttaaattntcgttttattggcaatattatttatttattttgaattatatntaaatttctntagtcccatgttttataattcttatttgttgtattatgaacataaaaaaatacaaaatgatcttttgtaaaaattttcatggtgtgtcccccttgtattttttagcaaagaatcaaaccatcctcatcattaaaattagagatttggaattattgtatttttttttataacaatcaaagttttatattttgctaagtttttgttttaatttttactttagcatgtgaaaatctatttttggccattaattttgcgataatatttacatcgcctgacactcacaatcagctgatgaagactggttaaagaagattaaatcattttttcatattatttaataatgttttaccaatattgtttgcttatttattttatttattattttttgcaaataatgtattattatatttctgtttgtatatttatttatttgttctttaaattattaaaaaattcaaattttatttttattcctaataaatatgtattttaatttctacaacaattgtgttttttggggatatatcttttttgaataattatctgtatatttttgtgttgcctatctctttttttgtttatttttttgaatgaatagagttcctatttttgaattgattttttatttttatttaaaccattttattttattttttaatcattatttaatttatcaaaacttatagtaaatttttcctgaaaatttttttaaaagttcattaaattataatttttgactacaaccaatgaatgtatttaaattataatttacactctataatatgaatttttatatttaatttattcctttattacgtttatttttgaacaattttgaaattgtagagttgtgttacgtcacatattatttttttttgtttggtttaaaagcaaattttaaaaaatttaaaataaaaatttcataataattatttatttactcacgatgaaatctgcaatttctccatccagaaggcatagtatatttattagttgtttgatttttatgaacgtaagttatattaattatgttggtagtttttgattttttgttttaatttatgctcgtattaagaattttgtccaaatatatttgtcgcttatgtgttttattcttaaattcttaaaaattcttataatagttaagacatttgttctggtttatatcttatcatatatcagccatttttctcaatttaaaaagcgatattaaaactcaaattaattgaaaagcatttaaattaatatattatttttatatttcatatattatttttaaaattttaatattttttagtttaatttacgaatttcctcttgattcttattgttttattaaatgaatgatgtgatcatcgttcggaccctttttatcatttttttaattttacacaaggaaaaacataagattctatatagtaagttgtattactttttcattaattttttttattattctttaatatttcctttatcattttaatctccatattatttttctaatttttttttttttttgctttttgcactttaaccaagcgtttgttttttaacaattatgtttttaaatagaattatttatgtattcattaatatttaattgttaatttaatgactttttctttttaataaacactctcggatatgtaaactatactgcctctaggaccagttcaaaatccaaantcttgcgttgaaaatttattcgctgcatttgccgaattttaagagagaaattattttttaattaagtattacactgtttacttatttattgttttaaaatctttattgatttaataagatgcaaatttactcagttgaactaatattaacatgg

SEQ ID NO: 27044 - DNA, 126 bp, Heterodera glycines
tctagagtctgtatctgttaggcttatgttttgtgtttaagaaggccgtaatgtgactgcgcggaaggcggaggaggcagccctcgcggcttcggcgtcagcctttgaacaatgggtttgattaaa

SEQ ID NO: 27045 - DNA, 61 bp, Heterodera glycines
ttaaacagttaatctttatgatttgctgcttcttcttaacgaagctttgttattttagtta

SEQ ID NO: 27046 - DNA, 1747 bp, Heterodera glycines
tagagtcaaaagtcaatcagtgaaaaactttatttaagcaaattacccgcatttaaaatgggaatgaaaaattaaagccaaaaaattgccaagtataatcagctattaagctaattaacaataataattaactcaacctttctcattagcatttaatcactaaactatggctgcgattaatcgtacaaaagtgttaattatgaagtaattgcctttcgttttcttcccatattttcaattttttttttggctgtccgattaaatgtgacgaggtcattcagtcattcattcattcattcacccattcgatcatccgttcatttgttccatcaaattcattctcatttccattatttatcagcaacagtcggctatcaaatcgcgtgcaataatttccaatttgaaaatacattttgacgattaacaaataataatactaataatataaattttgtcacatttcacccccccccccgggcgtcgttttggtcagataacaaaaaaagtgctggttttttgtgagccgaagacgacaacgagacgacacgccttttgttcaaatgacaacaaccctttcagtccaacggatcggaacggtgaaaagaatcgccagccgagcgacagcgaaattggcgataaaaaggcctatcagtttagcagcagcaatgaagtaattggttaattattgtaattaattagttaattagggacaagagaagcggaacggaatttattaatacattctcaaatggagtgatgcaaatgaaccaaccaaaaagcaacctcccattagagatccaatcaattccatctcatatcctgtgggcaatctgttaattgacaaatgccaggcaaaatgctggagaaaaataaaaatgcaaataaaattctcctcttttcgttaatttccaattcaacgaaagcattttttgttgtttaattgtagaccgaaagatctctcaagacaaagagctaaggaaaaaaatcattcactgaataattatttattttatgcttaagaaaaagcatatttgcaggaatatctatctaccgattcttaattacccataatttcttgagcaaattgaagcaaataatggtagcggttgccggggactcttcaaaaatttaattattatttttttaaatacgcaatttaatccgttttaaattgaaaaataaataattattattaaacagaaattaatttcatttttagaatgattaatttaacctctgacaattggtcgggcgcccacccgaaaatcagcgaggcgctgctgcgccattgcgacggcggtgccaccgcttatggcgccagcgttttggacagaaaaattgagcggactttcaacgaagtttttgagcgagacgtggcggtgttttttgttggcactggtgcgcaaaaaatatcaaaaaagagctaaaagagattatgtgaattggtttttacgattgtttgccccaggcaccgctgccaatgcgttgtcaatggcttatgtgaatcgcgcgggtggcatcattttcgcgcatcggcatgcccatctgattgaggacgagtgcggcgcgcccgaatattttacgggcggcgccaggttggtcggcgtaagcggcgccgagggacgcattgagccggaagtaattactggctaattaggggataataaatctgttagtgactctatttattggataattaagtacaagtgatcagtggccctaattaggggatacccaatataagtaa

SEQ ID NO: 27047 - DNA, 1082 bp, Heterodera glycines
tcatcatttatttccaaataatcaatttctaattctttttcttctgcatcgggctcagtagatggtgccaaaaacaactggttcatatttgctttgatgagtaaaatttgttgtgccatttctccgctcaggcttaaattccttggttttacagaaatcagaaatcgaaaataccgatttcttaatgagttgccataaatgagccccgctttcgagaacagcctttccgatgacacagatgtggcgggaattaaatgaacaatccgggccagtaaaaacaaatcagggaattgggccccaacttctttccaccacacgaaaatatcagtctcaatagtggttcttccaagtgccttgtaagaagctaattgaagttgaatttgtgattgatatgacgaatgtgaagtgccagaaacaattgagggcaccgaaacactccctggagacttgggcttccaaatatcgacttaaagtattataaaataaaaaaaaagaattattcaaatacatttaatgctgtcgtcgcttgctggtcccgtgtcttcgaccaaagaattcaaaggtgcagccattgctttttccacatttgtgccacattcggctccctgaaaatgcgacaccagaaaatgcgacaccaagaaaatccgacaccagaaaatccgacaccggcggaaaatgcgacaccgtaaatttttttttaaaaaacagaaaatgcgacacccggaaaatacgacaccaaaattaaatttttaaaaattatttttaattttaaaaatgaaaaataaatcaattattattcctaaagaggttcttagttacgttttaaaaactataaaaatgaaaaatcattgatttttgtcctaaagaggttctgccattcggtgggaaattgcgcgcaaatattgcagaggatggcgattgtttcgcgtgacgtataactcattaagatttatgtcttggtccacataagtttgcttgcgtttcattcccttgccacgtattccatttgctgggttgtttgcaaagtcttcaacttgctgacaaacaatggctttcttcttgccgaactttccgaagaaaaa

SEQ ID NO: 27048 - DNA, 963 bp, Heterodera glycines
tttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaccgacacttgaaaaatcgatttttttgttttccgggcagtcccccc

SEQ ID NO: 27049 - DNA, 1039 bp, Heterodera glycines
tttctatttgcattttccttaccatttccacgaactgaagtctttctcttgtctccacgagatcgtttcaagccttttgtcgcccgcagccgctgaattgtggcggcctgtccttgaaggcgcgcacaaatggactgatacatccggtcatttttcgccttcaatgctccaactttcgcatccagctcaagctgggtccaaccacgcttcaaatcctgcacgtctgcagcggtaatgacaccaccctttaaaacaccggtcattgttttaacgaaacgaatcacattcccaagtaaacctaatatggtaaccatccacataccaacagctatgtggatggtgactatccacatagctgttggtatgtggatggtaaccatattaggtttacttgggaatgtgattcgtttcgttacagcaatcaccgatgttctaaagggcggtgtcattctcgctgcacacgtgcactatttgaaccgtggtcgcttccagcttgagctgcatccgaaagctctatcacggacgctgaaaaatgagcgcatgtctcactcccttagtggctgcattgcaagcacagctctccacacttcagcgtttgcgggagccacaaggcttgctccgctgccgtcgacacacgacaaagccttcagctcgtcgaaatggtaagcaacatccacatagaaagtggtatgtgaaaattgagcatccacatagccgttggtatgtggatgctctatttttcaattttcaaaatttaggtgttgcaggaaagaagaaaggcctgagaaaggatcagaagactgcaggccgccgcagagttgtcattgacgattcatctaacggaggtgggtctagaggactgtaaacctgtagttttttcgtccagacgatacagcacctcgacccaagcgaacgagaaagagaaaaacggcgccgcctacggaagaagtggtgaaagtgctgcaaaacgttttggcggccccggggggttcgactacaacgggtgttgcacaaaatcttctgaacgaaattagggaga

SEQ ID NO: 27050 - DNA, 1472 bp, Heterodera glycines
aaaaatgtaattttgttttagcatatgataaaagttaaaaaattcgaattgcattttgaaaatcaaaattttttgcattgtctaaaaaagctccttagctactgttttgatatttttaaagtaaattctgtatttttacacaatttttgtcatttttttgatggttaaaagccattttaagtaatttttaaggcatattttagtgcatattttagcctttttctggtttttagtgcatattttatgcgcttataaatagggtcgcgtaagtgacgaaaaatctcgaaatagttaactaaaatagtgagtaaaaatgccaaaatagtgccataatggtggaaaaaagtccgaattagtaacaaatagtgacataattttcagccaaaaattgagcaaaaataatttttattcactgaggactgggatttataagagcaaataaccaaaatagttgcgtaaagataatcagataagttcaatgttcttgacacattacttttttaagcaaaaaaaaaatcatatatttttcaaaaaaacaatgtatcaggtgagggttgcctgtcgcaaagagacctccttcccgctggtgtgaggcgtcagtacttatttgggcaatgctctagtaacgaagttaagagtcttttctttaattcattcgcttgtatatcttgtttatcacatgtatcggtatatgctactgcacgaacatccagacacgcatctgcgcctgagctgttactgcactaacaaccgcaacggtgcacaccttacgcatctacgcctcgaagggctaggctcggctttctataaagcgcagccctctactgcgcccggctagttttttgtttaaaatacaaacagtttggccctggaaatgatggcactgctcaaccgcgagatggagcagtacgaccgggcgctggtccgaaagccagtggtgttgctgctgaacaaagtggacgaggtggacggagagcaggcgagaaaggttagggaaagatgatcagaagccgggcgaggggggggggtgggggttgaaaaggatgataacattgaccagaagccggacaggataggagagattagggatgatcagaagcagggtaaggggttgggccagaatgatcagaagcggaggaagagctttgggcaagatgatcaaaagacgtggttaggggagcgaggacagagtgatcagaagcagggagagggtgattggttgtcaagaatgatcagtttgatctgaaagcggccagaatgaagggattagggatgagatgatcagatatagggagagtgattgggaggatgatgactcgaagtcagaagccggacagaatggcggtactagtgatgcactgaagccgggcgaatgtagagggactagggttgataagaagccccgagggagatggtggggattatgatgatcaaaagccggggagaggggtgacgatgatgatgatcaaaat

SEQ ID NO: 27051 - DNA, 1113 bp, Heterodera glycines
attgtccgatcggaattttcttcccaactctcccaatgatcgcctacttcccccccccctcccttttcttccctcgctcccgccccaatctcttcggactgtccgtcgatgcctttgccaccctctcccatcgatccccccccccttttcctatgcaaatccctcccccccccaatcgctttgtttgttttcccgcgcgttgatctcattcaaatggccaatttgtcagctcgtccctaggcgcaaacaacctcaaagacaaagtgagcaaaaaccatcaacattatcactttccctctcctctcttttcttccctctgtctctctctctctctctctctctgtgtgtttctttctttcctcttttttctctttttctcttcccctcttttgtctctgttccccccgtccatttccccttttttgtcgctttttcgctgaccatccattcacccggcaaacagaatatttaaatatatattttatgcattcatataaaaaagaattgaagcgcccggaattttacaatcggaacagaggcaaatattcttgaaataaaaaaagttggtcggtcatctcgggtcttccggttcggttattttacaaaaacggaaccgggagtcccggtaagatcccactgggtcccggtcaacagtcaattgagttataagtaagggatagacgatccgatcgtcttttcagtatttctcattcatcagtcaaggttagctaattagtgttatggtcaatttgcaaccactctcttccccttttcgtctctcattgtctcctattctctccctctctttttaccccttccattctctccccttttccttttcctcttccatgtctctactcctttcttcctcatccccccttctctccttccttcttcagtgggatgatcaccaaaactgacactgtgtgaatattattccgatgtttaaatggtccaattcagaaaaaaacgatgaatgggagagatctgaggaaaggatgagaaaatatgagtggaggacggacggtccgaccgaagagattgtcccccacccccgctcgtttccttttctaacggctcacgccccggcactctatggaagtgcaaattggg

SEQ ID NO: 27052 - DNA, 914 bp, Heterodera glycines
cgaaataattatgacaaatgcacaaagacagtcgcagggattcgcttctcctcaggtgaaaacaacggctaatgaggtccgtaattatgtcagcgtggggagggaaggagccacgtgcctgcccctcccaaataaacaaaaatgaatttttaatatttaaaagagagaatttttgaaaatttcgaacatatttgtcctgataaaaaatctttttcaaattcgaaaaatttaacgcttcttttttaaataggcgaaaaagggtgaaaactaaaaactaaaaatcaggcccaaaaattatgaattaccaaagaaaattaattttctcttcagaaacaagtaaactttcatattttgtccgaaaatgactatttaagtctattctttgtcaagaaaaattaacttaatttaaaattattatgaattttcttaataaaaatttgattctgggattgtggggttagtttcccgcaaaatccggccggtggatcggtctcgcgccgatctctaatcccaataacttagtatgtttttttttatttattcaaaaatttgaaaaccctggatacaggctggactaaatcaagaataaaatgcaatataaattttagcaaataaaatggctagcgcgggtgcatgagcttgaatcgacgattgagtcggccaaattggtcattagaattgcgctgccgcccaatttaattgagaaatgggttaataatgaaaattgggctgtgttgaaagaaaatctgaaaaacatcgacatggaagattttatggcctatcaggacgaaaggcgttggtttgggtgcaatttctcgaccactgtttgcgataattggggatgtgagtggggcaaatgggggtaattaaattttaaatgggagaaactcattagcacccaaattaagaccgat

SEQ ID NO: 27053 - DNA, 1604 bp, Heterodera glycines
tttaaagccatccattgcctgccggttctcggcaccgcaaagcactaatacggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttaaaataataattcattacccaaaagttttttacaaccacttattgccaatctaatttcttgcagattgaaagccatccattgcctgccggttctcggcacagcaaagcactaatagggtgtttgactcacttcaaaaaataattccatacccaaaagttttttacaaccacataagtagtatatgaccccgaaagcgcacggttccgagcgggtgtttaccgcacaaacccaaacctacgggaggggtgttttcttttgaaatgtgccgcccgcttacaaacccatgcctattggactacctctgaagctgccgccaagaaccaaaccctatgggaggggcgcaaccctttgaagttgccgccccatcaaaacccaggaggggaggggtgtgtgttccaaaccaaacctaatgtactccctatgaagttgacgcccgtggacatttaccgccaagaaccaaagcctatgggaggggtgcatccctttgatgttgccgccttgtggattttaatttacccaaatccgtgcgggtgtttttttcacccggccgcgcagcgccgcgggaaggtcatcaatcatccacctgtcaccaaaagtgacaggtgaaggaaattcaattttttcttttgcaaatttaaatctttttgatcccaaaccttttgggcggttttattttctcaaatcctgagattttttatgatgggtttttcggatcctgaaattgaaaattctttttgaaaattagccaaaaccgtgccgtgcggttttttatcacctctcccctccctccccgcccgtccggcgatgcgatgccgccgccgcgaaaagtaatcgataatggaattttgaagaactgcaaattagttgatattgacagcaaataatttcgattatgacttggacaatagaattactatttaaatccaatgtaaaagtaaatcgaagaatgaataaatacattaaaaactttttcaaaaggagtcccctgtcaactaaaaattgtttgatgggttttttattttttcttccattatttctcaatccgcacgtgactttttgttcaaattattttcgaatatcccccccaaattaagtcactgcaaataaaatgggatggatggtttctaatgaaatggccccctaatttttattttccggtcccaactatttcgcaaaagggcccgaaattttccaacccgtcaaaaaaaaaaggatttatgattttcaaaaaaagaatatcaaaacaattttttgcagggtttttgaaaaaaa

SEQ ID NO: 27054 - DNA, 855 bp, Heterodera glycines
attcggtctctccatatatctgggcgcatcggttcgcggggactgcaccgagaacacaaataaatcgattttttcaagtgtccgtttggggtactcaagcaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccctaaaacaaaaaaatcgattttttcaagtgtccgtttggggtactcaaacatttatggggagcaaaaatccaacgcagaattaaagtacaggctatagggaagctactcccgaaggattcggtctcccccataaatctgggcgcatcgg

SEQ ID NO: 27055 - DNA, 1479 bp, Heterodera glycines
acatgcaaaacacgacggacgttgaaattgctgcgctcgacgcggacaaagcggtgcaaattgagatcaaatatgacgacaagttggacgagaaggaggccgcctatttccaagtgaatcattcattcaatcaccccaccaattttgcatttttcactcccaaatttcaattttattttaatttttacattttattctggttactggttgcaggaatggtccaatactaatttgacctagatgggtttttagaagtgagaggagggatgtcatggatgagggataaaacaaaagaaaattcgaaattttaaacaaaaattcttacttttcccttagaaattttcagagggttatcttagcctcccctcctcttttcctggatgaagggattttttctaaaacattttcattaaactatacaaatttagtgtttctttttttcagttggccgtgctgttcaccagttgcggaggccaacgacggctccgtgtgcacaatgtaaaaatggaaatttgtaaaaaacaaatttacaaataatgcaatcctccggcacagctctcactgccgatcagctccgattatgcgcaactgtaccggctgattgacgaggactgcttggccacccacttgttcaagcagggcaagcaaaaaataaaaaaaacatttcaccaaaatattatttttgaaatttcagcggaacaaacgctgcgcgaaaaggcgcccaaagaaattcgggacgagctgacactacgctgtgcccaaatgttggccgcctaccgcgagaagtgcagcgagcaggccccgcttggccaactgattttgcccgagtgcgccaaactgttgccgctgcatgtcaactgcattgagcgccacgacgcgctcaacggaggtcagtagagcgaacatttaggaaatttcatgatgatacatgtgattcgggaactgtatcggaccggatttggtgtgaaaatcctgtaattttgattggacattgatccgattccattttttaaatcccgtgaaaagcccggcaacacccaggataaatgatgtcattgtggacatggttgctgtagtgttcagcttcatactgtatttacattcgagcgcattgttatttgcacttcattcctccgtcctcattttttctttcgttttttaaataaaaattcgaattttcctataaatttatacttgattttctcggttgactgtatgtttaaaaacagaaaatttctgattgtcggttttttaaatttcttagggctgtttctgttcaacaggtcccgttcaagatttaatgacatttaaatctgcgctaaactcgcgggcataacccttttccatgacggaaccaattcaagttttcatgccgtcctgataaatttcaatgctcggcattccttcctgtatttaatattattattcatgccccatccccctcccattttgaaggtgccgaactcacggtggacgacc

SEQ ID NO: 27056 - DNA, 1024 bp, Heterodera glycines
ttgtattaaatggcatttttgaataataaattttattatttaaaaatttattttgtttttgtttagcaaaatgtggttaatcattcaaattttgtatatccagcacaatccgtctacttaaacaacaatctgcttatttgtacaaaatctcaccgattattggttaaaagattattaattctatcaagcaaaattactaaaagataaattattaattattattatttatttaaattattagggaatataattaattatatggacataaattttcacgaagtatgaagaagttgattttcttattcagttcgtgtttttgtcagaatcacttgaaatttgcaggaaaataaattctaagggcaacagaatctgcaaaattcataaaattttattcttctaaatttttttttacaaaaatccgtttattagtaaaaattaaaagttcacataaaaatttttagttgattttttcaatttttataaaaatacggatttaaaataaaattgtacgtgagtgcaaaattttggacttttgtactaaattttattgcatattattagttaatatacaaatgtgtaatacaaaaaataaaagcagttgattcaaaaaaaaaaaaaattaacaattggcattatgaccaacaaaagtctgtgagagattttttgggcttaaacaattttcaaaaaataggcaaaacgtaaagcataaaagaaagaattgcactcacatgaaagttgcacaggtaaaccacgaaaagtgcatttttcttctctgttagtcgattttcacattttaaaaaaccttaattcgctgttcgaattttttgcaagtttctgatagcaacgcgaatatttgctaataaattattgcgttcgcctcagaggcgtaaatttgaaaaatgttgtgtattgccaacctttagagtttcctagattttgtccagaaaatacacatatcaaggtcctggcttttttcaaaatgtcaatgtctgatggagagctagttataaataacattgataat

SEQ ID NO: 27057 - DNA, 1045 bp, Heterodera glycines
  misc_feature (860)..(860): n is a, c, g, or t
  misc_feature (958)..(958): n is a, c, g, or t
tatattctctggtgctttgaatttttttggagttatgcatgtatagttttacactaatttttattggtgtttaaacttattatttgcatttttatgttatgggtatcaggttttatttaatatttttctcttaggctttgttaactttaattttatgatatattcattaaccaaatatatattttaattataattttttctcaagcttttaagagtataaatatgaataagtaattttaatatacctaactatttttcacaaatatggggtcaacagttataacggccatttttcagagaaccgatcataactcaatggatattattaactgattagaaaacaactaaaattgtaaagatagttcaaaaatatttaactgaatactgaatcctgtaaattaataattgaaaatagggaaataaaatttattatgaaatgcaaaacatctgcaacaaaaattaatctaaaatatgataattggtcaattttttattatttagacaatattagaaactaatttaatctcacgatttttaagcagaatgtaacataaatacctaaatgttagatcttatcaagttaaagaaatatgttaactcgaataaataaaaaattaacaaatcgttcatgagtctaatctcttttttaagtatttatctaaacaaaaagcgatgaacaagccatagaaattttcttcataaataaaattcaaatattaataaaaaagatattagaaaataatacctgttctataatgaaataataaatcattaaaactgaatatttaaaaaatatttcatgttttaatgcttcttaataatcttataaaatatgagatattaattagtttcctaataanattaacttgttatagtaccttaatataataatgaacgttccagaatttttatataaaaaatctaaaagcgtaaattcgcaaacgaattatgcaaaaangtctaaattgcttgttttttattatgattaagaataaattttttcgtaccaaattagtgaacattataatcgtttatagatggaaaa

SEQ ID NO: 27058 - DNA, 992 bp, Heterodera glycines
  misc_feature (983)..(983): n is a, c, g, or t
ttttccaagaaaatccaaaaaattttcaggcggccccaattttggcattgcgggatgtaggggtagtacaataggggggggagtatatttaaaattgtaaaatgatgataataaggcgatcgctgtcccttatcagcagccgtgctcctccaactcgttgccgccgaactcgcgcgattgcatcaggaaagcatataaaaagatagctcccgaactgttggagcggacccgtgccgaactgaagcgtccgggaacagccagttcgatcagcagatgtgggtcgtcgtcgtccacggtctcttcaccagcgaggcgatccgatagggagaagcggaagctcgaaatgatccgtcacgtggggcaaaaatgtgaccccaattgccagacgtgtgatcagctcttgaaatgatctctcgtccccattccaatacccacactcatcacaccattcctattatcgacagtctttctatccgatcaaacaccaaccaatgtactcttaattaccccccccccttttttattaacaattaattatgccatttcctttgcttttccaccataaaaaatcatacacatctaatgcgttttacaaccctcccctacggcacacccttccccacgggttcgcgcccctccccactcccaacgctcgcgtcctccctcccacagagtatcaccacgaaaattcaaatttgaatttagcgccaaaaggggcgacaatcgtacaggagtcactactgcaattttttcaaaaaactaggaacagaggggcccgccgatatgcaccatccggagaaatattttgaaaattaatgtgatttgttaacagattttttctaataatgaccaaatgtcgcactttttgactcaatttttacatgattaataagtaaaagccgattcaggcggtgtcgaaggcgccgccgggaaaatttttgaaaatctagatgaaatttgtgataaaaaaatggatttaattngagtgaaat

SEQ ID NO: 27059 - DNA, 1715 bp, Heterodera glycines
ggggggggtggccccggggggagagattagtgaaaatggaatggggaatttagcaacaattggattcccaaaactccgtcagaactcgggacacgttgtgaacagttcggacgaatcaaagatgttttgcgggagaaaatcacagaaattgaagtgagtttgtgcaagtcaatgccatggcatttttattcgcatttcagcaaattttcgccaacagtgagcaggggggcagccgcggcactggcggaggcggcggagggggcggcggacgcggcggcgctgtgcaatttatgtcggcgtacggcgggggcggcgctggcgggcaagaattttggaacgtaattcctggggaattgttaattacctattcttatactaaatttaatttgatttgcagtcgggcgatgagtcactgacaattcccgggtaatttggggggcgcgaatcaaacccaactaagggataattgacattcgctaattaggagggccaagcggcaaattggaggcaagcgaagtgatcaaacacaaaacgaaagagtaagtgcgaacaatgggaacaatgccattgtaaaatgccattgtcggaatgccaacatttcattttcatttttaaatttagtcaaaaatcgcggccgacttcgctttgtgcaagtcggagccgaacattcagcacaaactgaagcaggcgctggataaaacgcagcagcgcataacgcaactgaagggaatggagcgaaaaatatcagtgtcactttttatggcgcgacttttttaatttaaaatattagaaaaaatgtaaattataaaaataaatgattaaataaaagtgtaaaaattaataaatcagacaataaataatctttatgcaaaaatacagtaaattcactaataaacaaaatgaacattcattgaatgaaattcgtttgcttcttttctccctaaagcattaaaattctctctcctttctctcccccctatccctctctcatttctcgctactccctcctccactctctctctctctttctccctatttctctctcatcaatctctcattgttccacttctttctcccttcctttgccactcatttcgtctttctcccattttttactcccatttttggcattgcttttcctccttttggcacagtctttgctctcttaaccgtttgatcactttaaaccatttcataatgtggtgattcctcacatttgtcttcctcctcaccgcgtcttttgtcattgtcggtggattcggcacattttcccccggggcgttctttttgccaatggctccgtatttttcgctgagtttcttaacctcccgaatgtcaactttcactgcttcggggggggggatgggttaattaccagtttaattagttttaattgctttccttacttttgacgcactgttcgtaaattggcatttgtgccaattttccctctctctgaagcttttccaatctgccgatctcccctttgatccttcgccattcttccaatcgtcggctgttcatttctgtcccctcccattgcacctcttttggctcatttggccattctccgaatcgcccccttttctcttttttatttggccattcgaattgtgcgactgtttcttttcgtgccaaatttggctgttcttttcgttctttctttggcactgaccgaattaattaattacataattattgcgtatcccatcccc

SEQ ID NO: 27060 - DNA, 1126 bp, Heterodera glycines
gaaaagcgaaatttggcgaaactgaaaaatggggaaatgaaaaaaaaagcgaaatgcgaaaagccaaaatatgcgaaaatgcgaaaagcgaaatgcgaaaagcgaaattttttctacaactttttaatagttaaaatcataaagcaaaaatcattatttaaaattttattccaaatttaaaaatcaataaaacgcttttttgaggcgcgctttttcactagaatttagtagggcgaaagctgatggatggcaaaaacaaggcggaatagtggaaaattcgaaaagcactactaaaacattccataagcatgacttttatttttagcgacgtcctatgcttttgatgggagaaaatcattgtttgagaatttggctaaaaaaaatttgaaaataatttaagctttcctattttaccgcctattcgaatttcattttgaattggtggaaatatggaaaaagtgtttttataaggtgctgtgacgaagttacaaaactataaatgataataattgaaagggatagtagctctagattcaacatcttctactatcttatatatttttaaaaaatctagcaaaataaataataaaaatttttatttatggtttctaaggaattaaaaaacccgggcatgtgtaaaaacagtcaaaaatgcgatttagagaaaatctataaaacaaaaatcaagtaaaaattatagagtctggtaatattttaaatcagtgactttttgaagaaaacccgtaaaattcgtttcttagtgatgcaattttattttttattacaatttggtcacaattctgctggagacgacattttatccttgaaaagcatgacaagacttggcaacaatatgaaaaacaatcattgaatggatagaggagcataatttttctagtcattttttgctgtcggccacaaatgtcgaaaaataaatattaatttaatcagcttttgattcaattacatttattttggacgttcaacttggacccaacagaatttgccttacaatttcgaagcacagcaacaaaaaaaaaacagatatttccaattcaagtaaaaatactaattttgagcactcaaaggtggagggctttcattaatcactgttgcccttttagaa

SEQ ID NO: 27061 - DNA, 970 bp, Heterodera glycines
attcaaaatagtcacaattaaaaaaggcatcaaacataacaattttattttccgaaattcgtcgatcaatacgaagttcttaaaaaacaaacaaacgaaaatttactagaaaaatcctttatgaaggctagaaacctaaaaattttttttcattttttgcgaaaaaaaaaattttggagtcaaggggggggggggggtgggaacgagctgctccgcttttagcaatatcaccagagattgaaacaatatctctggatcagacatgtattatcctaatccaggacaggaagaactcatttcaattgctaaaaattttttcgctcacaacactttaaattttggaaatttttttgggtgaatggccgtgttttgggtgctcgcctcgctccctacggagttgttttcttgttaatgattcaatagtaatcaaaattaattctgcggatcagctcaatttatgaatgatttctgataaattattgtctctttttgtaatttcgatcaattccaaattctcccacattttgcagctgatcgtttcccttgttgaccttttcggcaccgccgacgacctttggcctaaatccgcttccaccctgaccatccttctcacaatcatttcgctgattttggccattgcagctgcaatgcttcttgtttcgggtgtccaattccgatctccgtatttgctagtgccacacatcttaatgcaggtgtggcttgatcggacggcacccgtcagttgggccccacacatttgggccccagcatgttttccactatagcttttttctttgtcatccatatccaacaatttttgcatcagtctaaacgctttcacatgctctattacacttacaaaaagcgaatagatattcaacgctgtaaaaaatttatcatcagaaaattcacattattctgagttttttgcaattttcatgtataagtttattttttgactttgtctaat

SEQ ID NO: 27062 - DNA, 1435 bp, Heterodera glycines
aaaatttttcccgacggcgcctatcggcaccgccggacccccttctttcccaaaagttttttggaaaaaacgtatcgaaaaagtgatgtatttactacattaaaaaaaaattttaattcccggtttcaaaactggtacccaacccggtacccggcttttcaatacccggtaatacccgggcccggtttttgcccaaatacccgggcccatgtaactctagcaaatataatggatctttttttgaaaattatttaatcccaagcaatttgttgttcttgtaacacccggctaataaaaattggcgggctaattgaaaaatattttgccttatttcgataattagtgccagattgggttctgtttttaaacttcccttgaggggagggcgggggtaattatagggtggtgcactaattacagaaatattgttttattttactattttagaaatctgcgcggcacttgtgccactcttttggccatcggctcagccgttgactttctctttttgctctcattttcggtcccttttgccctttcgttggttggccagaacatgatcagcaattttggctgctttttcctccagtttttgccaaactttggcctgttctcctccgtttggatcgttttctttgttggcgttgatcgactgatttctgtccttctcccattaaggtaatgtacgagaaaaaccctgccgatatttagagattattttagtggaattttacgaatttaatcatagaatatttcactaaaataatttgttttaaaaatataaatctataaataaatctttggacttcagatatggtctctttgagcagcaccttttcatttatattttaccaatgcttacggttacatttggctacagtatctatgtgcttgtagaagctgcaaaatggccactttttgtataccccgactggtaaataaagctcatttttgaaaatttaaaatttcattcgttttttaaatattaattttaggccagttttatgcacaaattctgacatgttcagttttggcatgaccacaatgctcctgagaaatggtctggtcattaatggggtgtcaatcatttgttatttgtttgttggactgtcactgttttggtcatggcaaaaaagttagttggactaaaatttaattatttttaatttctttctgtgccctgcctcggcctttcaaaggggctaaagattttacatgggaatacaattaaaaaacataaagctaaaatttttcattaaaatatgacaaataaaatgtgttgtgcgtgggcatagttattttcaatttaatcttttttttatttaataaaaataaataaattctggcctaaaaataaaaattttttaccgcaaatgacttgcagggattaaactgattgtcctcttttaagcatctttaaatcttcagattttgc

SEQ ID NO: 27063 - DNA, 1093 bp, Heterodera glycines
cgatttgtctgcacaattgtcgattatgattagggctcaaaatgttagtgaagaaaaacttgcacaaatcgccaagcgcaattttctaactcagctcattgttttcagaagagtttgaaattttgcattaaaatactttggtataaggtctaggcaccttgccaaattttagaattttttatgcactcagagatttttaagaaaatccgctttttccagcctgaacgccaactttgtggtcaagttttgaaaacaggtggttttttgtaaaaaagttttaacaatatgaaaaattctgaaattttgcagggtgctaggtctcatgccaaagtattttcatgcaaaatttcaagctattctgataactctgaaccgaattacaaaaatcaacttgagcaaaatttaaacttttattcactaaaattcacagccctaattatgattgatcagcttacttttcgcagcatttggaaaattcatggatggaacttaccatttttgtacatttcccatccataaatacttttaaaaaatcttctttagtctgatcggtatagcaattattttttattattcacattttaattccaaccagttttccattaatctctttttctttcctcgttcagttactgttccttttgctgccttcccactgcttctgatcgctttgctcattgttaacgccatgtcgtagcatgggcgttgccgttgatctttttgggaattgtgttgctattaattgttacattcgtgctgtcgcgttttataaatccgccaaaatggaaagtcgcgttttataaaaccgccagtcgcgttttataaatccgccaatgtaaacaaaatattgtacatatgcgtgattatcaatttttatataatttaaatatagtaaaaataatcgagtaaaatgcaaacttttattgctctttaaaactttctccaaaaatatgaactgacaagcataacaaatcctaaacataataaatattaaaaaatataaaacactggcaaactttttgtaaaaacaatcagtagttttataagaacaattgcaaaaagtaaaatcaaaatcggaacgtttttggcattt

SEQ ID NO: 27064 - DNA, 997 bp, Heterodera glycines
tttcgatgtgcacaaagtatcccccccttttgttgccgagtcaaagcaatataaaatctaaattattttatttgcgggtggttaggcccgggtcagtaggtccacctcattgttttcagtgccaaccattttcagttcacttgcgccgctttggaattgcccgacttttcggacttcgcccgactccgtccgttaattgacgcactcattgctgaattggtaggccttttttacctcactacttacggaaattaaaaaaaaaactcgaaaatctagttttttttagtttgttttttgccaggaatgggggggggggtagggcaagaggatgcaaaatcaagaatccggcattcatttcgaccaattccaaaccccgggcccgatttcgaataaagactcaaatatttgaatttcgcatttgatttggcattggatgccaaaaatacacaaagaacaaacagcaaacaaatgttgtgtctctcccattttaggatctcaacgatttcctcggctgcaccgcggcgctcgaaatgctggcggagacggccgccacggcgccaaagtgtgtgcccttttttggccaaattggcctcctggacaaagtgtacgcgctgttcatccgaaccaaggaggagccggacatgggcatcattcacattggtatcaattcccaacctaatttggatacacttcttcgggatttcggaccatcgcaaaattaagttaaattttctttgaaatgaatctgtcgggaaaggcatgtcctttcaacttcagccaccaagaaaactactcttggcacttgttttcaagcgattttaacatttaaaaactatttcgaagggttatttataaaatttgcgattttttttcgctttttgtcactttatttttctccaaaaatttcttggaaaatgaagggaccaatggtaccttgagtttacaattgggaagcattattttttttcatcctaaaaattaaaaaaatttttttttt

SEQ ID NO: 27065 - DNA, 408 bp, Heterodera glycines
atccaattacacataaagatttaaacaaaaaataaataaaaccggataattttcctaaaattctatttttcccagaacgattttatccaaatatttattatttcccctaaagaatttacgcatttttcaaaaatacctttaacaacttcaggttgccggttgtcaacttgcaaatcaatagaattgagatttttttgctttttaaacctatttttttgcggcggtttttcaaaaaaactttttgggaacttgaggagggagggatggtccggcggtgccaatagacgccgccgagaaaactttggaaatttgattgtgatttgttaacagattttcccaaaaaagacaaaaatttttgcgattttgtgtcaatttgttaggaaaaaatgtgagcgggggggggggggg

SEQ ID NO: 27066 - DNA, 914 bp, Heterodera glycines
attgcaaaaatttgtcttttgtgtttaaaaaatcagaacgaaattacaaaaaaaaaaaaaaaaaattccggcggcgcctatcggcatcgccaagccctctccctcgcccatttcccaaaagtttcttggaaaaatgcgccgctaaaaaaattgttaaaaatctgattttttgattccgaatgcactaaattgtacgatttgctcaattttctcccctaaaattgttaaaaatgatcttgggaggcgaaaaatacgaaatttgatatcatttaaattgattaaattgttacacaagcgatttcaattttgcaaaatgttctgattttttggcccgatgttctgattttgaaaaattttcgatccgcgcccagaattaagaggcactccattgacttcttataaatagtaaatcttggttatttatttaaaaatgaataaaatatatttaactcaaattgattttagcttaaaaaggaccagtgatcactttctattatttttgattagagattttttacctcaattggcacttggcttgtttccattatccgatcgtaaattgcttttcgcatcattccaagcaaaacgattcccaaactgctgcacaaatcggcaaaaccgagcagtgtcaacaactaaaaaggagattgggttgttaattattatagaaattaataaaattttgttaattaaaaaattgatatttaaatgcatattcaaatgacttttatcaaaaaatattctcagtaaaatttgctttattatgatggaagaaattccttctgctgaagaacactatcaaagttgcgatgcaaaaaaacgaagagacaacggggacctttgttcaaataagcataattaaaatactccttaaggatcgttaattaattaatggacaaagcatttaatttgat

SEQ ID NO: 27067 - DNA, 898 bp, Heterodera glycines
aagacattgggatttaggacaaagggcaccggggcggggcgggggtgggaggtccaatgccgtcccaccaattccgtcccagccaagtttaagaagatttaatatcgctttaagtatttagaagatgtatgcaagctatttgtggcgcattaagtgatctaaaaaactcaaagcattaaaaatacataaaacaattgatttttatttcttttatttataattgttttacccctttgtgaatcattgttgtgagcattgttgagctaaaaagcttgtgtaaaatcttttgaataatggcgcaagtttattgaatttggtcaaaaaaataacttttgctgctctaaacttggctgggactgagttggcgggcacagaatcgccacgaaattggcagggaaggagttggcggggacggaattgtgggactgagttggctcgcgccatgggagggggcgggggattaagtcacaacagaaatgaaagcagaaaaataagaagaagaagcatttaacaaaggcacggcttggcttcttcatccatcccccaaatccccattcttttcatcgctggaggggcgggggcgggggaaggccgaaaatgcggggcataagtgcttttccgtctcgactgtgctggaattatgtgttatatggatgaatgaggttggggtggcgcaatgcaaaaaaaatatgtgaggagaatggacgaaggacaattctgtatttttccaaaaaaaaattatcgacaaaaatcatcataaaaattaaaagctcattaaatttgtcccacttacaaaaaattaaaggccagaaaataaaaaatgtcggttttggaattttctggcaatcactttttttgtacttggacccaaattttttgaaattttgcgtgctgataa

SEQ ID NO: 27068 - DNA, 1225 bp, Heterodera glycines
aaagacaagtaacaaacaacaaaaaagaccatgcgaatcaattgtgcgctggcttttaacgcaatattcagaattcaagtaattttttaattctttactattgaattttttcccagtgcctcggtttgactttattctttgttttatacttagctcgtcaaaagctttcgaatgatataccaaattggtctgagtttgacttgttttataaggttaggagtgcccattttgtcagttttcagcatttttatccggttcaaaactggtacaaatacaaatgcccgcaacttttttcgttcccaatcgttttcagcgccgaagaaaaaggttttgggtgttattggcttttggatataagggtcatattttcccaaattttaaaattgaaacttacatttcgtcaaatgattcatccttggcccaacagcgaatatccgtttgcgatgaacgcacagtaacaaacccttctctacacatgcatagagtgccgttgcaatatgagccaaataggcactcccttccgtccaaacaactttgtcctgaaatttaaatttgtgaatttttacttatggccagtatttcaattaaatatatgcaataatttgcattgcctggtagtgccatatttagtacttcctccacttttgcgcagaatacgtcaatttgttctttggacaatttcgtgttgtttggagcagtgaattggctgatgaacacatcacatttggcatctgaaaattgccaataaaatacatgaaaaggagatatttcatccatcattcacccatgtcggtttgtttaagtggatagattcgtccgggtttgttgcactcagtcctgttacacgaagaacagccattaaaatccatccaaccgctttttgcaaatagccaatggcacaaaatgctttttccatagcagccgacttgttggagcaacgagcctgaaaaaattatagaagaaaatgctgatgggtgtcaagccaggcaccagactccgtcgtgtattccagtataaagcagtccattttacatggcaccattttcagtccctcgcgtgggtaaatgaatctctttcggttcatcttcaaaatgaacccatccaaacatttatttctgaatttggtggctttatttttaaattcggtttgacaaaactctaccgtttgaaggtatttgcattgtagcaacagcattatgattcttgctgagcaattgaacacccc

SEQ ID NO: 27069 - DNA, 391 bp, Heterodera glycines
ttaattgaatccattattaataaaatattacttaatttttgaaagtttaaaattttgcatttgcaccaatatttttttctctttttcatttaatttattttcaatttaatatgattataatactgttattttaattatattttgtgtgtattttttaacgcataaaattaattttacttttaaattaaataatttttttgcgtaaaatttaaatttaaaaatgacattttatttattttttacacattttctcacatattcaaaacaaaaatacaattgtatttcaaattaatttgcataaaattttgcgtgaattgtttatgtaaatgcaccaaaaatttcgggcaaattttttgccctcaggcgaaacgttttggaatttcctcccccc

SEQ ID NO: 27070 - DNA, 2211 bp, Heterodera glycines
atttaaattaattacccccccccccgttggcagtgcccccattaattcacttgtatttgttgtccgcacaaccgcccatcccccctttggccaacaaatagggctttttcggcgttatgcaccgggccaacagcacgttgttttggcaaacaatttccacaccaatcggcacgtcgagaatcttaaaaaaatggcaataaattaaacaaaaagaaaaaattttttcccgaaacgccattttgcaccgacaaatttcgccacatcctacacaggcattccaacaaaccacccaaaaataaattaaaataagtaatggaaaaggtaatagaaaattgacatcatttagaaaaaggctggccctgtaatcctggaaaaaaaaatcaggaaaactcaggttgtcggaaaaatgccggggcctagagaaactgcagggcaaacacatgcccggtccgggtcaatcgcatggcactttttccaagttcaaccgaggttcattagtaattaatttattttttattttttcaaataatttcccaatcaatttccaaaaaaaaatccgtatcaaggcttttttttaatttcaaactagacatactagtaatttacttcttatatttcattgaaacttcaaaaaaaattctgcagctcctataggaacccattattcattgaaaatttgacccaaaattacaaaaaaaaaaaaaatttaaaaaaataaataaaaacaaaattttttttttaattttcggccaaaaaatggcggagggcaataattgtgccggtttctgcgctcaccctgtccctgccatggcgcccggccaacttcgtctgccgcgcgttttcgccgtcctccgccgccaccgttcgtgccctcctccgctgctcttcctcgttcacttggccatcctcatcctcctcatcgtcgtcgtctttcttccaagccgcattggcggcacggtcggatgtaaatccgccacagaagcggtcaaagctcagcttggcactcggccgggcgtacacaaagccaccgcaaccgccgatgccgttgtaccttttttgggagcaattttcaatttttatgtattttttaggcgcaaagaatggttgaaaaatgcagaaattttcagtcgccgccccctcgaattttttttcaaaattttcattaaaaaatccaaaaaaaaattttttaatgaaaaattgaaacgattattgtgcgtatttccccttgatttaaaaaaaataattcaaatttgggccaaaaatgtataaggcatgcaaaaattgggaagattttttttaaaaggctcaaaagggggggggggataaaaaaaaaagaaaggcacaaaacggagcgagccaaatatatttttaaatttcctgtaattagtgccgtaaatttcggcaccgtattcccacgaaaaaaaaattttgaaaacttgaaaattcagtcgcaactgttttttttaaatcgttcgactaatgccgtaaatttcgacatgccctgccctccccccaccattcactaatcattctctgtcaaacatggcttctctcacctcgccagtcctctgccgcccgcgcccgagcgcacataaatttggaagaaatcgttgcgcactacggtgctttttttgccccggacggcgccgccgcctttccgccattggccgttgccgccctgcttgcccaccctcggctgctgctgttgctggttgtgttgctcgtacttctgatactgctccctctccgttttccattcatcatcactgacgcgtttttggccaccgtcgcgtgttgcaaatggtcgaacgcattgaccaccaccgacggcaacggaagaagaacggaggcaccaaccagcggacagaagaaggcgtcgaactgcttcaacttgttgtagttgccaatggtataagagcattgttctggcataaaaattttggatttaaaaaaaaatttataattttttttatgtaaagttaaaagcggtgcattttgaaaatttgcaaggcccctctctccattcaaagtgagcgtttcagttttaatacatataattttttgtgaattttagaaccaaaaaaggcaaaaccccgaaaattttgtaaaaacgatttttttttttgccagaaaaaataaaaagggtcaccgtttaatttttaaataaacaaagaattcggaatgattgataaatataatgttcatgatcat

SEQ ID NO: 27071 - DNA, 1079 bp, Heterodera glycines
taacaaatagcactcaaatttccaaaatttttcccggcggcgcctatcggcaccgccggacctccgttttcccactatttttacatggtttttgccttaaaacggccaaaattgggtcatttttagtgaaaagtgcagtttttacccagcagcggaaaaaaagggtttttttttgggtaaatagcaaaaaaaaggtatccagttggagcaaaaaaaaaaagaaaaagatcttcaggtcgggccccccccccgaaaaatgtttctagatagcctctgtgtcttctaactttataaatttacaggtgccggttattccaaaattggttggcatccgcaagatgaggaggaatgggagtacttccgctattgctaccgctgtttggcattcaaagcgccacgcgttcaccactgttcgaagtgtaaccgttgcgttttggtaaataattgtgccataggttcttctcatcattgcgttttcttttgctttagttgatggaccatcactgcccgtggattaacaattgtgtcggacaacgcaatcagatttatttcatcaaatttctggttgtttccatcgttgggagtgtccatgccgccgtcgttctcacgagttgtctctatcaagtcattttctttgtgggtttcatttattttcttgattttctctaaaaaattaccaaattttcagtttatgctccaaaatcctgactctgtacagcaaaaccctctccaaagtccgtccgatttgtccatctcttccttttaccttttcattgcctccattttcgctgtcggtctttcctacggtgtgataattgcggttggaattctgctaattgttcagctgagaagcatttatttggaccggacaggcatcgaatcgctaaaagacaaatgacttaaaaatgacccgcgctgacattgtgccatttgatgttcctttgcaacacttagtcttttcattttttgctcatggattaattgcttaattttataataatgattcatctcctcctaaattcttccctttttatgtgagtttattgtatttgcctataaacacttaaatccgctctgat

SEQ ID NO: 27072 - DNA, 254 bp, Heterodera glycines
tttttttttttttttttgggggggggggggggggggggggggggggggggggagaaaaaaaaaaaaaaaaaaaaaaaaaaaaaaaaatttttttttttttttttttaaaaaaaaaataaatttttgtggggggggggcggggggggcgggggggcccgcccccccccccccccccccttttttttttttaaaataaaaaaaaaagaaaataaaacaccccccccccccccccccaccccccccccccccccccc

SEQ ID NO: 27073 - DNA, 1603 bp, Heterodera glycines
gtcgggacaccaattccgaaggattacctggatgaaaaatggaaaagaaatgcaatgattgtacggaaaccagggaaaattcattggctttacattatcgcccgttgatcagtttgcccaccccctgacgccttgggacggacggacattcactttcccagcaaaaagcataccccccccccccccacttttttacacaatcgaacagaaaatggcgaacaatttgctttttctttcttcataaaaacagaaatgaacaaattgaaaagattgcaacatttgaaaatgcatttgacatttaaaaagaatattataaaaaatgaaattacaaaagcaaattcatcttcatcaaaatttaattaatgagaaatttagttgattttacaacaaaaaaagcaataggtgaaatgcaaatattaatatacatgtacagtaattcaacggtattagaaaaatcatcacaagaatgcttaattatactgaaagaaaaatgtaaatttaattgtttattatttcttttgcgtctttgagtttctggaattccgctcatcatttaatatgacgatcatttttttgtaatttctgctgagataagcaatcaaatcaaatatggtatacattgtcatactgtaattgttgcaaatatttttataaaatatgaaattattatgcaaattcttcggtggaataaactttacggctctatgtgacccaacaaccacctgctgctgctggcgtagtgcctctggtcatccgcaaatcaattgatatgggcgggcaattaattgcatcactaattcatttatttcatttaacaataatacataaattaataattatgacgtttagtagttttctcattaattagaaaatattacatttattcattaatattttaatgattccatttaaaaagaattactcaaaaatggcacccaaaaaattcatgccaatggagttaatcgtggaaattgtcactttcctccaatttcgtcggcgatgggccaatgttcgcgtgtcgagagcatttgatcactttctgcttgaacaaattggcttatttttgacgaaaacgaactcatcggtttgtaacatcaaagcaatcactttttaaagaatttgatcaatttaatggtttttttcaaatttttcaatttttctaagaattttaaatttggtttttcatgcatttttccattaacccgttggacagttaaaacatgtaaaaaaaaagccccaatttgtactatgccccgattcactgttttcgataaaaaattcattaaaaaaacaaacagaaaagattatttgctttttagagatgagaattgaacttttgagtgaaaattggaccaaataaatgggcataagccactacgaaaaaaagaggaaatgcccaccaagcttcatcctgaacctccaccaaagcgcaaaataaacttattttggaattaacaattttaggaataatattttttaataaatatttttaaatttcaggctaaacaatgcttaacagagtttggagaaatgataaagaatttgccatcaaaacacaagagaaatgtttttaatgaaagcgcgcgtaacgaaggcgtgaaat

SEQ ID NO: 27074 - DNA, 1252 bp, Heterodera glycines
tgctgtatattgcccagaagaagacgcagaaaagaagaaaacggcatgcaaaagacacaaaatggaaatttataagtaataaaatttaattggttgaatcattaaatttaatttatttagccaatcggcgcgagttcaaagccaaggcaaagtgacaacaattgacggagttgaattggagatgaaaatagtggaggacagaatggaggtggaaaagcggaaatatgcgtaattaagagcataaaacaaaggaagccattttagtacgatggaattgttgccgaaaatgccaaactgatgcttctcgacggcacaaatttcaaactgttcaacccaatgctcgattccggcgcacccggcggaccaaaaatggacggagtgttctcattggcattgggagataaggtaattaggaggaagcgtcaattgaaaaattcattttctaaggaatcgcccaacgggatggaacaattattagagaagaaagctgaaaaaattgcaacggtttacatgcagccatttgggtaattagttattaataagcttagaaatcggctgggcaaattagccgctctttagagacctcgacttctacagcgaaacgacagcaaagattaacattggcgaggtgaaccgatcaaattgcgattttggtgaacagcccgaatggctgaacattgtcaatgacggaccgagaaaatggtgaatgatccgacagatcatcaaatagaaaatattttaaataaatattttaattaattaagatctaattttttgacgtaaagtccgctcataattattaaattgataaaaacaaatttaaaaattaaccaaatcaggaaaattgggatgcatgtgaatgtgaagaatgaaaaagacaacgttatggaaatgccgaaacagcaagtgctcatctcaacaatggactcgttcatttttgcgccagagtctgtcactaaacctttgatgaaagatttaaagttggtgcaggacaaccaagtctttaaggctggacgaagtcttggcaagacggggctggtatggagcggaggggggggagggggcagatttattggcattggcaaaattcacagaacccaaaagatgtattgataaaatgcccatagcaggaagagatggactaactgccgactttcgaattcaaattcggcaggcaaacattcactttaacgccaaaaaatacattttgaagggttttatttcactaatcatttaattttctcccataaaa

SEQ ID NO: 27075 - DNA, 1157 bp, Heterodera glycines
agcaaaatgctgataaatcagcagagttgggagccctctgatcataatgaattatgtcgaaaaataaaaactcttagaaatataagcatatttggaagtttaaattaaaaatgagaagctaaactaatctcttatttcagagaagagacccctttcaaatctcacaatcaaggcaattaaaacttttatcaaatttatttatttgtttttggctagcagtttattaatgaattttttgttgttgtttttagccacttttttaaaaaatttctcagtgacgaactgaaaacagtgaataaacaatcagtgacgaaatgatcggtcacctaaattacattctatgataataaattataaaatgatttattttgatataaatttgaaaaattaatttcgtttgtaagaattaattggaattcaaaaaaaaaaagaaaatgaaattaaattaatttttgatttataatttgttattgatttccagataattaaattctgtgataatgaatgaaaagcaaaaatgtgctttgataaacaattatttgcagcaaagcgacagagaacggaccaaaaaatagatcaataattctttagtgtttttgcttgggcgagaaacgcaacactcaccaaaaacgggcaattaatgtgttagagaatggagagcaaattgaacacgagagaggaacgaaattaatggaaaatgatgcctttttgcactaaactccccgccccccccccgaaatttagtgaactaaatttcacaaaatataagcctaaaaataggcataattaaaaattgcataaaaaatttcaaatagaaacttttcacagtataaggattagagtatattattagcatttttagcttgttgagaaatttttaggactatttccatatgcatatttgtgcataatttatgtgctattttggtatttggtgcatattttatgtgcattttgggttttttttaaatcctctattaaaagggcagcaatatcggaccgggtcagttagatacggccggtttagtacggccgttttagtacggccgttttagtacgggcggtttagtacgaggggtcggttcaatacgagggtcagtttagtacggtgagctgattttggcgacaatagagtctactgattttttccgaaaaaa

SEQ ID NO: 27076 - DNA, 1116 bp, Heterodera glycines
  misc_feature (164)..(164): n is a, c, g, or t
  misc_feature (170)..(170): n is a, c, g, or t
attatgcaaaaataaataaaaatttctaaaaattgatcgtccataaatatttgtaaaatgatcaggggctcaccaaattttgcagggatacgtatcggaacactacaaatgcttactaattttcctagatttttaaacccggtgaaattttttgcagacaccanccactnttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggaactcactccggccgcttcgcggcctcgtggtgggccttc

SEQ ID NO: 27077 - DNA, 1494 bp, Heterodera glycines
gtagtctttatcgagtctgcatacactcctctttcgtggtagatacatgtatttttttttaattctagattaaaaattttataaaaaaaatataaatttgtattatttttgttttttaaataatgtaccctctaaatttagagattttctatgttatattaataggtacaattactttctatgcattttccggatttttcttttaaaataaaaatacttttaaattggaaaaaagaaaaaaataatatttaaaaaataataatcattaaacaataaaaatatttttctatcaactttgataaccttaacccaccgagcaagaaaaaagtggttggaatgcaaatttattgtatgaaaagtaaaatcaaatctttattagtcataataaacagaagtaataaccatgcctgcgggcacttcaaaattttctggaaagaatctaaaagccacttgtaataagttctcgacaattatgaaaatacatagagaaaaaataatccataacaattttatgcaacataaataaaaataataatttaaaattaaatttccgaaaataaaataatttaattaaatatcaaataactttaagccttcgttcgtaaatcatgtctcataaataactggcagaatttttgatctaataaataaaattataaatataatttaattgaaaggtaatttgataattgcgctgattatattttgctatttaaaaagttaaccttaatcttgattaagtcggcacacttacgggtaacggaaattatggcattttttgaccccgtaattacggattatgtgttacggatttttacaatttttctgtaattttaaatcaaaaactggaattttttgaagattagcaatttacaaaaaaaaaattatattttggaaaaaatgtattaatgcaaatttaaatcaactcagatttaaaatataagacgcaaattggttttcattgagaattggcgggcggtcaatataaataataatttaaacctacataaaaaatgcattttcatatattttagaataaaattattaaaaataaactatacgtatgatttataaaaaattgaaaaataaaaataataaaaaatatacaaaaaaaacctatctaacagattataaatacacgattgcattgtacatgagaaattaatacataaaataaaaatgactataagaaatttttttaagataaaaattctcgttatagtgttgataaaattatattaaatggaaaattcattaagtttagaaaaattattagtttttttattatagcataaataaattaaaattttaaaagtgattgcttcattaataacatatttaaatttaaaaaaagtaattatataaaaaaatctcgtcttaatcaaagagcaaaaaataaaattaattttatcaatttaaaagtttaaagtctattaaaaaatatttttccaatttatatgagaataattcacagtaaaaaatttaatttgaaca

SEQ ID NO: 27078 - DNA, 747 bp, Heterodera glycines
atctccacacgtcgacgcacttcctccctgtatcgtgccggatcgctgcggaacaaaacctgaaattttgatgaaatgatatatattcattcatatgccgaagaatcaatccacttacggcagcatccacattggccggactgttgaagttcgggacgggtgggggcttttgctgggatttgatgaatcattgcgcgcttttcttactgttcggatgaagaatgtcggtgaggaaagtcattgttggcggataagacgggaacgaagctgggaatttgagcagtgccgtaaacgtgcatcccgcgctaaaaaaaggggagaggagggattaatggggaaacaattaatttgattgatttgcacttttcctctgccgccgccgcccactcactatggtgtatccggcggaccatcgatgaaaatgcgccatttgaagatctgtttaaagggatgggactgaaatatgcataacggaaaagcgtatcagatcagttcggtcggtctcacattgccatcgttgacacgcacggaatccgctgtttttgctcgcgctttgcatcaacatttcgagctggcgcatcagcacacttctcggactttccctgctgctgcttctgtggcttcttgttgttgttgttgttgtcctgcctcggcttctgttgctgctgcttcggctggttcttgtcatttgcggacggtcggagtcgttgtggtcgtcggcacagtgaacacaacacaaaaagcggg

SEQ ID NO: 27079 - DNA, 706 bp, Heterodera glycines
ttttatattgtttgaaaaagttccggtgtacgacttccaaaaaatttttgaccaccgaaattacgatttccgaaatctttggcctcggaatgccatccctggtctatacccgttaccaaaacggcattatttggtctttcttttgcacgagaatttcaaatgcatccaaagtctggtaaacaatgtcacggtcaacgtaaacagttgcgcctttttcaatgccataaccaccaactcctattgttagctggttttgccaaaacgattcgaatttataaactagaccagtcaattttagactcaaaaaatgtaacattttttaagaaatttacgaatccagtctcctttttgcaaattcagaacccagaattcgatcgaaccttctcgaaaattccaaatttatttattgcattgaggcattactctaaccaaaaagtagggtcagcgacaaattagcacagcatatttagctaacaattcagatcaagttgccggattattatgagatgtacatacggccgtttttatacatccgatttatttacatatattttagaggggttgaggtttttgttcataaaatacattttgatcactgatgaattatgatcggtcggtcattcttaattaattcatttcttctgcggccaatcactgtttttgttggtttgtccgtcactcatttggggatccgacgcttagggat

SEQ ID NO: 27080 - DNA, 793 bp, Heterodera glycines
atacaatttaaaataatttttgaaatcattaagccataaatgtttcttaccactaattgtaagcaattaattcttgcacattatggcatagatcgctccggacaggtgcgatattctgggcgatgactgtgagccgacccgagaaattttgctgcaaattcaagacgtgctgcagtgctgctctccattaaacccctggaagcaatgcctttgtgatgggtcgacgaacactgtggatatagtaatgaggagaaatttttaaaatttatagcaattagagagagcatttggccaatttttcagagtgaattcgccgcactgccgggggaaaaagtgtccgcgccgaacacaacgccaagcagtagcaacagcagaagccgatgggcccatttgggtgatccgctggaagcggacgacatcatgtacaccagagagcaggcgcaagaaaaatacgacaatatcatggagagtaagtgtcaaaaaatgtatcgtaaaagttagaattttctatcgtaaaagttagaattttcgggctagaaattgatcaagaattccattgggatgaaacaaaaaatgttagggattttcacccttaaagtattatttttggcataataatttccgtttacaaaatgagaaacagggtaatggcatagcataagcgccttatgtttaaaatgttcaaaatttccaatttttccccccgcgcgcctgtcggcatcacgagacccttcaaaaaacttagaaaaatgaaccaaaattgcaaaatttgctgattttttgatgaaatctg

SEQ ID NO: 27081 - DNA, 930 bp, Heterodera glycines
gtctatactggggccccttaaaaaacaaatgtctgaaaaatcctgaaagaataccataatgagcattgataaatttattttagtggcaaaatcgttatgttgtttgccagaggcgctgcttgtccgaggctcctttgctagtaattccttcacgcagaatttaaacaataaaaaaatcagggtattttcaaaaatggaggttgtcgtgaaagaggcgaacatttggaacttttctatttgcagaattacatcggatacgaatatggtcgtctttaagcctctattttttgaacaattatagtgtattttaggttttaaattcaaacgctcgaataagacgctcgccatcttgatacaaggccaaactttgatcttctcatttagcaatgtcgagagcatggtgttttggaaggagtggttgaaggacgtttgtgggcgaagtcatttatcgagccgcacttataatgacagtgcttatttttcaggtgccatgtattttgtcaagtgccataccattccaaaggacaattccgtcatcaaattaaactctcgaagtgcacgaattcacatcactgtatttttgtagaatacaagtgccactttcaaacgttattctttaaagcgctacgccctcgtcattgtccaggaagtgccgcctaaacagcgattgtatctcaacttggaagatttgtccggtaattactgctcggattggtcaattttttgtttttcatctatcagcagatgttgaatgcgttcaaaatcgctttgcgtttcgcgcattgacctacccctggtcaacaccgcaaagctttgtgttcactagcgatcagatccctgaactgacagccaaattgcagtgtctcctgaaggtgcggtcatagggtcttttctgggatgaaagcctcgtttagacgaagcagtagcttc

SEQ ID NO: 27082 - DNA, 973 bp, Heterodera glycines
  misc_feature (894)..(894): n is a, c, g, or t
tgatagccgaaattgagcacaactcgggcggatgagcagtaaacagactacccacccgatcagacagctgatcagcgacccgatgattaggaaaaggaagacagagaggcgggggttgcaccgccaattggcgagttggtcaatgcaaacggagcagtcaatcaactcgcattcgtcgatggctgagcagacggtttcggcggcgcaactgcgggtcgatgagaggctgaacgttgcggaacagccgtaattgttgacgagaaggtcagcggacaactcatattcaatggtggcagcgcccaaccgatcaaagcacgaattggcgcaacaaatcgtgaccttctgtacggcgggagtggaggagactcggacgcctcttctggtgcaattgacgtggtttccgatgcaatggaatgttgggggtggctcgggatggtctgaggcgaatggccaaattccttgtgctggggaggcttggacgcccaggaaagtgacgaggatggccatgatcatggtcgtggtgggaggaatcgcgaaaagccgtgattttcgtcgcgtaagcatgccgctgtgcttactgatcatcggttctcccgaaagtgaagggaccggcggcatttcgtgtacagacatttcggcgtttttggggtctctgaggccttgatcagcagggatagacacggtggcgtccgggggtggttccggggtctgggtttcggtctccagggggcaaagacggctgattggtcgcgtgacggtttgcccattttgcattcgcaactggacgcttctcacgttagggagtgagccgtttagtgcaacgacgatgcccatcggccataaattccggggggcggaggtcctcttcgacgatgaccacttggccgatgttgnggggcggtgggagttcgaaggcgggggactttatgagtccatccggcgcgctctctgatggcgaggaggtactcatgac

SEQ ID NO: 27083 - DNA, 1444 bp, Heterodera glycines
  misc_feature (1412)..(1412): n is a, c, g, or t
  misc_feature (1440)..(1440): n is a, c, g, or t
ttttggtgggataaattttttaaaaatttgtttttataataattatttgtaagctcggagagtctcgtcgttctgctttctttaaaaaatgtcgggttttttagggtttcggtttggtatcgagcgccgtaaattttcggttccatgcggcattagtaattatcacaatgcaaacacacccatgccccagaaaatgtgcctttccaaaaacagagtgatcaggaacaagcggaaccgatgccgatcacgcgcgagcagttgcgccatgcctgcgaatgcgcgttgctcggccacgccgcatttgcgccgtactgcatgcagttgattgcggagaaactgttggagacggagggcggcaccgataacggaacaggcgcctcgggggacgacggatgcgcactgatcagacgacaattggaaatctgcgaattctttgtgtgtccttatgctgttcaaaaagtgccaaatcccgctgccggtgccgaaccttcggcgggtcttgttccgagtctcggattttccgaattttgagattgatcgaatcaatccacaatttattgaggaaagaacatcccattttcaactgggccatcccaaccttcaagtttaatttaagggattcttgaatctcggggttaaaactcgaaaaattttcagtctcggacattccccgaatgccaaagtcatacatcaaaaacacaatcgaattgggctttgacacttttcctcgaaattcatatattactggagacgaacaaaaaagtgccaaatgcttttgctcttcgaaattgccctgtaggggtctaagcgctccattcattggcataactttacattggattgcaatgccatacccaactactcgcattattacggtattatgtaaatttgttactgttttttctcagattcgctcctgcaccaaatttcacgatgtgtccaacagcgcactgcacgaacatgtggacgacctgatgaccgccgtccgtctgctcttcctcaacccatcggtgcagcaacgggaagagacactgctcaaagacatcaccgctactgtacgtgcgattaacttttggaatgaatactgtagttttggaatggtactgtatcatagcttggtaagcaaattatgcattaactcttgggagtatagtaatgggaagcgcatgttttcattggagctgaggatcaagtctactgtaatttggcataaaaccaaaattgattgtgagcatactgtatcatactgtagctagggcgaaaatcaggaccggttatattaatcttatgagatttagttgacattttcattttgggttgggtcaatgcttcccaaatgtcaattaattaattagtgactttacaggtcgaccgaatgttgcatgtgttggcatcaatgaaaggagcataantgcagcgaaattggtcttctgctccaanttaa

SEQ ID NO: 27084 - DNA, 1226 bp, Heterodera glycines
ttgaggaaaaaacaattattagtgctgggacagatatttattaaatccaaaaatatttacataatatttacgataaatcctgtaatgtttaccaaatattgagcataaaaaaattaacagctcataggtattaccacaaaatttattcattaatttaaagttaaatatatatatttttcgagatttttaaatgcatttttccaaaataaataaaattacaaaaatcacaaattttggccaagaaaaaaaataataagaatttctatagggaaatggaaaaaaaatatttaaattttttttattcttttaaatttataatttgtcaaattatgagctgatggcttcaaatgtcaaataaatattatgcatgcgtgatcactgataatcggagcattgaacatcatccctaataataaattttaaatgtcttgaagtgggaaggggttgtttagcacggcggagcagttattaattactaaattacgatttgcaaattcaaatttaattgttcacaaatgcccttcaatttgttaatttttcaaaattggtatcactctgatttctttctatcaatatacatgttttacatgtttttctatgtataatattcaaattattatgtaacactcaaaaatagccatttttggtatgctcacacagaaaaaagataatggaaattacgagggtggaagagaagtcagcgtagcaaagaaatagttcatctcatgcttctttctctaacctccttttcatcccacacataaaaatgcgataaaattccttctcctatatatgctctctaacgcaatgctctctcgccgatttgtgctcgctggcgccgtttcccgtccgcatgcgttttgtattttgtatacacacttggtcggagtccttactccccagtaaattccttaccgtattccttctccactgtctgagtctctctctgtggaaatatcccagtgatatttcgtcttgtgcgcgtacgcgtccgtctgtcactgtccaacagagcgcagagagtgcaaattgaaggcaatggaggggaacaatcggtgccgaaaggtccgtgtgggcggttgcattcggttggagtcggcttgagcgcaaatcgcaaattttttttattttaaaaattgaattcctgtaataatcagtagggaatggatttttaggggcgaaaaagtccaaaataggggcaaaaattttgcgaaataggggcgaaa

SEQ ID NO: 27085 - DNA, 873 bp, Heterodera glycines
tctttccaactaatcatttgccgatcagccataaaagcgaatgtgatatcatttattactaaatcaacttcagctaaacaaaggtcgaaaaaggcggttggcctatggcttgttggctgtgccggaatggtttatggcgccattacaattggaggactgacgcggcacttttaatttattttcaatttaatcatttccttttttgtttaggttaacggaaagcggcctctcaatggtcaattgggacattatcaaaacgatgaagccgccattcactcaaatggaatgggagaaggaattttcaaaatatcggcaatttccagaataccgattgtgtgtacatattattttgtttgatcacttttttttacaaatcagcaaaaattctgacggcgaaatgactttggccgacttcaaatttatttggaccatggaatatcttcatcggatgtgggggagagccatcggacttgtttttctccttccttgcgcatatttttggcgtcgtggttatttcaacggaccaatgaaattgcggatggttttttctggcctacttattgcttctcaagtccactttcattgattctttcgttagggtttccttttccgtctttttagggccttgttggctggtggatggttaaatcgggacttgacccatcaaataattcgaattccgacgtgcccagagtttcacattatcggtgaggactcaacatgccttttcacttaccttattttattttagggttgcgtccccgacgtcggggttggaaaattcggggttcggggttggaagtttcggggtcggggttgccaaatcgttcggggtcggggtttttcaatttttgccttatgccaaatagtcaa

SEQ ID NO: 27086 - DNA, 804 bp, Heterodera glycines
cgtcgaattgttgctcatctcgcggtccgttctgaactccagcagcattttctccaattccagacatgagcaggcgtcggcgaatttcagttgggtccaaaagtgatgaagcaactgaagagacagaattatggcgagcctcgttttccaaacgtcggtctgctaggtgctgtggttctacaatttgttgccccacctgctggtttgcgttgttatttagacgaatgccgaggttgagtgctctttgacgagtaagcggaggcgaccgaagattaggcattacttcgcccttttccacaaaatttacttgtcgaattcggtgagaagaaaactgatgaatttcacaaaatttccgttctgtagaagatgaaatgtcgatgggaattactttaccctttttgtcgaatcagctttgtagacggaattactttaccgagctgacaaatcgttggtgaatttcttttcactttttacttttttgtcgccgcagtagttgaagactttgtagaatttcctacttctacaattccccgtataaaacccgcgtcgaccacacctttttgcaggagcgccacgtacaaataatttaattttactcagcagcacgtcgaacagttcagcacttacacacaattgaagcacacagaataaagccttattattttatgtcaggcaattccaaattaaagtctgaggacaaaaaaaagaaaacaaaaacgaaatcacaaacattaaaacaaaatgccaaaaatatcataaaatcaaaaataaaatgaggtcattattaattacgacataccgaaa

SEQ ID NO: 27087 - DNA, 1573 bp, Heterodera glycines
caaccagggctgggcgtaactggattttcaattacggaaatccgtaatccgtaattatggcgattttctcaattacggaattccgtaatccgtcatgacgggagtcaaaaaaccccgtaattttccgtaacccgtaatccgtaattttcaaaattttaattttttaaaaataattttcaaatttttattttaaaaattcaataattttataagcaatttaaaagcatattaaaaagatttggcgtgaccgaaagtgtggatagacgccgtaaaggaaaattttgaagatttaagtgcaatttgtaaaagattttgcgtcaaaacttaaaaaattaattttgtcaaaaagtaattttgaaaaaacttattttaacattttttggaaatttattagcaaaaatacaataaaaaagggaatacgcctctaaaaaatcgacccaaaaatttcaaaaaacacacacctaataaagtaaaaattttctcaaaaattaattaatttattatttcttgacaaggagtttaaagttataaatatgtgtcccaatactgatttggcttcattttgttgctttatgggaaaaattttacgcatttatcgcctaaattttagggtttagaatagggagaaaatttttggaaaaccctgaatcgaaatcccggttctggatcgggaaatggtaaaaaaaagcgaaaaaaattcggcaaatccgttcgtaaatccgggactgattgcggtaaaaaaaaacagaactggcccggtattttaatttaaatcatcatcaaataaaaataaacgtgaaattttattgcttaaaattgtatccatcacacaaattcaatgaatatattccattgctttttgatcatctcatcttgactagtttgataagagcaactgatcaatggacaagcaaagaattgcttatttctttcgctttctcctcactgaccaacatttcgacaagtttcagcgcaaattcaaaggcagtgcctgcaattgaaattataaaaattaaattttcctaaatttttaactgatttgaaagttaggcgccagacaattgcgccacaattaaaatccgtgggttcctgtcagtttttttttgggggctatgctagaaattcattcgtaatttgatgatttctagggcttttttacagccatattgggggaaggggtggaaaatttccagaaaaatgcattaaaaatagtcagactcaaatttttcgcgctttagctaccccatacgctaaacggaccccaaattttatgcaacttgggttagattaaaaaaaataaaaacttaattatacataaaaactcaaaaaatccctgcaaaaaatcggttgccattcatcaaataaattaataatttttaaattaaattcaatcaaattgttgagcaaggtctctcaccaggtccacggcttgtcaccacattgttgaacacgcacacattgtcatccgtgtatgaataaccatcgccagcaattttgtcctgcgaatatttaatacattattaattgaaaaaaatgttccaaaaatatacagtgtttttagttagaaaacacc

SEQ ID NO: 27088 - DNA, 1827 bp, Heterodera glycines
cactatttttggttatttgatcaaaagaatgactacttcttgtttggttattattgttattggcagttactatacttttccgaagggaaatgcgggcttttagtcagttggtttaagcatggcaacatcattgcctccgttgctacttgaggtaggcataagggattccctaggatgctttctcagtgcgtgtggttcagttttaaaaatgattatcgttttcttgtttcggacatagaatgattggttgattgatttgttctgcctgcttgtgtaaatgcctattgttcctttaagcgcctgaagaagcgtgggattgttgcgtcaaagaatggtatgtttttacactaattggctggttttaatgtgccgttatttcccttaacattcagaggacgaggaagtttttgctgagagttatgatcaagatgacgattcggttggttgttcgcattttattcgtttgatcattttctaatttataaaacttgcagaaattggaaatttcccgtgagaaatatcgcggcggtgcccccggatgtcctaacaagcacaatccgttccacgtctgcacagacttttgctttgaccattggcaggagggctatccggagagtcggtaagccaaacaaacaatggacaagtacaaattaatagttataaaaaatggcggaattgagactatccgataaatacttggagcagcggaacaaaatgttgcggaattacccactgccgaaggattgggtcgaaatttacgacccagggatgcaccgccattactattggaaccaaatgaccgacgaagtgagctaaaaacaacaaaatggggcagattttgaaagcactaccaacttttaggtcagttggctctccccaaaacacccaaaggccgtcatttcggaggcggcagcaaaatcggcaaaaggtttttgtttgtttgttttatcaagaatttttctgttagaagcatggaacatgagcaaaatcgagcgcagtgaaggcgaaagaggcgggcgaagaggggggcgagagggcgacgaaagagagggcactgagcggaggggcaaagagcggtacaaaggcaaacggacaaaggcaggcacaatctttgtgggtaaatatatgtctgacattgaatttggcaggattatgaaattgctttgccggacagtgatgaggaggagggccgaggccgagctgtggttgaactgagtgaccgcgacagactcagtaatcctccattttgtcccccatttctccatttgttccgcaatagaacgtgcaaagcggcgtggaattgacccgatggacccgtccgcttacggagacgcaccgtcgggtggctggacaaccggactgcgagaagtgagctaaaattgggacatacccattaaatggcaaaagttccctcttttctgaccctgagcgtgtgaataacctaattgcattccattttaggaccaggaagtgaagactggcgtggatgtgacggcgtctgggccggtgtgtcttataattgcacttctcatccctttttaaatgcctttctaatttattgccgttctcagctcttccaacaacgtccttaccccgcccctggtgcaattctgcgcaaacagaaccccgacatgtacaagaacaactgacaatgagccgatgtcaaataattattttggaatttattacattttaaaatatttttggtttattttttgtttcttatataaaggctgtttttggaatactccccatattgtaatttatcgcatggtatcccttggctctcaaactttacaataatgcaaatcagcatctttatatgac

SEQ ID NO: 27089 - DNA, 1049 bp, Heterodera glycines
ttataggccgggaatgaaagtcccggtcaggccaaaaatttttctatttccggaaagttatgaaattttttcaaaaatgccaccaatcgatagagctcaaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatgcttaagcggcgccaacccgctccgcttaacccccagcgagttattcccgaaaaacggaaaatgccgaaattgggtgccaaattttgccattttctgcagcattggcatttacagatagccccgccaaataagcgccaagttttcccaaacattccaacttaaaatcctaccagcaagcattttccgctcccgcttcttcccgcaaagttacaggccaccaaagacggacaaaaaaattttcgggccgtttcagcgccgctggcgctcaactggccaccggagcggaaaacctatagttttcctgaatgcgcctcaaaaagttgtaagacccttccaccactttcagacccctcccgacagccgttcgactcaaattagtttttaagacgaaagccaacttttctctatggtaatataaactagcgtgtggcggcgcagtagttgctcggtgtagacagtatacttttggtatatatgggcgggcgctgacatgagcgcttcgcgcaaaggacttcgttgctagtgcatgcgcgtttgttaagtgatgagcaagtgcattcggccgcgtcgcggcctcagacgggcgctttgcggcctcacgggcgccttgcttcgcgcaaaggacttcggtgctagtgcatgcgggttttgaaatgaatttatggatgtgataagggattttggtatataggtatcgcgaggacgcattcataattttgtggaaggacttttcgggcgctttcgcggcctcaaaggggggctccgcacccttttttatatttaagg

SEQ ID NO: 27090 - DNA, 1875 bp, Heterodera glycines
acatatttcgtgattttatacatatctgatacggattttggcttttttctgacatattttcattttttaaacatattttaaggatttttattgaaattttggaaatcttcaaaaaaaacccccaaaatttcggcaaatttttcgtacatattttcatttttttaaatattttgagaatgtatagaaattctcacgaaaaattaaaaattttttttaatgtacaattaaaaattcttgttttttccaaaaaaaaagatattaaaaattattttaaatcgatattttaaaaatgtatgcggaataatgtatttaattatttattcttgttatttagaaaggaaaaagaagttatcaatctgggaaattggtttatttaaaattttgggtgaggaagtggcagaatgccaagaatgcaaacaaaaactttcaagaaaatggggcctatcatcattgaaggatcaccttttctctgcaaaacatgcgaattcgaaatatgccgaacattttataaaattggaagaggaaaaaaaagcgcgaattgttacaaagaaaaaaccaacaattgaaagtgtgataataattaaaataaaaattaatttataaataggaccgaaaatttaaaatggatttttttcgtaaaaattaagggaattaggggcccggcggtgtagacatatatcacagaagaaaaaaaaaaagaaattttaatacaatagttaagaaaaaaaggaataattaagatctagatgagtttatattttcaaattctgttcgttttgtggcgccgaaaattgaaaatttaattcgatttttgttaacagacttttcaacaaaatttccaattttattgttttcctaaatggtttccgcttcatttccataactttattgagaaatcattatatattttaaatttaataatctattctttacaaaatgtctttaaatgtaaatcataagtattctgtgcttctcaggtttcccttcgccgcgaccctttcacaatgatcaattgtttccgtgtgatcactactagggcttatatttatagttgctaaaagctgccaaaatattagtttttagtttctaaaagacccccaaaatagttgctaaaaatgggtaaatatagttgctaaaaactttcaaaattatggatgtaaaacaggggtgcgatcgaaaaattttcaaaataagaacaccaaggcaaaaaaataagatttttggatcaaaaataagaacattttgcgaaattgcttcaaaacaattatttttcaattttttcgatcaaaaatgtattaaatactatatttttagtctcccattattggttttaacaattttggggaggaaataagcaaatcataaatttcagtgcattccggatcaaaaactcagttttttaacatttttttttgcggcgtttttttccaaaaaaaaattggtgaatgggcgaggggatagtgtccggcggtgaaatttttgtaaaattttgggtctgacaatgagtcgttcgttagtgctttatgagcgatccccctcccccccccccaaaaaaaaagaaataaattgggctcaaattagccaattctattaaaaaaatttcctatcaacggcgcgccgtagctaaagtttttcgaatgatttgacggcgccgtcatcggaaattttttcatttaaaaattaaataatttcctctttttgcaggcccgtctgaagaccatcaatgacaccaaactgtgtattcccgaagttttgccgccggaattcatctctttggtcgacccaaatccgaaaggtattgtccaattttttatgaaattacacagtatcaaatacgattgaagattggttcatgtttaccgtagccaaatttaa

SEQ ID NO: 27091 - DNA, 1402 bp, Heterodera glycines
aatatttcaaaattaaaaaagcaaatccaaaaattagcgacaaaataattgctaaggaatttgaaattgaatatgaaacgctaagaaaatggaaaaagaaatttgcttcagtttctgagatgtgctttttgaagagtgctaattgatgaatatttttccattgtaatttttgaaattttctcaaccccctagaaatttttttttgaaatttacccctcgttcccagccaaaatgggctgatcagatcaccatgaaggagtgatctgatcaacttggtgttgctaccttttttgatcagcatccaaagttatgcatacctgaatttttttaggcatttttattgctagaaaatatgaattttctgaagtgttcctaaacatatgaccaccccgaaatttgactatatggaagaaaacacaaatttttacaaaaaggaataaagcaaacgagaaatgtgtggtaccaatggatagcccagaaaaaatgctacaaaatgcattaaaaagattattgattatttttctttcaatccagagaagcaatattttcaaagaatttatttaaaaaaagaggtgttcctaaacatatgaccatgactgtattaatgttataaaagcacagttacctcttaaatacattagaggccgctcttagttaagattaaaaaatgaattgcagtaaaatgttaaaaatcaattaacacttataaattttttaaagctttttttatttttttattttataatttttttttatttgcagatcaaataaatattagagtgcagcgggaccgggaaatttgggcaagaccgggaccgggacttttttggttgaaaacccgggacttttttggttgaaaacccgggactttttatattaaaaagaaattttatagagaataaaaaaaataaaaaacaaatatttcttaataaattggcaaaatattttttttataataaaatcaatacataatgcgctaagaattgaagcaaaaaactaaaatttttgctcaagagagattttgaaaataaataattaaattttaaacaaataaaaaaattaaataataatatcaaatgtacataataattgtagttgcagtgagccaatttcgaagtgaaaaggaatggttaatattaatgacatttaattaaattaaccataataaaactcgaaattaaaaaacaaaaaaataatatgatttactaattgataaacaaaacataaaaattataatttttataaagatatttttaatttaaaatttgaaaattaataaaaaaaatttttacttataataaaaaacctttcaactttttgaactaaaattttttactcatattaactcaaataaatattatattaataaaaatatttcataatattaaaagagttcgataaa

SEQ ID NO: 27092 - DNA, 1096 bp, Heterodera glycines
ccatatttcgttgactgattaattcttaggccgaaatttctcgtccaactaatcgttccactcgttgcactcgtgggttcgatccgttgcctgtgccattcacttctgctgtttaatgtaaaatcccttttcctaaaaatttgcccaatttcattctcattgattgtttctttagctgccgccgatcattcaataatcacttttcggccaatttctcagcgggcctctcttttttctttttgttaaattgatccatacgccctttaatttctttaaaatttttgtctgtccattttcctttttgcttcaactccaatcgatcggacaattttcatttaaatgctttttaacattatttaaactttatttaattaatttattttattatccgtatatgtgcagctatttacaatcagtctcgccaagtctcgtcccctaaggcgggacctccatgaatatagatggggacaagggggtgcccaaaaggtctaagtgccaatgtctgactcttccaatgaccaacagcacagtctttattctggtgtccaatgttcaggatacaatgggcaacccccaacccgattcggtctcggggacagagactgatgggcgggagccccgggcaagactgagagagagaagaggcggatgaacacttataaagagtctcgattagtgaaaagaaggaccgccccccgggctgacattgacgggggaacaatgatcagaggataagagagagaaagagagaattaagaaattaagtatatcaggggcataaatctaagcaaattgtttgaacaaacattttaaatttatattgcctacaatttaattgccagtcaaaagtggcaatgcaaacgatgcctttgtgttatttgaaatgccattcaaaatttaaatttttgaaatttattatttaatttgatttatcgtgaattttatttctctaatgtaatgcaaaagttttatcgttaattttcaatttcctcatttgcaaaataatttaatttcgcttatcaaaattccagagttaaattctttgatcaaaaaaaggatattatcgaatatattcgtcccatttgtcccatttatg

SEQ ID NO: 27093 - DNA, 664 bp, Heterodera glycines
tttagcacattgaatattaattcttatccacttttattacaaattctgcaaattgtttttttttaaatttggtctttgtcatttctaacctccgtccttacagagattttgtttctaatacaaattgtgatttttttagttcagttattattttttattttattttatatttaataaatatttttttgggaacatttgtaacggacacaatgaaaagcaaagcgtaagccatgcttttaaggaggaatgacaaatgagacttttcgattgcttttggctttaaagtagggttcggaccccgtgcccgtcacccccgcccccgccgggggcgggacaggttttttggcctcacccccgcccccgcgactctgacccccgacatccccagcccccgcgaccttcgcccccgcgggggcgcgggggtgaaaatacacccctaataatggcatattcgtgggataaaaggcagaaaatttatacaaatttgaatttttaaccatctttgacaaattttttatgaaataaagaaaattttgctgttaatttccaatatatttgtggattagtggttagtggttcaggagccaacacatgattcataaaaattaattatttatgagattttttggagctaattcaaatcttaccgccgcctccgtccccg

SEQ ID NO: 27094 - DNA, 1049 bp, Heterodera glycines
  misc_feature (964)..(964): n is a, c, g, or t
  misc_feature (966)..(966): n is a, c, g, or t
  misc_feature (970)..(971): n is a, c, g, or t
  misc_feature (977)..(977): n is a, c, g, or t
aggggtgcattttttgaaaaaatgtttaggtcgtttcttaggggtgtattttttggttttattgcatttttgttaaggaattttcctaaaaatgtcgaaatagtaaattttcactattttagtacgaagcgccaaaataggtagtgatttctagtgcccgatagtgacatcagaatcgaaaaatttcaacgaaaaaatacgttttttgagctcctttcttcaaaacaattgaacaaaaaaattcgttaaatcactaaaagtagcgacactaatcatcagaaaagccaaaaaaaaactaaaaacttttaaaattaaaattaatattaaaaaaaataaaaaaaaaggcttcttcgtgatcgtttcgtccatctttcaccattaaaaattccaatttttatgcataccggaagcaagaaaatgatagatttttgtcattttggagtcattttcagaagttctttaacataaatgcaataaaaatgttttttttttgacgcgatgacattttttggcgacatgttcaaaataaatttcaaaaattttccactaaataaatcatcgaaaaataatctcccagtctccattagtctaccaatctccaattatctacccccttctgaggaggttgaaaaataatataccatggcatataaaaagagcaaatacggtattctcggattttttaaatatttttcaatattttttaaattgggcggataccatttttaagaaacgcgccagcactctttaagtttggtttggccactctctgaaagatattttgatttttcacatattttgctttgtgcttttattgtgacttttcttaaatcccatttttacaattgaaattgaatttatgtactccaatgtaacatttaattcttctgccaccccaaataaacatattcttataaaacattttttgacattcatttgatgagaattttgcattaaatgatgntnattnngtgtgntaaaatgatgaaaaaaatgaatgaatggcttaatcatcatcagcaatcagtgaatatgataatgaactacag

SEQ ID NO: 27095 - DNA, 813 bp, Heterodera glycines
  misc_feature (16)..(16): n is a, c, g, or t
  misc_feature (25)..(25): n is a, c, g, or t
  misc_feature (34)..(35): n is a, c, g, or t
ttagcaaaaaaggttntgatttcantttcatcannttcatttttagagggaaaaaaattattaattcatcaactctttttttttaaattttgtttccagccctcaggcttgggtttggatttaaagatttaggatagatggggggaaaaaaatttttgaaattagtggttgcctaatgctaaaataaataaatgtggttgaagttgattaaactaattcccattccccttttagtatggcaaaaatgtttgatttgtcgctggacaatttgaccttggcaacaaagagatgatgcgcagtggacattcagttcggcgcttgacgttttgaacccggaacaccaggtggttaagcagtactaagcgtcaacgacgagaggtaccagtgatgggcagccgttttttttttaaattttttgttgttgtcggtcaacgcatggagagcggttagtcgttagcgaacctattttctaatattttcttttgcttttgctttccaaggcaacaaaaaaacatcaaaaactaaattgtgagagaagaagcagggaaaggaaaaaaaatttgtccaacaatttttgagggtttttttttaaaaaccaaaagtcactaagcaaaggaagacgaaaaaaatcttttttttttgcggaattatttcgtttcgatatcaatatttataaatacaaaaaaatatatttttaattttcataaagaaaatgtttatgcggaaatatttggctttttaccaatgttttgataaatattatatacctatacatttcgttatactttattttctttttcatataatttgcct

SEQ ID NO: 27096 - DNA, 1016 bp, Heterodera glycines
actcattttagcgaaaaatcaacctgaaaagcgaaattttcgtcttttttcttatttttgacataaattaaccaattttttagaaaatttaaatttaatcaatattttcgacaaaattttggtaaaaaatgtctttttcggaaaattttccggttttcggggtcaaaatcccaatttatgcgatgggggccgttctaatagagatttttttgaaaaatgccaaaatataaaatatggaaaatatggatatagaaacccatcctaaagcttcaaaccaagctaaaaacatgtttttcgtgcgtttaaggcctcccatagtccaggaaaaatgtggatttccatataattcaacgccctactaattaggtcattttatggcatttgtgcttgttcacgcttttttaaaagaagttattagttaattttttttcttaaaaggttaaaaaaagattgtccaaaaaatcataaaaaagtttatttacatattttggcttttttgtacgtatttcttatatatttcggtttttttttaatatatattttatgtatatattttgcggttttttcttacatataatttctgcccttaataatggaaaataaattatcaaattaattaattaatgaactaattgattaaaccgttgcgaaagatgtgccttcggccatgtagtcgtgctgttaattgactcatgattggcttcactgttggccgccacatcgtgatcatttgaatcaatcaatgaggagatcattttcaaatatcaacaaattaattaaaattattttgaatttttcaaaaatttgtcaaccaaattctatggttttatatacttatttaatattttgaacattgcgcgaaaaatttaatcgacaaaaatgttggcgttttctgtgtagtaataataatgcgattataagtgtgggggtggttgcctgctgctgtaattgtttaactttttcacttaacaatgtgacaaaaaaaaggaaatcagtcacatttttttattataaaa

SEQ ID NO: 27097 - DNA, 976 bp, Heterodera glycines
tattattgccatttaaaacacgcagaaattattttgcaatttactggaattttattaaactgttctgaaatatacccgcatttttgtggatgcgatgttaatgagaaaaagcaattttgcttttttaaatattaaaaaaggcataacaataaaattttcctattccaataatgtatccaaagagtcagaaaatgggcagattacaatttatttggagttattattgcctttaaaaacccgcagaaattgtttttggaattttctggaattttattaaactgttctgaaatatacccgaatttttgtggatgcgatgttaatgagaaaaagcaattttgcttttttaaatattaaaaaaggcataacaataaaattttcctattccaataatgtatccaaagagtcagaaaatgggcagattacaatttatttggagttattattgccatttaaaacacgcagaaattattttggaattttctggaattttattaaactgttctgaaatatacccgaatttttgtggatgcgatgttaatgagaaaaagcaattttgcttttttaaatattaaaaaaggcataacaataaaattttcctattccaataatgtatccaaagagtcagaaaatgggcagattacaatttatttggagttattattgccatttaaaacacgcagaaattattttggaattttctggaattttattaaactgttctgaaatatacccgaatttttgtggatgcgatgttaatgagaaaaagcaattttgcttttttaaatattaaaagaggcataacaataaaattttcctattccaataatgtatcccaagagtcagaaaatgggcagattacaatttatttgcagttattattgcctttcaataacccgcagaaattattttgggaattttctggatttttattaaactgttctgaaatatacccgaaatttttgtggatgcgatgtta

SEQ ID NO: 27098 - DNA, 2011 bp, Heterodera glycines
atgaagaacaaattcgaaaataaggaatgattttttcgaggtgcacattacctatccgatcggttggcgaggcactgagccaatttatttcggtgctttggtcgggggagtgcatttggtggacgaaaagggacacttcgactacgccagtgcggtcagaatgacattcaacgtaaggagcggagcggtggaggaaatcagcggacggtggaagaaacgattggcagaggtaaaacaaaaagtgatcgaagagaaatcaaatgaaaaataaccaaaaaaaaagaaaaaagtttctctaattatgctaataaatgcttttccattttcagtttttgtccagcaaaacttcgcccgccagcggtgagaagggaaaccgccaaatgaaacgctaacacacaaataaatggcctttagatttgctcgaatttggactgtatcacaatgaaagtctgcccgaggggttacaggtgaaaagcgaacgaaacgaatgtttgccattgccccccccccccaattttccaattggaaggacgtggccaacactttgacgcccaaattggccggttgtgctcttctgctgtttgtgttctgtctcgcgtgcagcatcgtttttctcaagtgatccctctagaattcgcctacatttggctaatgcctttggcttttcactctctcctccattattccctccctttcccccccccccccccaaaagtgcctcttcctccggcaccaaagtgattggcatcgattgggtgcgcagtaagcccattctcggtgtggctgcccttctctgtcccgcgttggcttctgtttcggccttcggtgcgctcctttggatgggctctctgtacaatgccattgtcaatgtttcgccgttcatcgttctctgttccaatttgtccttctttgtctttaatccatgccaatttgccctaaggcgttggcattgacgacgcttttctaatgaccgccgcttggcatcgcacagacccaaaactgaaggcggagcgacgaatggccgaaacgctggcagaagcggcggtggccatttcaatcacttcattcaccgacatggtaaagatttcatctctggttaaggcagactcagttcgcttaccgtaatgcctttcctaccgtaatgcgttgttcccttttggcatcgtcccttttcctttcagctttcttttggcatcggttgtttcaccactcttccggtggtccgtctcttctgtctttacaccttcttcggcattttcttcacttacctttaccaaatcacttattttgccgctgtgatggcttttgccggccaaatggaacagtcgggcgatcattcgcttctttttggtcttcgcgcactccgtcccgaggaggcgggtgggaatttaatgggactaattaaccccaaaaatatttaattaattaactcattcagacagcactttcaaaagatggatgttggccggttcatcagcagaagcagcagcagatgagggagaagaaaaggggggagaaatgaagccaaacggagccaaagacgggaagagaagggaaagggacaaatgccaaagggtggagggaacggaggaggacaattggcaaacggagggacaaaaggaccaaaaaagggacggacaaaaggaccaggaagaggttggcacaggcatttggaaaaacatttacaatggcaaagtcccattaaagtgccatccgtcgcatttagcgcaacaaacgctcgtcaatcggtcgctttttagcctcctcactctttcactttctctttcatttcgctgcttaaggcttttccgcgaaatttacggcccatttttgctcactaaacggaccaaactttacgttttgctgtgctatgtgctgttccttctgttctctttgctcggcatttggcaaatgcgcgagggattaaacccaaagaatttaatccgaccaaggcgaattagtcatttgccatttgaatttattcaacccaattttgctttttcagctttta

SEQ ID NO: 27099 - DNA, 1334 bp, Heterodera glycines
cttaacttgccagatcggacgggtgcgcatgattccactgttccaagcaccccaccaaaagcaaaacgatataaccaaaatataaggaaaaattttttctccatcttcttttttgatactaaagcatcagagtgctaaaattaagttgtaaataaaattttggtgcactttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagtta

SEQ ID NO: 27100 - DNA, 968 bp, Heterodera glycines
agctatgacggcaagtaaggatgatcctgtgagacactattatcccaggaaatgcgttggaattcaacatttcaacaactcccaccaaaccaacaaaaagaaatgtataatttggtaaagaatgggccaaattcggcctcttctagccgaagtccacagccatttcaaagttcaaaccaattcccatcaaaccaatttgggtcaggtcagtcgaacagattctgtgcttaattagctgaaaattaactgaaatggagaaatttagctaaattacgtgcaaattaatttgctgatgttttaggcactgtgccgttggggaaagcatatttgggccaacaaccattggtggcctctggttcatcaagtagaccattacaatccagcggcacctttttgagaccaaatcattcgagaaatcctagatttaactcatcaggcaactttcaagtaccacagaacagttctgcaaatgcttccgccagttcttcatcgtttcactcactatttggattggaggaccctcaaaagaacactttcgaatcgatgttcggatcaaagaagggataaagcagcattatgtgctaatgagctaagagagaagatgagaaagaaaagcatgatgttcgaccatcatatattgttgaccaatttcatttctgtcccttattttttgtaacgtcctttttctttcataaattactttactaggtcacttcacaaaaagtgcaaatcggggggggggggtaaccaaaaaggcaaaaatcataaatctgactttttctatggattttttattaataactttcagtttttgtattcgaataaataatcattaaaatataaaaaatattaaatcaaataattggctgaattttaaaatatttatgaaaaattttcattccaaatggactaaaataaataatgaaactaaaatatagaaaactgatataggaatgcatccgtttcac

SEQ ID NO: 27101 - DNA, 1588 bp, Heterodera glycines
gtcaaattggggagaatgcgagcgcgacgacggcatctgttggtaataatgattgtgacttttttttgacttttttatatttttgggatttttatgaaatttttgcactttttttgactttttcgtgactttttaaggcaaaatttgaattttagcgaaaaaaattctgaaaaataaaggtaatgcaaaaaagtccatgaaaaaaatagccaataagtcgcaaaaaggcaaaaaaaagcactaaaaatgcaacaaaaaaaagcctgaaaaattaggcaaaagttaaaaatcccattttttaacaactgtattagttgattatttataaaattttactgcctaaaaacccgggtctctatttataaaatgctatcctataaattgttgaaaaatgggattttttaactttgcctagtttttcatgacttttttgcattttttcgtgcttttttggcgttttttgtgactttttggggatttttaatgacttttttagtcgactttttggagatttttcgtggcttaaattctcagccctaataatgacaacagcgaatcactggcacaaatttaaccagtaaaaatggtccaactttttcgtgccattttccctcctccgtttgtcttcccttttcagtccgcttggtcgtcccatttctgcgctttcttcctccggcgaaaagattttcctaaacgcaaatttcgaaagctttgccgaattcgactgtgccttcgaagaatggaagagtctgtacaagcatccattcagagttgccagttcagagaagcaccatgacgcgaagttcaaatatcgctacgtggtttaccattgttcacgctacggcgagccgaggaaaagaggtgggaaaagtgagagagagagagaagacaaggggagggaagagagtgagtggatggagagagagagacagaggaggataagggatgtgttgagaggtgctaggacgaagtgacaaaaatatcagtgttcataataattaaattttattattatttaaattttatttgctaaataataaagcataacttagcttaagacttaatcaaatttattcatcttggtattagaatgtagctctcatattctctaatatctatgtaatttttaaagaattagtaaaaaagttgtgaccaaaaacttccaaaaaatttagactcaacaattttgactagagcccggaaatttcaaatttgcggatcctgttgcaggattggaattcaaaattttttgccggaccggatccggccggattaatcctgaaaatcctgcattttccaaaaaatgcaggattgcggactgggatcctcgaaaatcctgcgcaggatccggtcctgctccgggctctaattttgaccctaacttttttgaaattcaataaattttttcgaaatttaactgaataatagataaatctttgagctatctttttatatcatctgaataattgaatgtttgaacaattttatgcatttaaacgaccttacattttaggatgaccataaaatataacattattaattccttcataggaagtcagaaagaaccaatttatttttatttatataa

SEQ ID NO: 27102 - DNA, 1900 bp, Heterodera glycines
  misc_feature (20)..(20): n is a, c, g, or t
atttattaaatttaaatttntgtttaaaattttgattattctttttttgttatttgaaataaaatagaaaaatttaattaaatgcaacataattaacaaagtccagctgttggttgctcttttgccctttcactgccattcattcatcattgatcgtgatgtgcatggagtcgtccagtccgcacgatgaatgtgtcctctgcctctttgttgccaattgcctcttccgcttccgtgctggtaaaagtttccgccacgtcctcgtccgcgtctgttccaagcaccattttcttgccaatgttggatctctcccttcctctcaattaaacccaaaacgttttgcacttcttcgttgattgacaacgccatttgtcgtatttcccccaactttttgatcaccccttcatttccatttccttcacttttccacccattgcccaatttctttccttccggaggaatttcttctcctcgtctccccacaatatccatttccgccgaatttatttccgcttttaataggcgaaatggattcgtcgcttttttcggttttatcatttccgatccattttccattttggtttttgattttgctctgtttaagcaagactcaaaaaatccgaatttctcggtttcttgccctttcagaggctcgtacagcatttgctcctcttcttcgagatttaaataaatctcatcatccacaagcacttgccgaattctttgcttttcttttctttcttcgatttcttcattactttcaccaattccttccttttcttccagattttggacttttttaattttattcatgaccatcgctttttcctcttccatttcatcagttttccttttttcggcctttttctcttttttcattttcgccaaactctttttcagttttgtcacttcctcttccagtcttttttgagtcctttttgcttcctcctccttcatttcctttttcaatttttccacttctttttcaaatttcttttgagattcgctgtttgcttcctccttttcaccttttttgggctcatccgttcccaacatttcttcgaaaagatggtcaatcgacgacgacatttctaaattgtttttaagttccattttggtgtttatattgttatttctgttatttatttcgttttgaatgttatcatttgccaaattcacatccgtaatactcaaaaaattttttgttattacatttatactgtaattaaaaatgtcattttcattttcttctgcattttctttgtgtgtaacccaaatctcaggtattctttgaatctccacaaattgattttcctcccaaaataatttttcccaatacgtttcggtatcatcaaagacttttaaagtccatctctctccaattaaaaattgtatgtccattcccaaaataattttgtcgcttgagttattaatgaacacttcaaaactctccccgaagaaccaaaactgcacatatttttcattcatttggttttcgtatatttcccaatgctcattcacaagattttcagggatggacgaaattaatggtacaattgtagggtttaaccagcctgtagaagtctcaacaagttcagattccaaccaaatttccaaaattgaggaaatttgctcgagtctgaattcatgccacaaattatttggaataatttcagggccttcctcctcattttcattttggctttccctcacaaacgcaattcccgcactttcctcctcttcatcactgctctcaagcccaaattttgatacattccctcttattttattttcagtaatattttttggttcttcaactgttttttcaatttcattttctgatgcattgctttcatccattacctcttgctctaaattgtgatccgcatattatccataa

SEQ ID NO: 27103 - DNA, 1763 bp, Heterodera glycines
gccgtaaacgatctaacattgaaggaacgaattggtttatgtagtttgtttccgtgcatttaaaccggttttgaatcaaaaatgctaaattcaaaaatttgggtttttggctttttgttcgaattcgggcccggggttcggaattcagaacgatgttattatagaattctactttttatacctagtacaatgcttaatgctgcaaatctttattttaaaatattttttatcactgactcattttccgggcacgcgttagatgggacagaataaaacgaaattggaaaatgaataattaaacttcaaaattttcttcaataaatctttttttaaatgttttaataaatgaataaaatatatattttttttttgaataatttatcttcaatgatttaaaatatacaaacattatttaaaatatttataaacaaaatgaaaaataggcaaatttgttatgacccacaaagaaattaaaattgaagaaaagagaatttaaatatctacataacaaactaatttaaaagagaatttgggtgacaattttatataattttggtgttttttttcttttacattcaatcggttccaaattgtttcctccatcttcttacatttctcatgcgaatttccaactttttggcaatttgtgcaccactcaaattcggatttttctttttcattcggtcaaacttttccacagattccaatttttcagtttttgtgtattttttctgttttgctaaaataatatttattttaaatataatttagttaaattaaaatattacggatgaattgtccgagttttctcccccaatcgaaaattgtcctcactctgacgccaaatttttccgcaatttttgcttcaattttctgagttgttttcaaattgaattgcttttctaactgttctttacacttttcgaatttctcaattatttcaatttttcgctggtttgagaattttctcaccacccctaaagtggtgggtaaaattaattattttaattaattagttaattaggattccactttttattcgatattattattattataccaaattccttcttccatttgtaaatttttgtccgactaattcccaaatccttcgcaatttctctttcaattttcgctatgtttttattttctaatttaaacccataaattttttcttttcgcatttcttcaaattttctgaccaattccctttttgtgtcttcatttatctcctccttttcttcaattagcttctgtgattgtcttaatttccttttcatttcatcaatttagtttagactgttcgacaattttttagcagtgtttttttcagagtgatataaggataagtttctataaatgtgatgggagaatgattgtcagtgtcatcagtatatgtcagggtaggatctggagatcttcagcatgatcttccagggggtttccattgggatatttatagatattaaggtatcagacgataatgtcaggaagggaatttttggaatggttgtcaggtggttggaattttagggaaaatgccagcaaaaatgcttttgcatgattttctagcgtcatacggacatataataaatatggagttttcatagatattttatggataagaggataaaagatattaaatttttgagtgagctgattcagaagagtgcagcagatcgtcagattgcgaagagccagagatggtgggatcggaggattgtttattgtcaatgccatctctgatcatgtggtggtatatt

SEQ ID NO: 27104 - DNA, 829 bp, Heterodera glycines
agcgcacggttgcgcacgggtgtttaccgcacaaacccgtgcctatgggaggggcgcagccctttgatgttaccgcccggggacattttcccgcacaatcccaagcctataggaggggtgcgtgccaaccgaaccctatgtgaggggttgtttctttgaagtctgccgccttgtagatttaatttactcaaatccgcactggcgattttttttttttcactccccctctccgcgccgcgcagcgccgcggaaggtcatcaatcatccacctgtcaccaaagtggcaggtgaaggaaattcaatttttctttgaaaatttaaaattttgaccccaaaccttttagcattttattttcacaaatcctgagatttttatgatgggtttttcggatcctgaaattaaaaattcatttttgaaaatgtgccaaaacagtgcgggttttttttgcatttcctccccgctcgccccgcgccgcgatgccgccgccgcgaaaaaaaaaaatcgataacggaatttggaagaagtgcaaattaattgatattggcagcaaataatatcaattataaattggacaataaaattaattatttaaattgtgtttaaaaataaaaatcgaaaatgaataaataaatcggatgaaaaaccttttcaaaagtaggtcacctgtcaaccaaaattgattgatgggtttttatttctcttccattattccccaaactgtacgtgactttttgttccacttatttcccagtgtggaccattatttagggcaactggcaataaaatgggatttgattgttttcttattgaaaatttcaccatattttt

SEQ ID NO: 27105 - DNA, 857 bp, Heterodera glycines
ttatcctttctgtcacccccctgaaaattttaaaaaaataattttttctatggtaattttatgcgctgatcgcgtaaaaaggccttccttgggggtttttcgaggtcgctgaccacgaatctgacatccatttatattaattcagaacccgaattagaataaaaagttgaaaattcaaatttttaaaattttcactattgccctaaaattgactaaaaacaaaaattagtcacaattttttgaaacatcaaaaaatgattagattcgtgttccgcgcataaaaaattctaaaaattattttaaaaagaatttcagggggagggggggggggggtgacaaaaaggagaagtacgaaaaacaaaatcgtacgtttagtaaaaatgaaaactaaaatcctatttggtaataattttaaatgcgcagtttttaaattttatacacaatttaggacggatttgctcacccaatgctatttttgcagcaaactaaattaaaatggataaagttccatttggtgttgttgttgttgtgtccgtacccaaactctggacttttcccggttacttttcagcaaggcttcttttaagacaatttattaaaatggaaatcaaaagtggaaatgcaaagttaaataaagaatgatcgctttttaaatagtaagaaaacaaagccaattgttaagtgagttgtatcgctttaggcagggaacctgagtcaacgaatgggtgagtaaaatcctgaggataagagaataagcaaagacttaaataccaatgacaaatgggaggggccaaacagatggaattacacaatattgattggaagaatatttgccgatggattaaacgaaggggtca

SEQ ID NO: 27106 - DNA, 1036 bp, Heterodera glycines
tttttccggttttgaatcgcggaatcgtggcgggtttaaaatttaaaagctgaaaagtttctatgatttttaacaaaaaaatcatttgttttttttttcattttttagaccctgaaatagtgcatgaaaaggggcgggttagacgacgagggaattttttacaaagggacgcaccccatctaatttttgcaattttcagttccattagagcccaaaatcccccacctaaattgactagtgatagtccaattaaggtactattacatccacatttatgtggcacccaaattttggaactgtctcgccctcgggtgggacttaaaagaaggtggaggcaaatgtttgaaattttcaagtcaaaattttcgttcttaaatataatgcaatagttttctcgctttttttcacggttttgaatcgcggaatcgtgcgggtttaaaatttaaaagctgaaaagtttctatgatttttaacaaaaaaatcatttgttttttttttcattttttagaccctgaaatagtgcatgaaaaggggcgggttagacgacgagggaattttttacaaagggacgcaccccatctaatttttgcaattttcagttccattagagcccaaaatcccccacctaaattgactagtgatagtccaattaaggtactattacatccacatttatgtggcacccaaattttggaactgtctcgccctcgggtgggacttaaaagaaggtggaggcaaatgtttgaaattttcaagtcaaaattttcgttcttaaatataatgcaatagttttctcgctttttttcacggttttgaatcgcggaatcgtgcgggtttaaaatttaaaagctgaaaagtttctatgatttttaacaaaaaaatcatttgttttttttttcattttttagaccctgaaatagtgcatgaaaaggggcgggttagacgacgagggaattccttacaaagggacgcaccccatctaattttcgcaattttcagttccattagagcccaaaatccgccacctaaattgact

SEQ ID NO: 27107 - DNA, 1496 bp, Heterodera glycines
actccggctgaatccattgttattcgtgccacccgtgctaatttgagtggagtcgcatctaatgatgacggcgggccaatgggcagctttttgggtccggtaacgtctactgcggcaaccaaaaactcattaaatcaacaaaatatggaaacggcgcgtccaatcgcacgatatgccgtaattccgcgcccgatcagtgctgtgggtttttatattaggagagtattgggtggattaattgttaaatttacagcgatatgcttcatttactggcggtgctgatcatctcccacacatgcccaatcagcaccaaatttctgctagcggaacaagacaacgtttgggggcattctccacgacttttatgattaccaggcgagcgggtgaaattgacgcaatttacattttgattaatcaattgcattggacaatcagtcactaattattagatcgcttttgctatatttgacgaatgagaattttggtggctagggatttatcctgctgcaacatggacttaagaattgttactcatcgtcagccttttcaacaccaccgaccgatttcttatgcgacggagggaatagtcgaatatccggcccaagaatatggggagatacatggacaaataatgaacactccgtctggaaaccataaaatacttgtacaggatgaggaagtgattatcgaagagaacgatgaacgagtttagaaagggtgcagacttcccattttcaaggatcgatcttcgattgattgctgacaatgaattcacttaaattttttatataaaattttctcacttgaatatttctctcgtttgaattaaaagttagtttatttcttcatatcttgtatttgattcatgacatcattaatcattatgcattttaagtctttgattctacaaattgaagtcgttttttgtgttaaatgggttcgatttttgatgaaattgttcaaagggctgaaaaattgcacagtgatgttcgtttgggcggcgtcacagaacttcgtcttcccgattcgtccattattcctaccgatgtacattaatggatcattcttttcctatcgtttttatttattccatcaattgcagagaggaaacggcacttcgtgttccgctgctttgttggacgctggtttagacgatgtattcagacgcagtgaagagatttggtcgagaaaacagtcactgcggccgacggccgtcggaatgggcgcttcgctaaagacctaccaggacttagttggtggaactgttcattcactgtttaaagattaattcaaaataatcattcagagtcagctttcatccacccgtctcccaatgtcaaaagttgccgaaaagcctccgtcggctgatgcttctgaccgttacgaggatataaacactgatgttttgaatgaacgatttacggatgcggaaacaaacaaatttgtgcaacgtacgattgaacgagctcagattgaggcggagcggaccttcctca

SEQ ID NO: 27108 - DNA, 1345 bp, Heterodera glycines
tcctctatttacctgcaaaattgcgaaaaatttggttaaggttcaaaaaagttatggccagaaaacttcaaaaaactggttttctaaacaattttggccggaacttttttgaatcttaatgaaaattttcacaattttgcagaataatagaggaaatatagggctatcgaatgatagcaagaaagttggatttggttgacaatgaaaaaagttatagtacaaaaactgcgctggcgcgaaaacgaccccgacccttagcaaatgcccgtaaaagaagacatttaaaatgattttaagattgtttaagctaaaaatgttttgccatttgaagatattttttcacatttcaatttgctcacttttgtttccgtgccttaccgaattaattttattcttattttatgatttcaatttctttagcttcccatttctcctttctatataaaggaacagttgtgatcaaattttttagtcaaaatgccattaaattaattaaaaaattaattgtaataacactttggcgcaaaacaatggcatcgacgtggataatgccacagtaattgccattttgaattatatattttcataaaaaagcacaaaaagatctgctgatcaattgatttaaattaaaaaggacttttgcgcattcttattttattctttttgcatttctttctactaaatcaaaaaactcttcccaaaagcaatgccaagcgaaaacaccggtggaatgatttggagaaaaatgatgatcactaaaaaattaacaaattcataaaaagaaaaattctgataaaaagtttgcaataaaaaacatttaataataattgtcggagggaaagggcgagaaaaacatggaaaaattatcattattattattattcttattattgttattattaataaatgattctcgtggcaataaaaatgaatcgtaaacaaaaattattaaaacaaaaagcgggaaataacatggcgctatcaaaatgtcgttgagtcaaaatgtcgccaaacttaaaattatagaaaaaatcgaaaacaatatttttttgtgaagaaacgatcattaagagatgtatgggtgtatatattgctaagtttgtccatataatagtatataaaagtataaaattaataattctatcatttttcgatttttccactaattttcagcttggctactttttgactctttttagcttcggcgacatttcgacgcggcgacattttgacgggcggcgggaaataacattttttttaattaaatttcccataaccactagaaaacaagaaataaaaaggacttttttgataattattacagtttttaattttgtcaaatcca

SEQ ID NO: 27109 - DNA, 1416 bp, Heterodera glycines
  misc_feature (49)..(49): n is a, c, g, or t
  misc_feature (1398)..(1398): n is a, c, g, or t
ctgatccaaatcaaaagtaacgaaaagaagcaagagtactactaccccnttgaccaaacacatgattactagttagaattaataatcatataagtaataaatttaatttaccaaaagaaaagctaatcattaggggtgaatttttcacttcaaaactcaatctttaggggtgtctttttcccgaaacttctttcagtgccttcctattcaaattaaaattttggaagtttaaaaatctgagtttgatttcttggcattgccttcaattgttttatcaattataatgcaattttgtttttgataaaatatattaatactatattattattatttttaaaactgtgatatctttttattctttaatattttaattatatacaaatattaatttttattcgaaattgctcaattatgatttaatatacatccctttcaagcattatgcttattgattagatgcatttttttaattcatccaatttaaattttagcgtataatttactatatatttttttttattaatcagttagtatttttattaagttattaacttttgtctgaagaggcgactccgtgtgaaaacggcgcgattccctcaactgcaagcggacaagtcgctcgcattatccttggcgtgcggccttatgctgctggcgttgttcaaattctgggtcttgcttcggtgctgagtcgctatataaaaatcatcaataagggcgttatataaaagccatcaaatgaaaattttcagcaaaaaactgcacataacttttgttataacgaaaatttttcactatacgtaaaataattttaggcatcaaacattctgaccaaaactttcttagaactaagaaaattaagaaatcttgttcgatagccctacgtgtcctctattagcctgcaaaatttcaaaatcggtatgtttcaaaaaagttatggccaaaaatgtttgaaaactcggctccttggagtttttgttgaaatttttcatttgatggttttttatataacgcccttattgatggcttttatataacgacatagcacccttggttcgcgtcgttttcttggtcctgctgctgaagctgtcttgaggaacgtccactttctaagttcttcttcaaagttcgcttgccgcactctttccgctcgttcaagtaattgttaaaaataagtgtaaaacgatttattcaaataccgtatgaaatggcgtttaaattatgtatcaatttgttttttagttttagttgtatcaggtctatattcacttttttccaaactacaaaatttttcttcaccttaccagcctgtttataatgcaattgtttcaaatccatattcttcttttttgctttatattgccgaagcattttatttttatttatttgtctttcaanaaattaattaattagaaa

SEQ ID NO: 27110 - DNA, 1476 bp, Heterodera glycines
  misc_feature (28)..(28): n is a, c, g, or t
  misc_feature (46)..(46): n is a, c, g, or t
ttttaaaatttatttataatgccaaatntaatggattttcccatgnatggcacatgtctgtcctcctgtccattatgtgttccttctcccatttcggcaccattcctttcatcttcgcctcccccagtagcaatgatgggacggagacggcacagctcacaaacacataaaaagatccatgccgtgccgaacccatcaaactgtggggatggaatttgatgggaatggttggggatgaacacagcacacacagtgggagacaatgtgatgatgaagatgatgatgatggtgatgacataagacatagtccatttggagagcttaaaacggggagccgaaagtcggggattggtatgccatgaaaaaaagagactttttacattttatacccgaaaaatttgggggaaaattctttaggaaaaattttatttagtttaaattgcttaaggaacaaattaggaccggttttccattaaggggaaggaaatataggggaaaattattaattttttgttttgaaaaagaatttacttaaatttttcatgatttttttaaatatttttttcattttagaatttttttatcaaatttttttttataaagttataaattaaaaacgccgataaaattgggttttatttctgttttggctattaatgaaatttgatacgtgcgcaaataaataattatagttttgcgagggatcttcagcacagcagcggtactttatggggcacctttccattgaacttaaaagggtgtggcgctggggtcactataatgaaaagttttggacggaaatttaacaatggcatgctcagagtcttactgtattgactttaatcttgtttactgtatcgaaaaagaagaaaaggagaaaatttaaagaaaaaactattttttaatttcgtttttaatatatttaaaagaaaattaatatcaaaagattaattttaaatttaaagaaatataataaaaaatattaattttaattttttattttaaaagaaaatttaaatatcatcacaaaaaaatattaattttttaatttctattttaaataattaaaagataataaaataacaaaactttagatgaatgatggataaagccttgtttattaatttagctattttagtattttattgattaattattttgaaaacatacattttttaaattaaattattggaataattgcattattttttcttttttcattcttaaattttcattttcaactatttttaaattcttttcacattcgattaatttttttttgtaaattatttaaattaacattaatatttatgttaatttaaattaaatttcttattttttccagggacaattgttgtgtgtgagggtgggctcgcttcattgcattgtccggcccaacatggaattgtcatccatgaagcaaattttggacgctttacactgcttgagtgcaccccgaacagactgaccaacatc

SEQ ID NO: 27111 - DNA, 1452 bp, Heterodera glycines
tagtcggtcacattcgggaaatggtctcgaattttttcggcaattacgtgcaatcattttaaaagaaaaaaaaaacataaaagctaaaatttattaatttttttagcgcaaaatcaacaacaaaagcgaaattttcgcttttttgcttatttttaacataaatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaaaatatggaaatatggacataaatcgcgaaatatggaaaatatggatatagaaatctttcctagaagcttcaaaccaagctaaaaacatgtttttcgtgcgtttcaggcctcccacagtccaggaaaaaaatatggatttccatataattggacgccctacttatctaatatatgtgttttaatgctatttattaagtaatcttttccaagtgtcaatttcttacattttttttgccttttcgtcgattttcttttccctctcccccttcacctcactcttttctttcgtttctcctgcggctgccctcctctttttccattttccctctcttcctctttattctttctctcacttcccatttgttttggtccaattccctctcccccaaactcaatgaccaattaacatagaattttacaaaataagtctgtctaaaagttgctgaaatttatcaaatctgtccacctgtgaacttttgcccattaattttcaaaaaatgccctcatctgaaaatgtaaaggccaaaaaagccacaaaattttatgcacttttaaaacattgagaaaatgatttttgatgccttcggaaccgacgagacagaaaatacaaattattttggccattttcagctctgggccatatgatcaatattttcctataaaattttggcacataaaaacaatcgcacatattttggctactttggaatttttaacacatattcatattagggaaaaatctataagagaaatacaagaaaattgaaaaattcacccttaaaaactaactttcttttctttatttatttcgaattccaaaagtggccaaatcgaattattcattattcgtcattggacttcgaagttccctgctgaaactttcaatttacaacaaaacaattttatcagaataaagaacaatttaacccgaacacctcgaaatgtagatttgcaattgtgcgggcgaaaagacaaagaatgaaaattttctgggatttttatgtataaatacaattgattttttcaattttcgcacatttttgacatttttttttggtttttagcactatatatgtatttctagcattttt

SEQ ID NO: 27112 - DNA, 1416 bp, Heterodera glycines
  misc_feature (1293)..(1293): n is a, c, g, or t
ttccatctgtttagacaaaacaaaagtcattcatttccaatcagtccaaataaattccatttgaattgcattttcggcttttctcatcaatttaatttaaacattttcgaatataatttcgaatataattaattaattgaattattttcatttgaaactcttacccttgggcagtattttaacagatggaccttaaaaagtgagattaatttacgctgtttcttcaaaatatggccaaccattccgtccattgtcctcgcattttccttcgcccttttcactgagtctctttcggctgcgctgaaatggctccatgggagatcgcctgaggggaaacaaaaaaaaaacaaaggcactccaatcggtgccaaaggcgacaaaccggacataaactcgacgacgacgctaaacagtaattaaatgtggcaatgagctgctgtactcactagaaccacgactccaagtcgtccttcggcgacagttccatcgcgcgatgcgccgccagcgaagcgtaacgaacacttcccctgagggtggggagaagaacacttggccaaatgaatggccatttaattggccaaccatggagtgctttccctctcttctcacctgaattgcgttttctccctgggcggtttaattccgccggtggccgtctgaaagtgtcggcaaaggccaaagtccaacaaaattacacggccgccactttgtccattctcttcggacagagcaaaattggttggcttaaagaacatctttttataatgctagaattaattagggcctcgaattgtctttttccttttccctaattaataactcttttctttttcgtcattttgctttcactttggcttctttctgttcacctttacgtcgcgatggacaaagccaaaagagtggagctgttccagggactcgagcatctccaaagccaaccgaagcgaagtgggggccgagaaacggtgctgttggaattggagtcgcaatttgaacaaattgtcacccaactaaaaaacaacaaaagaccattaggaacaatcaaacactaattgccatgtccatgacgagaaatttgaaatggtccttaatcattccccggtcgaccaaagcgcagaaatggcccaacttcgctttgttggccgccctcagcacaacgtaatcctttgagaacattcggtgggaaaaggattaatgaatgggacgaaaaagtcacgacaaatggccaccatgttcagcgcgttcaatgccgccattccgcacacctccaatttggcagcgaacatctctgtngtaatatgtgattaatgctttgtaattgccctaatttggtcattttcttcccttttccactcactattcccatttttgccccgcacaaaataccccaaaagattatcactcacttccgtccct

SEQ ID NO: 27113 - DNA, 496 bp, Heterodera glycines
aggtcgcaaaaaaataaaaataatgaaaataactaagcaagaaaccttctagggcgaatttattaattgaacataaaaaagtccaggcctcgagtcgcatcgagtctcgaagaccgagacccgaaaaactcgcgacagagactcgagatggagaccaaaaaaccctaggcttttctcgcgactgagactggatcaaaacaaaacttggtgtacgaaaagccatttttttaaattttcaaatatgccgacaaccaatgaaatttttcttacaaaaaataagcaatgaaaattggaatttccagcagtcaggtaacgatggtgggagtgagtaaatccccctttttcctttgttcattgttctccccagttatttattaatgggcacacatatccccctcccatccatccatcattttttgtcccttattatagggacactgtgaaaagcgatgtgggggcttggggatcgggggggggggggggagatgaatgagtg

SEQ ID NO: 27114 - DNA, 1028 bp, Heterodera glycines
tgcatgatcagcttcttctcacccgatgatctcaagtgatctttttattgttttaatttttgaaaacttaaattccactttttaaggtacacttttggcgtagatcacctaagcagaggttggttggcattttcaaggacaaaaatggacttaaggactattgataaaaaaccacgcgtgtattttgttttttgttaatttaaaatttcttgaaaaataaaatttatctggtaaaaatttcccgaaaaatcaattcacttggtatgaatgatgcctaattaaggagggacaatttgttttcaattcatatccttaaatgggggtagcggctcattagggaggggggagcggctaattaccgaaatgcagtaacttgtgttttcaattaatactctttaaatggggcgcggaagggctaattagtcgggagggggaggggctaattatcgaaaatgcggtactaattaccgaaaatgcgttaaaatttggaatgccaatcccccatttatctcacccctccttgccagtgcctccccatcggctggtcactcctcgtctgatcgctcgtccccgtcccgtccgcccggatgacccgttgttcgacctgtacctgcaaatggctgatgatgaacagcctctgctgttgccgttacactcgatcactgatcaattattggccgatcagctcactgtggtcagacggacacggcccgacggcggcggccatttttcgctgggccgcgagtcgcgcgcgatggtcgacgactgccatttccatcaccgatcggaacacattttggccgcaatttccaactgtgacgggctggaattggtgagaaatttgttgcggcactatttaattgtaggaaggagaaaattatcccgcaaaaaaaaattgtacgatcgacagttttgagagtgtgttttaattgaggctaattagtgggtccagatttatgagatctcaaatttttttttttttataaatttccgggaaaaaaagccatttagggggaaagttgaaaagt

SEQ ID NO: 27115 - DNA, 490 bp, Heterodera glycines
cacactgagttttttttggaacgcccgcactgagtttttttttggaacgcccacactgagttttttttggaacgcccacactgggttttttttttggaacgcccacactgagttttttttggaacgcccacactgagttttttttggaacgcccacactgagtttttttttggaacgcccgcactgagtttttttttggaacgcccacactgagttttttttggaacgcccacactgagttttttttggatcgactcagcacggataatttactagtgggaattaatcacaaaaaagattttcaaatcgtttatgaattaattaaaaaggtgtttgctaaagcaggaatgaatgtgcgtgagtttgtgtcgaatgaattaagtgagcttcaaaaactcccaaaggaagaccgaatcgaaaaagaaactgtcaaattgttggaaatttggtggaatgtcaaaaatgacgaatattttataaaaatgccaaa

SEQ ID NO: 27116 - DNA, 1227 bp, Heterodera glycines
atcaccattgttttgttcttttgtccgtcattcattgccattagaagacgccacttttgtgatgctttgtcccgcttcttcttccggtggcggagacaatgggctaaattaagcgctattttaattatttaaacaaataaaatgccttttttttattgctcacccaatgcaattagtgtcactagaaagcaaaaggaccacatagttacaattttcatctttcttttgctgctgctgcttctcctctttctccccaataattttgcatcgtttcattatccatcggttatccaattcatttgttttggtcagtgtcagcttttcctttgtcaattcgttcaccaattcaaatggcacaatttgtattgacggcgcatgaacagaaaaatgaatttggtaactgacggaagaaatggcattggcacggagaaattgctaaacaatttgattggaaaaacaaaaggcaatcatgagagggagggcggtgcgcaatcgccatttaatttctcagagaatttatatcttatatccaagaaaaatgactatctcttattttgagaaattttatacgttacaaatgctctcgagcatgataggaggggcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttagtttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttacgcgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgatagg

SEQ ID NO: 27117 - DNA, 1590 bp, Heterodera glycines
atgcaataaaatagaaaaacacacccctcagaaatgatcccataaaattcagaaaaacaccctcctaagaattgaaaaattttctcaaaaattgatggccaaattttattttttttttgttgatgaaaagttttaggtttaaaattttccttattcgaaaaaaaattataaaatatttaataaccatttaaatgaccaaaattaagttttttgattaacttttacgtgttttgctacctaaaaatccttaaaaaatattttaagtgcctttttcatgcctatttgaggatttttatgccttttttgcaatattttaaaccaataaaaacaaatataaaaccataaaaaataaaaatacgaataaatataaattcacgtaggaaatacaaaaataaatacaccaaacgtccggaaaatacatatgtaaaagaaacacaaattcttggaaagacaaatggaaaacacataaaccgtgaaatacaaatgcaacggaaaataaaatacaaaaataccatgaaaaggagtaaaaaatacaacgcaaaatgtaaataggaattcacatttaaaacacaaacataaaacacatgaaaatacaaatgtaaaagaagcacaaattcctgggcccgaagaaagaaatcgaagaatatgatccggccacaagttacccccacctctatgttgctctctctgtaaggaattctggaaatattctgaggaaaacccacaaaagagatgaataaagcgattatgaatttcgttatgcagcgaaattaaccgagtgaaagactgaataaattcattgaaaatttgagaatttattaccagggattctttttttatgtaaatacatgtttttttctggattcttcatagcctaattagtttgaaaaacactttcttttttgtgtttgagtaataacacacccgggacctctgtagattgacactaattataagagacaggtggaggggggaggggtgtcaattagtcactaattgggggtggggggaactaattgagtcagcaggcaagagggcactaattggccagccggagggggtggagtggggagtcaattaattaattaaatgtgggggacccatacctattgaacggtgtcatattgacatttactttttttgacctataatttgattgatttaaaaagtgacagtcgaggtggagggtggatgtatttggaggatggatgcattgacaaaagacccttttgaagaaatatgattagacgcttttctgttttatgagtatttttttgaatagacggagtccaaacctccggagcgtattccaataaaggcctaatataagttttatataacgtaatccaaatcttagatgatttggatttaattattcggaacaaggaacgcatacgtaaatacgcattccttgttatttggttaatatgatcggaaaattgtaatttgttatcaatgattactcctaaatccctagttgtatccacagcatttattgtatttccatcaaatttatatgtttcttttgagttgtttgaacccaactataatacaaaagttttttgaattgaaacttttatttgccattta

SEQ ID NO: 27118 - DNA, 988 bp, Heterodera glycines
atcaacggccaatgtcactttgtccccgtctttgtcataaaatcctctgcttgggtccattaattgcttaattatgctcatttttaaatggctttaggaatgaaaaagctcaccgcaaaagtgatgaaagtggggaatcccaaattgttcaatttattgttgaaaatacggccattgaattgtccaattaaattctccgccccgcccttttgtgagacaatttgaattgtggccgaacatttgcaactccaattttcaccttaattgccaatttaaataatgggataattcccattttgtgccactttttgagccggcacataaaaggtaaaatgccaaacacttttcgctgcttttattattctgattgattatcagtgccaatatcttccacgaaagtccctttatttgtttgatttcgctgctccgttcactcaaacaaatctctcgcgaaaattccgccaatttgccaatttccatcacaattttcccgtttgttttgtttggatttgaataatccaatttctccgcattttcttccttcaccataacatcgatggccaatgtcactttgtccccgtctttgtcataaaatcctctgctcgggtccatcaattccttaattataaagtaaaaggcatcccttaattttctcttacagaaaaagtgatgaaatttgagaaacccaaagtgttcattttgttgttaaaaatgtgatcattgcgttttccaattaaatgctccgtgccgcgcttttgagaaatgattcgaaatgtcgctgaacacttgcaactccatttcgggtcttaatgaaaataattaaatataaaataaccaattaacattaattaggtgtcattatcccacctgcccttggcgcggtgcactgaaggaaaaagcccaaacacttttcggtggtgccattttcgtttttcgtcgtatttattttggcacatattttccacggaagtgcctttatgtgcacttt

SEQ ID NO: 27119 - DNA, 1434 bp, Heterodera glycines
  misc_feature (169)..(169): n is a, c, g, or t
  misc_feature (190)..(190): n is a, c, g, or t
  misc_feature (1333)..(1333): n is a, c, g, or t
  misc_feature (1406)..(1406): n is a, c, g, or t
tatgtgttcatatttacaaaaaaagcagtttctgaatgtcgtcgaaatttgtggtaattccatggctatagcccgaccccaattggcgctggaattttgccatgaggcttattttttgtgctggtttcgaatttacaggcgcccatgcaattggagcgcattaaatttnttgtcgatttttcttcaatancccaccattatacgataagcatttcctcgcacaccgctcttatttgctctgttttaaacaacaaaattttcccaagcattcatacctactttcttaattgcactgggatcacatctaaacgattatgctaaaaacggggaactaaactgtattaatatttttaacaaattgccgcccttttcgcctaccctgttaagagaaatcttaatttcactaataatttctcaattttcttctataacagattaactcttctatggtgagtttttcaatttctatgtactttattaagtaaacaataattatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtgtaacaaatagagaagataagttctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccacattatacgataagcatttcctcgcacaccgctctatttgctctgttttaaacaacaaaattttcccaagcattcatacctactttcttaattgcactgggatcacatctaaacgactatactaaaaacggggaactaaactgtattaatatttttaacaaattgcagtccttttcgcctaccctgttaagagaaatcttaatttcactaataatttctcaattttcttctataacagattatctcttctatggtcagtttttcaatttctatgtactttattaagtaaacaataattatcaaacatttttctatgattgcaaagcatttaaaaaatcataggcttgtttattttcattatgttttggaacaggtcaattaaataaacaatttttttttgtaattttattaattgtataaatcttatgcaattntctataagcaatcgatagtaacaaatagagaagataaaagtctgatcaagcacacacctttcattatttccangttaatatgtgttcatattttaacaaaa

SEQ ID NO: 27120 - DNA, 922 bp, Heterodera glycines
ctatctctttttcgaccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagctttgcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagctttgcactttcgaatattacatataaattagccctctcaaattttccttcgggcctcagaaaatggctatctctttttcgaccaattttgtaccgatcaaagggaaaatggcttaattcaggccccaatgtgcgcctgaatcgctaattagctttgcactttcgaatattacatataaattagccctctcaaattttccttcgggcctcagaaaatggctatctctttttcggccaattttgtactgatcaaagggaaaatggcttaattcaggccccaatgtgcgcctgaatcgctaattagctttgcactttcgaatattacatataaattagccctctcaaattttccttcgggcctcagaaaatggctatctctttttcgaccaattttgtaccgatcaaagggaaaatggcttaattcaggccccaatgtgcgcctgaatcgctaattagcttggcactttcgaatattacatataaattagccctctcaaattttcccttcgggcctcagaaaatggctatctctt

SEQ ID NO: 27121 - DNA, 2171 bp, Heterodera glycines
tttcactatttcaatgtcaatgtcatcactttgtcttcatttttaacgttaaagtttttctcctggtcctttaattgcttaattaagccaatgattggtcaatcaatgaaaaacaaatgaccatccactcaaagaaagtgaaatgaaactcggctattccgcgctttcgattgtttgtccaaagtgcgctaacaaatccgtcaagttgaattctcctcacatttattataaaaaacaattttgacaacttttgtatttcttccctcctaaaatttttatttttctccctagtttgctgcttttaatttatttgaatttaattgaaaattctgcagttgatgtttaacttccattataggcataatggtacaaacaaaattacggcaaaataatgacaaaaagggagaataacggagaaaatttgaatttaattcatcagcaaaatactgaccctaaaaggtttttctcatatacgaagagaagaggcaaaaatgtacaattcagatttgcaaaagatacagtacactcgctttttttgtcctatacttttttcaaattttttgactctaaattcataaaagtaaaaaatcaaaaaatcaaatgtaaaaaattgaggcaaaataatgccctgccgatgagcaaaagaaagtaaacgccttattaccccaagattttgccaagccgacaatgattttgtaattccgtttaaaacgtaaatatgaaatgctattctcacacctttctcttcgtggttaaattgttcgggttttatgaaacgcggctgcaacgcgcggcgcggttcgttcggtaccctttgttatctcatggctaacaggaccaagccacaattgaaatatatctgaacataatggtaaaaaaaaggtgcaccgcaatttgagtgtccaaattttaattcggataaatctttgttcggaaaaatagtgccttttcattaatttcaattggtcgggtacgaaattaatcaaaattacgggtacaaattataatggcacggtctccttgtctatgattttgagggtcgcagccggcggagggtggatgtgatccccggacatatcgtagaacggagagagtgaggatcattaaaccgggaaccacaggaaatgggaattcgtaaaccggtgaacggggatagctggtatgaaaaaactcgatttattgaaacaaataactttttctagttattttttggctactttctaatttactgccaaatctcaaattttgaacaaaaaaaaaattcatttcagagaatgcttcaaaaatgcaattttagaaaaatgttaattaagatttatattataattaaattttaaaagatgttatttttgaccataatatcttatttttaccagttattttcttatagagcagtgggagatatgcaaaaaaaatattttaaaaaattttaaacttgtgaaattagtagtgaaaaacgaaaaatttttctgtttttgttttgaaaattcatatatgagttgccattgactcattttgacattttttaattagcagctgaacaaattaaaagtgaagctaaagctaaataaagttttgcattttcttttttccctttaatttaatacaattatatttgtgtatttaaatttgaatttgaattattattttattaattatttgacactgatgataattaaatgctttttgttccgtctaaatgaacattgcgtaattttgaaatgggaatttgcaaagctgggcggacaagtccaatgatgttgtactttttggctaattagtaattcattaattatttttatttcctaaaaagatcaaccggcgtaaagcactgctatcgcaaataatttaaattgtaaatcctccatttgttcatttttgtttcactatcatcaacctacagtcaatttcaccactttgtactcatttttgcgttcaaggctttgttcgggtccattaattgcttaattaaccaataatttgaatttgggcggtgcggacggagaaatgcctgccgaggaggagggagcagttgattatggataattgaaagatttgaaaaaaatataggcaaggctcgtggtgagccgaagcgacaaaaatatgggtgtttgtaataattaaattaaattataattttaattttatttgctaagtaattaatcataact

SEQ ID NO: 27122 - DNA, 1313 bp, Heterodera glycines
tgcagctgttcacgggctctctaaacctatttttatttttttctatctcttctctgaatggagttataacaatttttcacaacagttttgcatttaacagacacattctaaaaattctaattagtatggtagtccaagcctattattattttttttgactagtgtctgaatgggttatcccagttttagtatcctttttgaaaaacaacaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcgttgcagctgttcacgggctctctaaacctatttttattttttttctatctcttctctgaatggagttataacaatttttcacaacagttttgcatttaacagacacattctaaaaattctaattagtatggtagtccaagcctattattattttttttgactagtctctgaatgggttatcccagttttagtatcctttttgaaaaacaacaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggcacttgcatccgatgcagctgttcacgggctctctaaacctatttttatttttttttctatctcttctctgaatggagttataacaatttttcacaacagttttgcatttaacagacacattctaaaaattctaattagtatggtagtccaagcctattattattttttttgacttgtctctgaatggggttatcccagttttagtatcctttttgaaaaacaaaaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggtacttgcatccgattcagctgttcatgggctctctaaacctatttttatttttttttttctatctcttctctgaatggagttataacaatttttcacaacagttttgcatttaacagacacattctaaaaattctaattagtatggtagtccaagcctattatttttttttttgacttatctctgaatggggttatcccagttttag

SEQ ID NO: 27123 - DNA, 886 bp, Heterodera glycines
ccctttcacccattgctttacacttcgtcttcatcttcttcttcttctcctgctactgttcctttctttctgaaaacaattttctcaaattgagaaaaagatgtcgttttgttttttgtcgctgcttcgtctccccaaattttaagcattcattggctgaccaaacaaacgaaattttattttattgttattattattaattattattattaatcatctctatgttttattcgttatttaattgatctcattaaccaataaactcattgattagcaacagcatttgattgatgtccaattttgccgttttcttagccacacatatcacaatcagtcaatcaaattataatttgtcaaataataatggatgacttcaaataaatttgttgttagcatttggcaatgctttgtcagtgaagcacagactttggccaaattgggacaacaatccctttaatgctaacaaagttgggaatttatagcaaatgcagagacggaaaaaaatcttcggtaaatttttatgctcgtccataagactattttttacaaaaattccaaccccaagggattttttttgaagattttcttgaagtgtatctttcagtgtcaagatcaccttgaagaagaagagatctgaccaaattgatgcaaagacttgatcagcaccaaaagttggacaaataggaactttttcaatatatgtatttaaatgaagattttaatatttttcattaaaaaaatcgttaaaaatcgattttccgattgacctggacaaaaatccagatccccaggtccaacccagcaggtttatttattttatttattcaaaaataaaaataaccaaaagaagggcatgtgccacttatacttttggcggtaaaaattt

SEQ ID NO: 27124 - DNA, 1561 bp, Heterodera glycines
caaaagagcagcggaagggaaaaagcgtggttccgaaatgaacaaccagaaaaaaagtggaccgatgggaaaaggctctgaaccgaaaaatgggtcagattttgaagcggaattttttacggccgaggaaaacaagcttttccgacaacttttgggccgattacgaacatttgaggctgcagtttgcagccaattcagacaaatggaaaacgaaataagtaagaggacaaatgaaacatccacgcacttgggaacaatggaacgatcgatcaatgagacgaacgcgagtggggaaattgaaaattttgagcgtgaggaaaaaattgcaaagttggaaggagaaattgataatttgggagataagtgggcagaatacaaagaaaatgcccaaagggaattgagtgaattgtcaatcaaaatggaaaagaattttaatgagacaaaaagttctattgatggggtgaaactaaaattggaatcagtggaaaatgagttgaaaaaatcaattgacgttgtcgaaacaagggtcgaatttctggaaatggaaaatgctagtgatgaagacatgtggattgataacggtcacgaggatgctaattttacggacggaaatgttcagaaaaatgagggtgaagacgaagagatggacgaaagtgaagacaaaaataatggagaaatggaagatgaatctggggaaaacgaagggaacaaagacaaaagttgtgaactaatgatggccgatcctttttttatgaatgtagcacccccgggagtatacgatgggaatcccgccatgccgttttcacgttggtatgagaaatttaaggacttacttttactgtgcccccaactcaacgaagagcagaaattaagccgattgcgtgtatgtttggccggacaagcacgaggggaattggactcaatgagtccagcaccggaaaccctccaggcggcaattgatcatttgaaacgcaaattcgaaaatgaaaacacaaaatccattgctaggcaagccatgtcgatttgtaagcaagccccaggggaaaaagttatgaattcgcgaaccgactgaatgaagcagttaggactgtgcttgccggagagacccaaggggtgattcaaaaaggcttttagaggaatttttagaccgtttgacccctgatctccaatttgaagtaaagtcgggaatgtcgacagattactcgagagcctatgaattggctcaacattttgaattgttgttggcggctagaaggtctacacaagtctctgtagccgaattgacaaataaagtcgagacattgaccatacaacaacaaaatttcaatcggcaaagggtttttccggaaaaacgcacctgtttttattgccgccgacccggaaatttggcgagagaatgccgtaaaaagaaaaaggacgagtcgggacaaggccgagaaaggcaaacttattataataatgggccaaggagaaaggatagccgaaattgggaatcgggtagtcgagactggagaggcgataatcaaaataatagaaatttttaccgccccccgactcccat

SEQ ID NO: 27125 - DNA, 2180 bp, Heterodera glycines
tgtcttcagcggagttcagtgtccattttgggaagatggcgaacggagtcaatttcactaaattaatttgaaagatatgaaatttgaggcataaaatgatttaaaatttggtttttattatacacctggcttggctgtgttttctggataatttccatgaaaatgaaggttcaggaaaattccaggatgctaaaagtgccaaaacctaccctaagatatgcatatagtaaaccgatcctaattttccgactttttcggcctgtctctaaaccgttggctaataaattcaataaaaatttcgcacaaagttacacaaagggtcaaaatgtaaaatttgtgggcgacttacacgctcaaaaatgcctcatatcgatgtgccgtctcaatgcgtcgccagtccaattcgcatgtgacttggcccgccccgtcaaaaagtgggcaataaaatttgttgcggtccgccgtgcccaacgtgggccatccgaacagcgaaagatcgggcagaaaacagattggcaattgcacctttgatgtgggtttttaaggaatttaaaattcccaattccaatttatgtgtgctagtgaaaatcgcaattttttattttttgtatttgcattcataaaattcatgcattttcatagttttttttttgaaaattgacccaaaatgggaaaatttggtcctttttggcgaaaaacagctacaaattcctgttttttgctctccggcgcagaaattaaaaaaacagagaattttttagagaaaatttttttttaaattcgttttggaagcaaaaacctggacatattttgcgaaggaattgtccacaaaacgggttggaaatggccattcattttcattgtcgagcaaagaaaattggtttgatgaatgcttgttgatgctgtgatgatttgacgatggcaaaacgcgaaaccatcgaccggaacgacaattggcaaaacggggacgaattgtcaaggcggacaaatcatcagcaaatagcaaatggcattcattgcttgtaatgccaacacaaagagcaagacgctgttgttgttgttcttgctgttggtgtttaatgtacccaatcggcgaggaatgcattacatttaatggaaatttcaaaagaaaaaaatataggcactctaaaaaggtaggggataaacgaacgcatgcaaaagcactaaataagaaaagaaacaaaaagataattagcgcaaatacggtaatattttcatttttaagtccatttcaatctttcagctcttctgatgatgattttatggtggaaatggggggttgggttcgtttccctatgaccatttccctatgaccgtttccctatgaccgtttccctatggcccatttccctatgggccgtttccctatgaccgtttccctatggccagttccctattcacgtatttaggctattttcatatcaaactatgaatataaataaacacttaattaaaacaagcaagaaaattaacaaacattttatctgtttcaaatcacggtctcatttcataatttcgagaaattccgatcaaaaaggtaatgataaaatgatgattgaaaggctgatgaattgggaaaatgttggtgtctccgttgttaaatggcaaataattttgaaccatcgtgagaattcggcggtctgctccgcgatatttctttgccttttgcggtggttcttgtccagttgaacacttcgcgaagtcatcatccgacaatttttgatcctttcgcagaaggtcaatgaaacgccaaatcgatggatgtgaacaggcaaatgagcactgcaggcgtctgttcgcggcttctgaatggttattcgtccggtcatcgccttgcattgttcgagtgtaaacgctccaagtgtttgggtcaaatcgcgggcgcgttcggcttccatcattcttaagacgacccgtgtagttcatgatgaacctaataaataattaaagaacaataaatactaaacaatttgtgagattgtcaatttaccagtcaaggacgggagtaagttcgtcgggaagagccatgtccccagagcaatgattccaggggtcaaatctccaattgggagaaacgcgagcgacgagacacatcgtgccatttctgcgaatgtcgggtcattttgatagcgctaaaattttcgaaaaacgattttttt

SEQ ID NO: 27126 - DNA, 1141 bp, Heterodera glycines
tgagcacgggtgccacgcatgcccatcccatctgagcacgggtgccacgcatgcacattcgccaagccctcgctttctgactgctcacgggtgccacgcatactcattccatctgttcacgggtgccacgcatgcccattcgccaagcctcgggttccaactgttcacgggtgcacgcatgcccattccaactgctcacgggtgccacgcatgcccattcgccaagcctcgggttccaactgttcacgggtgccacgcatgcccattcgccaagccctcgggttccaactgttcacgggtgcacgcatgcccattccaactgagcacgggtgccacgcatgcccattccaactgctcacgggtgccacgcatgcccattcgccaagcctcgggttccaactgttcacgggtgccacgcatgcccataaaccaagccctcgggttccaactgttcacgggtgcacgcatgcccattccaactgcaaacgggtgccacgcatgcccattcgccaagcctcgggttccaactgttcacgggtgccacgcatgcccataaaccaagccctcgggttccaactgctcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgctttccgactgctcacgggtgccacgcatacccattccaactgttcacgggtgccacgcatgcccattcgccaagcctcgggttccaactgttcacgggtgcacgcatgcccattccaactgctcacgggtgccacgcatgcccattcgccaagcctcgggttccaactgttcacgggtgccacgcatgcccattcgccaagccctcgggttccaactgttcacgggtgcacgcatgcccattccaactgagcacgggtgccacgcatgcccattccaactgctcacgggtgccacgcatgcccataagccaagcctcgggttccaactgctcacgggtgccacgcatgcccattccaactgccctcgggtgccacgcatgcccattcgccaagccctcgggttccaactg

SEQ ID NO: 27127 - DNA, 1777 bp, Heterodera glycines
  misc_feature (845)..(845): n is a, c, g, or t
  misc_feature (849)..(849): n is a, c, g, or t
  misc_feature (853)..(853): n is a, c, g, or t
  misc_feature (878)..(878): n is a, c, g, or t
  misc_feature (896)..(896): n is a, c, g, or t
  misc_feature (1586)..(1586): n is a, c, g, or t
  misc_feature (1675)..(1676): n is a, c, g, or t
  misc_feature (1757)..(1757): n is a, c, g, or t
atttttcaatttaaatttgggtcttttcttaccgatggaacatttaaattcaatgcattgaaaatgttcagcttgcgtatgacaaagatcatttccataactagaatatgtataattccattggcctttgaacatttttttattttcacattccggataatagagtttccctcaaatggaaatttaaaaaattaatttaatttgtaaaaattcattaaaactcactggcgccacaaaatacaattgcgacgaacaaaaaatttaaaagaaaaataaaattcatagtaaaaattcaaaatcgctgaaataagaatgagtcctaaaaatataagtagagaccgtgactggtccaggttttattatcaggaaatgctcaagtaccagatttctttccttttttcgttggtttatggcccagaaccgggttcactgtccccagatttctcaaaattcccagtcccgtcctatcctataaaatgaatgaaataatttaaattcaaaaggacaaattgttcactaccatttttgattgaataatattaattaatattttatgggaataaataattgatgattcataacatttattttgttattaatttttttcattaaataaaagaatagaaaatcaattacttttaaaaacagaaaaaaccaaaataccaagaaaaaaattaaatgcttattaataaaaccgttaaaattggctaaaattaaaccaaattaatacttcttgataattcaatagctttaattgttctctttcagaatataattttctaaagttttttccttaagtataaataaagttataaagctttgaacatggctatgttttttgcaanggtnatgnatataaacatttattatttaaagtntataaaatgtaattgagncaaaattaatttatattttcaatagccctaagaattttttgaacccattggcggatttacgaaacgcgcatgggaggcggtttttacgaaatgcagtctatgacgttttctgctgattgagtgatgaatttcgggaaaaacaaaataatatgcattgaatttaaatatccaacaaatttatttatggaaaattttttcgaaatttatgttaattctaaaaacttagaactaatttcacaatttttataaatttaaaagaaaaagcattcagagagttcaattatgtactttaatcaaaaaatcaacaaaaaatgcattgataaaaaactaaattgaattaataaattttaagagatttaattgaattaagttttcaaatttattgaaatttattgttacaatatttcgaaagcaaaatatagaaaaacatgaaaaagtttgaaaaaaaaatgctgtaaaaaattttgttttttcctatttatgaaaacccaaaaacagtgaattcaaatggcagccgatttgcacattatcaatcagactttttcaatcaaaaagtcgaatttgaaagttgggccaaaattggcctcaatttcgtcgccagggttgagaaaagaaaccgctggttggaggccgtcaattgagtcgacaaagaaagtgggagagcctaaattcattcattaattaacccanatgattttataattaattaattaaagtttaatgattggcaatttcccactggtcaatctgacgccgttcttcgtgaaaatgatttgttnngctggcaaatcgatgccgcagccgacgatgtcgccaatttggaaattggcatccgaattgaacgatactttgaaaacattntcttttgccattggccataa

SEQ ID NO: 27128 - DNA, 2311 bp, Heterodera glycines
attttaattgatgctgctaattataaataattaaataaattttatcaattaagaaattaaaatttttctcaagaaacataattaattttaaattaaattaattttcttttcccaactatttttttaatggatgaatgtcaaacaatttaataatacacatttctctgatcagttttatatgaaaagaacttttctaatcaaaatataataattcaacgaaaacagggcctcaaatgtttttatgtgcgctcaaatgttttgaattaattctcagccgcagtctgttcacatatatttaaggaaggaaatattatgttggaaaatgaaggacaatttaattaagggcaaaaaataattttaaaaaactcaaaaaaaaaaaaaaattatttcatacaaattgaaaactttatgaaattgaataaaattaacaatttttctaaaaaaaaatacgacatttattaaatttatgtggggcatgaaatgggattaaaacagtgtgaaaacgttgcgaattttttttttttttgcttgggcaaatcaatgcagcactcatcactgatttgatgatgatgaagaagaaaaaaaagagattattggagaattatgtggcaccgaaaattgcactgataaaaatggataataaaatatttataacacattcattcatatggcatatgagtgagcatcagcagagcatagagcactccacaaaagtgaaagtgataagagcatttgaaataaatgaaatgataaaaaataaataaaataattaatggggtaataaaataccctaattggggaagtcttttgggggttgaggacaaaataaagcaaaaaaaaaaaaacaaacaaacaataataaaaataattgcagtaaagtatttattgtttcttagcaagaaaatattttaaattttaaaaattattaataaataaatactactgaaaattaatttcttttatttattacttgtcgaaaatggaaaagtttttatgtaaattattaaatgtaagcaattattaaatagtttatattttatttgaaataactgaaaaatttttttttaatgatttatgtaaaaattgtttaagttgaaaaaaatgtaaaaataaaatatgattttataggactacaatttttcatgaactcacaaattctcttatcaaaatgaccttatccaaaatgttccaccccaataaaggaatgaatgaaaattgataaaatgttggtggtggtgttaatgatcgattggatgggaaatgagagagcacagagaatgggaaagtaattaaagttgttcactaattaattaattacaaataaaattgtttatttgttggttcgctaatgtcgaaactttaataagagagtttgaaatttagaaataaattaaaatttaacagtaaatgccgaaacccgttgcataaataggcaaaaatgttatgttttggcatttgccgtgccatcccttttaggccgcaaaagagtaaatccaatttgtgccaagagtcactaccaatcaaggcaaaacacagaagatgaagagaattgaaaattgtaatttaaataaagaattgtataaaattatataataagaaatatttttcaatggaaaaattagcaatcaattaaatttatttaattaataatttaaaaatgggtaaataaaatgtaaaattttgcatttcatgccgtaattttatgattttaaatcccaatttttacagcgtaaaattctttttgctatccatcggtaaatattttctggtgggctgatcacgaatccgacatacatatcttttaaccaattccgacttcctaatctgaatttgaacaaaaataataaaaatcataaaacgagaaatttgaattttcaacttttgttcaacttgggtttcgtgatagaaattggtcaaaaatagttgtcaaattcgtgttcaggaacctcaaaaactagagcaagttttcaatagtttttatcacaaaaaaattttttgcaaacctaaaagatctcagctattggtttctaaattaaatattcaagaaatatacgattttaacaatcgccgaaaacgaatttttgtaaaaaaaataaaataaaaaaattttgtaaatgtattaatttggcgattgtcatgccgtattttattttatgcaatgaatgaaaaattggcaatgaaaattatttttttataaattaataatttcaataaatggatggataaataaattgaaaaatttggcatgtcatgccgtaattttatgtcaataaaaatccctaatttatataacgtaaaattcttttgccct

SEQ ID NO: 27129 - DNA, 1041 bp, Heterodera glycines
  misc_feature (50)..(50): n is a, c, g, or t
  misc_feature (1010)..(1010): n is a, c, g, or t
ataacattacaaatgggaacggtgctgccaataatgggccaatgccttgnaactcggcgggtgccatcgtcgagacgacaaccagcgcaacaacaacaacgagagcaagcaggtcaacagcaagtccttgggggagagagggaaatgccctcgggcaatacaatgaaatgggggagagagaaaggggagaggagagagtgccctcgggcaagaggcgagagggaagagagagcgaaacagcgagagtgagagagatagagaaaacgagatggagagaaaagggggtagagagaaatttctcgtcacttttcaggtttcgaaatcacaacaaagttgttttttacgcgccgtccgtcgtgtccaattgcgaccgttactttgaacgcgtgctgcaaaaggacccctcggcaattcgaatgaaggcaataaaaatacagtttcatgccgttctctgccctttcatttttttgatgcctttttcagccagccattcccggcatttccagcggagtgttcttcgagaatttgtactccaaatacaggtgattggagctgagagaagcgtctgtgccttcgtggtcgtcaatttcggcaaaaatgcaaatcaacaacccaattactgtcccatcccgctaatacacttaaaatgccaaacccaagccttattggggatttacgttttggcgaatgaatgccaacatttttttggcattatgccttttttgtttcatttgaatccacaattatcattccactaatttttttgccattatcagacgaagtggcaacgtgctgaccaagttggactcgagcaccggcgaattgccgccggagaatcgacggaccgccttttgggtgttcacggacaccaccacttcgttcatgtgggggcacaatgccaatgacatcggacattacaaattctcccaattttgcaggattttggtcggcgttttcttcccctccgtcaccggcattatggcgggctccaccgttccggcatctacggngtgagtcgcttcatcttgtatattatctcat

SEQ ID NO: 27130 - DNA, 1179 bp, Heterodera glycines
  misc_feature (1051)..(1051): n is a, c, g, or t
  misc_feature (1064)..(1064): n is a, c, g, or t
  misc_feature (1095)..(1095): n is a, c, g, or t
  misc_feature (1101)..(1101): n is a, c, g, or t
ctcaaatattcctaaaacaagctttatttttactgactatctttttccagaaggctataaaatgcaataaacaattcgcatgcttggatagaaaagaaatgggctaaaaatatttcatcacttagtcgtgaaccattacaagatttctatagcagggccatattggcaaaagaagcacatgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtctaaagaaaatccgttaaaatttgcattcacaaactccattttttcattggcaaacgtgtaaagcaaacccgaaattgataggaaatatatattgctcataataaaagtacaatttttatttgtcccacgccattttctgggaaaactttttcgcgaaaggcgaaaaattttccatcggcctcttccaacggcaacagatgcgtttcaaacaattgacaatataattatgattgaagtcaaaaagcctctttagaaaatgctcaaaaaatttttgttataaatgttcacaaaatattttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatttttagaaattgcccaaaaattgttgttgtaaatatactcaaatattcctaaaacaagctttatttttactgactatctttttccagaaggctataaaatgcaataaacaattcgcatgcttggatagaanagaaatgggctanaaatatttcatcacttagtcgtgaccattancagatntctatagcagggccatattggcaaaagagcacacgtagagcaggctcgaaataagggcaaatgcccgaaatttttaaa

SEQ ID NO: 27131 - DNA, 967 bp, Heterodera glycines
atgtaaataaaagtcccaatttttttaaaattaatttaaaaaagttaaagaaattatttacgagaattgatcgaatgaattcatcatcactttattattttaatagaccaaaagcaataaatggaaaaataaataaaattcagccaccacttttagttaatggggaaaaatagaaagaaattcctatgctaatatgttgggacaaatatgcaaataaaatttaaaaaaatgcataaagatttattataataaatcattaacagctctgttaaaagtgtgtattataataatgttcgatttgatcatgtaataataagaaagggacaaaatgttaggtgccgggtgggaatcgaaccccacttcagagcctcttttcatggccaaaactctaccattgagctatcgaagcagttcggcacgtaatcaaccccgcttttacaaactggagaccaaagtttttttttttaaattatgcacttaaatgtaggaaaaaactctctatgaattaaatatataattttttgatgcttttcctatttttgaaaaatttaaaaatttttattttaatttgatataaaataattttttttttttaatatattattattagggttatgagttgtatgcactaaaaaatgccaaatatgcgcataaaatatgccctaaaaacccgaaaaatacccaaatatgcactaaaatatgccttaaaaactgccaaaaatggcttttaaccagggttcccagatcaaaattttcaaaagcctcatttggcaggcaaaaaagcctcattttgggtcaaaaagcctcatttttacaaatttattcaaaacacattaaaaatgttcaaatgttatatttctgatttgtccatgctcaatttgagcattttgtgaaatctaagcatgaaaaaccagttgatttttttgcgatgcttcttccaaaaaacttttggggaacaaaggggggg

SEQ ID NO: 27132 - DNA, 721 bp, Heterodera glycines
ttgcctttctccaattcagggcaaatcgtaataattcaggacattttatatttttcattttgcctttctccaattcaggacaaatcgtaataattcagggcattttatatttgcctttctccaattcagggcaaatcgtaataattcaggacattttatatttttcatattgcctttctccaattcaggacaaatcgtaataattcaggacattttatatttgcctttctccaattcagggcaaatcgtaataattcaggacattttatatttttcattttgcctttctccaattcaggacaaatcgtaataattcagggcattttatatttgcctttctccaattcaggacaaatcgtaataattcagggcattttgtatttttcatattgcctttctccaattcaggacaaatcgtaataattcaggacattttatatttgcctttctccaattcaggacaaatcgtaataattcagggcattttgtatttttcatattgcctttctccaattcaggacaaattgtaataattcaggacattttatatttttcatattgcctttctccaattcaggacaaatcgtaataattcaggacattttatatttgcctttctccaattcagggcaaatcgtaataattcaggacattttatatttttcatattgcctttctccaattcaggacaaatcgtaataattcaggacattttatattt

SEQ ID NO: 27133 - DNA, 1477 bp, Heterodera glycines
  misc_feature (34)..(35): n is a, c, g, or t
  misc_feature (67)..(67): n is a, c, g, or t
  misc_feature (125)..(125): n is a, c, g, or t
  misc_feature (1373)..(1373): n is a, c, g, or t
  misc_feature (1418)..(1418): n is a, c, g, or t
  misc_feature (1423)..(1423): n is a, c, g, or t
  misc_feature (1425)..(1425): n is a, c, g, or t
gatgctcagccaaaatgaaagtgctcagcttttnngggtccaataaacgtgggaggagccgtattgngatggaattgcttacaattgcattgcacccggcaaacgctttcggttgagaatccccnccattttcaaaaaggaaaaactttttagaccgatggacaatttgagcggtggtgagaagactgttgcggccttggctttgcttttcgctattcattcgagcaatccgtcgccttttttcgtgctcgatgagatcgatgctgcgcttgacaacacaaacattggaaaggtgtgtcatttttgatttcatagtaattttgccattattttaaatttgattatactttttaataaataaatttccaagaatctcccttggtaatttgttaaattagagtgaattactaaatttggcttttccacaggtcgtgcattacatcggtgaacggtctcggaccgacatccaattgatcgtcatctctctgaaggaggaaatgtacaacaaggccgactccctcattggtgtgtttccccgttccacgcagccgtgcattgcgagtggcattttgacatacgatctcgaaaactttagccaaatgctcgaagagcaataaacacttttcctctcatctctctgagtttttgcttattttctcacacttaaattaccttgcattttgattttgatgtaaatttctatgggatatttaggcataactgttcaaatattttgagactgaattaatccagcaaaaatgcgcccaaatatcccagttatagttggctatttaatcttttcgacttacttatgctattttctgacgtttacctgatgataaacttaacctttgattacttatccacattcttttcaatgttttaattcattttggcttactttcttttaattcttacttttttcataatccgtcttaggcagcagatttggagatgagtcaagaagtgagttcggaaggcggcttccctaattacaaccgcaaccaatattttaaaagcattagtaggttttgttttgggtttaggtaattgaccttaaatattttcagtcgacagtttgtcacagaagggacttctcgaagcgaatcgtcaaccgcccatcagtcactcgacactcagttttttgatggaaaggaaaaaggacccaatgtcgtaagtgttcgtcccattatcattcttttttgattcattgtcagaatggtcaacatttactgctcggcttcgggtgagcccaattttgagttttttgtctttcaacttgcagtcaggccaaggttgtgggaattttcaatggtggttttcctaatcgagacttcagcaaatttgttttcatcactgaattgagaagtcgncccgtttatggcttttgcgcagcgtcaaaaaaggaggccaaaaanccttncncatggggtttgaatgaacattttgatgacagaagaacgagtcggaagaccaa

SEQ ID NO: 27134 - DNA, 1405 bp, Heterodera glycines
ccaaattgaacagttccgaatgtccatttgcgagttttgaagtgttcttccacataatagtcaaaacggtggctgatcatcgcaatgccaaagccaagctgacgcgggggaagcaattcgaagacacaaagccaacagtcggcggagatgaaactggagaaaagggaaaacaaaattgaaaattgaaaattatgctttcatctcgcacaattggacaacggatcaacaaaaacgatgtgttccatttcgttcttttcaatgccaaatgttcacgagttaattcattggtcatcacaaatggcacaacggaattagcaaaagacggcggaaattgaatgacaacaatgaaattgacgggtgatgaagccgaggcaaatgcctaaaaatgaggggggaaattgaaaatgccaaataaatcaattcgaaatcaccgctttgaagtcttcaatgtccgacaccaaaaacccatcattcatgtccaacggacttctcaacacctttggcacgttgctttgaagcggagtgaaaagccatttggccaccgcttgtccatccgatgccgcggcattgtcatcggtcggaaatgcgatgaagagatcgacagaaaaggagacaacgcgaagtggtggacattcgttgagaattgacgggacgaattgacgcaaatgattgaaaattctaacggacatttcaatggcatgaatgttttttccaagcattggccaaatattgcgcaaaatgaactccgaaatgcgataatcatcacgggccgtttggatggacaaattaattggacagacggcgaaaagttggcgaaaacggtggagaaaagcgatgacattgcggtcgatgtaactgaaaaaaatgaagactcattaccacttgacaataattgattcattttactctaatgaaatggccttgaatccgacgactttctttggcaacggattttgcggaattggcattggtcgttgataacaattgacaacatccatttccttggtgccattcttcccgattttgcttccaattcgaataattccgaatgtccatttacgagttttgaaatgttcgtccacataaaagtcaaatccgtggctgatcaatgcaattccaagtccaagtttacgtggagagagcaaatcgaacgcacaaagccaacaatcggcggagatgaaactgaaaaaaaataaaattcaaaattgaaaattgaaaattagcatttttaattttaattttacattgctttttccatctttgcctccgcttctttccgattgtctgacattttgttgaggtcgaattattaagacggttattggcacttttgcacttaaatggctttattttcttcaaaaattcacataaaaaatgaatatctatttgcataaaatgtcataaa

SEQ ID NO: 27135 - DNA, 1159 bp, Heterodera glycines
  misc_feature (182)..(182): n is a, c, g, or t
  misc_feature (1129)..(1129): n is a, c, g, or t
ccgctgggagatgcgttagaaaagaaagaaaaatatgttccgacagcttttgaagacctgcattgaatgctgcagttgccgctgctgtacgcccacccggttgttgagttagggtcgagatcggcatgaaaaaagacaaaaaggaggaaaatgaaacaaattcgcggctttgccctcgcgtnggagaaagcaatgcgcagaataactggagagacttagggttagcgcatcaattatttttttcagaatgtgatcggggtacaaaaaatacgggtccaaaaatgggtgtaaatccgctcggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaatactggggagacttaggggtagcgcatcaattattttttcagaatgtgatncgggtacaaaaaatacggggtcaaaaatgg

SEQ ID NO: 27136 - DNA, 1050 bp, Heterodera glycines
aaattgtcccaccagtcgaatttgttaaggaaatccattgggcttcgccgggaatggcccaactggggataacagccaaagagcctcagattttgctgggggtgcgggaattttggagatttttccttggaaaacgggaaattctcccggggttgtaccggattgaaactgtttttggaccagttttcgggggtgtgccatcctttcccgtgactttggcgcccgccacagccattaatccttcatctgtctgcccggtggtaagccgcaaaccggaggagctggtaaagcagttatggagcttagaatccattggaattcgggacccattggaccccaatgatgaatccctcgctttggcccttttttctgactcagtgaaatttaaggaagggagatatgaagtcggctggccatggcgtccgggggggtaaggaccgactttcaaccaatttttctctggcctattcccgtctttctgctctgtcccacaaattacgggacaactccgaatttagggaaaaatatcaggcaactattacggagcaaatagaacggggaatcatcgaaccggcggttcgaaagggtgctcaagagcacttcattacccatcatgcggttgtgtctccgaaaaagctccgcgttgtctatgacgcttcagcgcgcgaaaaggggaaggcatcacttaacgatttactcctacccggccccaatttggtccccgaattagccggaattttactgcgattcagagcttccacctgtccagttcttggggacattgaaaaggcctttttggccgttgggctacgtgaggaagatagggaagtagccaaattcctttggttccgggacccttcccaaccattaagtcaccaaaatttcgttgtttaccgattcaaaaggattgctttcggcgtcaatgcttcgccgtttcttcttgcgttggttctgcgtcaccatttgtcgacgaggggggacccattggaaatggccaaaaatttttatttggataatttgttaatttgcagcgaatccccggagaagcgg

SEQ ID NO: 27137 - DNA, 1167 bp, Heterodera glycines
tttttattcgagttcgggttagggattagaaattagtcaaaatacatgtcagattcgtgattagcgacctttaaaaccccggataaaaaattatcatggttttttatcttaaaaaaattttgcaaaacaaaagggtccccccttttgtttcaaaaaggcccacttttagtatagcgccgaagttgttatgatcccaaagcttcttactgcaatgctgtgctaataactgaaatcacaggcaattggtttggtgttatttttttaaattctttttaattcattcataaacttaggaaacttaaaacccttaattttcttaaataaatttttacgggtgattacgcaaagttttaatgcgggattgcgtaagttaaccccgcttggcataccccgaaaaaatttttgagatgcagcggaatctgcaaatttgaaatttctgggctccagtccctaatatagcttgagattgaacaaattaaagcttttaatacgggattcaatagatgtgaaaaaagtggggggttttttttgaccccgtaaattatcaaagactaggcccggtcccagcattttcaaattccggtctttagacccgttaattttggctaacttttcatatcttttttttccatttttcataacttttggcgcttttgttagaaattaatgtttgtttaattataaatttaatttattcctataattttcataaaatggtcattttttatgtaagaaaaaaatttgatgaaaaaagcaatattattgtttaactataaaaatcaattaaagaaacgtttttataatttgttaaacaataatttaataagaaaaatttattaaaaatataatttcaataaattaaatcttaataaatgttagttctcaccttgcaattcgccttttttttacattggattccttaacggaatgttgttccatgaccgcaatgaatacaaaactggcaagagaagactttggccatgttattaagcaaaaatgaaatttaaccccccccccccccccctctttttcaccttcgtcccgactttccgcaaagcgaacttttatgtgccattctttgagcagtcgccgccattcctcggctctgacttttgaacataacaattccacttcggagctttcctaagcaacagtaaacattgttag

SEQ ID NO: 27138 - DNA, 1542 bp, Heterodera glycines
  misc_feature (1345)..(1345): n is a, c, g, or t
ttttttcgggtaatatttgtagaggaaatattaatttggaattagctattaagggacggagggccaattaaaaggagcaaaattctgacaaagcatggactggcaaccattgtttttatatcccatttaaaaatgcaaaaaactggacttacttgagtgtctctgattatatttaattgccagttggcctctggcaagccattaataaatttaaaatattaattaatcaaaaaatttatttgcttttttttgtttgtttgtgtgcgctttttaagttagtgtgtctacggttgggccgaaacacccgtaattagttgctttttaaccggaagagaccgtactgacgaggcccactcttccaaaaaattttcttaaaaaataatttttttttattcagaaaccgtccgcaaatgtccctccgcaaatgtccgtccgcaaatgtccgtccgcaaatgtccgtccgcaaatgtccctccgcaaatgtccgtccgcaaatgtccgtccgcaaatgtccgtccgcaaaagtccgtccgcaaatgtccgtccgcaaatgtccgtccgcaaatgtccgtccgcaaatgtccgtccgcaaaagtccgtccgcaaatgtccgtccgcaaatgtccgtccgcaaatgtccgtccgcaaatgtctggtagccaaaaaaagagacgccgtttttcgatgagaaagatttgttggatgtgaggtgaggataggagagcgaacattgccaacaaccaacataaattatttcatttacatacattgatttattttttggtgctggttttatcacgaaaatgcaaaaatatttacaatacaccaggggtgttatctgtcctgatttatcagatttgtcttgatttgaagggtccaaatctgataaaataataatgtcctgatttgtttgatttttccggcggcacctatcggcaccgccggaccccctcctctcacccatttgtctaaagttattttggaaaaatgcaccgcaaaaaattattaaaaatctgattttttgatcacgaatgcattaaaatttacgatttgctaatcccaaaattgttaattaatgtgagatgaaaaaaaattatttgataaattgtaaataattgatttttaagcaatttcgcaaaatgtctgattttcaaccctaaaatctgactttttggtcctgtggtctgattttgaaaattggaaatcagaaggaaaaattgcctcgcggagaaatgtggttgaaaatttgaaaaaattgaaaaaagaaattttcaattttcaatttttttttaaataatttttaaatgttgccagcgcccgacccgtcctgtgccataaaaaatgnattaatgtgtagcaataattaacacaaaaaaatgtaacatttcttaattaacttttggaaaaacgaatgaaattttcacggggggaagcgttataaatttgttaatttaaatttattttaatttcccccccctgaatcgtcacactatttttatgaaatctctccccctgcccccgggaatgtttcaagtgatggaa

SEQ ID NO: 27139 - DNA, 1365 bp, Heterodera glycines
  misc_feature (42)..(42): n is a, c, g, or t
atttttatttttaaagacaagtatcctccgttcttagtggtntaagtcactcttttttaaggtgccattttttatttccgataaaaaaccaaaaaaaaaaacaatttcggcacaaaatgcacaaataggcaaaattgggacgaaaaattcatcctaatagttcaaaaccaaactaaaaatgttttttcaagcttatgacgataaaaaacataaagcgaatgacatttaaaaatgatgggcctaaattggaaaatttaatgaatttaaaaaaagttaaattcaaatgtttagcctgacttttatagctgttctttcgaatttaaaaagattcttttggcccttagggtaaaagaaaattcttttaaaatttgttcacttttcatttcacattttttgttcagcaaattctatttttctttctcaaagcgatttaaatttttattaaattttcgacttccataggcaacaaataaatattattaaaaataagaaaagagatttttaacaagccacaaagttataggaagaagtaatttcaagcaaatgaataatttaacaaaaacaaacaaaaaataattcattttcttacaaaacaaaaaataaaaatggaaaaaagcttacaacaccttcgattcccaggacgtctccgttccaagtactaagaaggcccaacgttgcttaacttgccagatcggacgggatggcgtgctttcaacgtggtatggtcgtaagcgaaaggcatccaattgaaagcaattaaatagtcttttttataatccatttttcttttttgattaatttaacccagaacaataattgataaggtatttagaattgaaagagaaaaatttattagtttttaatgaatcagcgaaaaatttggaatttttttaacaaaattatctccaaattcgcaagtctttagaaaaattgaaaaattgataacattttttgactttcttcacaaattctctttaaaacctatacaaaagccttttcctatacgtaatttttcgaaaatttgaattttcatatgactaaaaaagctagaaaatcagaaaataggctaagaaaaattaattttaattgtcaatttttaagacaagtatcctccgttcttagtggtttaagtcactcttttttaaggtgccatttttttattccgataaaaaaccaaaaaaaaacaatttcggcacaaaatgcacaaataggcaaaattgggacgaaaaattcatcctaatagttcaaagccaaactaaaaatgttttttcaagcttatgacgataaaaaacataaagcgaatgacatttaaaaatgatgggcctaaattggaaaatcttttgaatttaaaaaaaaattcaaatg

SEQ ID NO: 27140 - DNA, 852 bp, Heterodera glycines
cagctgagagggtgcaaatttgtttaaattttcgatttcctttattggtgggtaccccgccgaccaagaccttccccactcatatttttttgttaatttacgctaaattttcccaaaaatacgcagatttaggtgaaaatctgttaagaattttgagttaagagcaaaaagaaacccactccctccccgagaattcaacattgaaattttaatcactgggggggggggatttcaagttttatttatttttttctgtttaaattttcactcgccgcttctccgtctccccctccgccgtcggtcaatccctgcggcattggcacttcgttaacgcaaagcggagggccaaggccaacttcgaaccgataccgtgttttcgtttattatgtcatccgggaaaatgccaacaattttttgtccgcggaagactgaattgatgtgccaagctgagccaattgagtgcatgccattgctccatatttacacaaaatgcgttgcagttcatcgactccgccacaccgagttaatccgtgcccacagggcactccattgatggacgacaaaaatgagccgttgatctgcgggaacagcttggccgcggcggacctcgcactgtttggtttggccccctgacagccgcacatcagtaccaattggagacgggatttcccagctgggatgaggaggatgccgatttgaaagcgggatgacgcgaggaagccggtttacggcataattggtggactttttgcccatcgtaatttcaatctcgaccaattagcaggaaatattaaagtgattactaagtctgatgccccgtttccgtatcgttgggcataattggccccaaaa

SEQ ID NO: 27141 - DNA, 102 bp, Heterodera glycines
tttttttttttttttttttttttttttttttttttttttttttttttttttttttttttttttttttttttttttttttttttgttattttttttttttttt

SEQ ID NO: 27142 - DNA, 573 bp, Heterodera glycines
aaaaaatttaatttaataaaataagaatattatggcttgaaaatagattaaatgagaaacaaaataatatttataaattataattataaattatattaataaaaacggttttaaaatgtatttatacttttgaagacagattttgaaaaagaaagatgaaaatttaaagttcgatgcatttaataaactggtaattctgttcggaatcgctcgatcggcattgatttgcaacgcatattttgttcaattgggcgaaatatgtaagtagagggggcgggggatacaaatgccaaacatgctaatattgaacagtaattaggcacgggatttcggattaaaaaatcttaaattttccacttttttaatctttctctttttcccataatttaatacattttaaattttaggtatttattattaattgatttttaattttttaggcgccttttcattaacaaactctttgtatgagttgacatacattgaatattttgatgataacactgaattaggcaaatggcgaacaaaaatggtcatcgaattcaacctgtacaatttttggatacaaaattt

SEQ ID NO: 27143 - DNA, 968 bp, Heterodera glycines
aattcaatgtttttgtttgcgttgtctttttcctttattcattttcacacccaatgagagaaaaggaagattttcatgaagaaattcagaagcaaagtatgtaattcttggttaaaaatgaacaaattccctttaatgaatgttgccaacagaaaaaaatgaaaatataaaaattttctcacgaaacaagtcgccaagtcactcgtgccgagaagtacaaaatcatttttcgacaaattgtttatttacgaatgaaattagtcacccttacagggattccccccccccttctctctctttggatcaattcattattaactatatgtacactatatgtacatttattgagtgttattgtttttttatttgagtttttaaatgtttacacataattttttgatgatattttaaaattttattttaggttataatttcgaagatgagttctgctggcgttacggaaactctcatttccccctcgtcttacatagaaaaacagtaagggtcgtccattctccgtttttcatttgttttcttttttgcatttttagcacattgtctgggttgctgactgaggatgtgcttcattttgccattggaaagaatataacgattaatgtggaagaaaaggcggtgccgcgggtgcgggacagtgcccgcgcgaaatggaaaaagtagactttttggaatttagttttaagcgaagaagctttccagtttatccgatttcaaaagcgacggagtcgaaagtggcgtcacttctggtcgcattttggctgtccgagacaaattggtgagtcatttaaatataattttattcttaattattcaatttcaacgcaggtggcttatcgtttatataatgagtccatcggtgaggctgttcgagtcatggtcagtcttaatcggtttatgtattatttaatctcacttttgcaggattgcgaatcgcatgtccgccagctgat

SEQ ID NO: 27144 - DNA, 967 bp, Heterodera glycines
ttaaggattttttcgaaaaccctaaaataggcactttaggcacaaaaaccccgaaataggcaaagttaggcattataaaagtcatcgtagacaccccaaaccatgcggaaagggcttttttcgtgcttatctgtgcgtattaagtgcgcaaaaattttaggcatttgcctaaaaatcgcatccctaatcattacacttttttaagcaaattgtagaaacaaaaaatttaaatttctttccattttgttggttcatctttcaaatttgtatttcttttttatttttatttttcgcgcagcaaaacttctaatgattttttttatttaaatttattaaaaaaaggaatttaatcgctggaaaatttccattttaaagaaaccaaaacatataaaccgcttttttgcggcttaccttttccaaaaaacttttcgagtacgggggcaggtggtgtcaataggcgtcgccgggaaaatttttaatttttaatgtgagttagcagatttttttccaaaataaatttaatagagaaaaaattagaaaaattcctctaatttgtaagccaacttttgatgctgaacaaaaaaatcttttgaactaacaagatcagattgttccttcatggcgatctgacatcccaaaagacactgaaactcgggaaaattttagaaaaattcctatgggagttgagaaaatttttctggaaattttgattttaagcctgtaattttaaatataagcgacgggaagaaaaaactaggaatttttagccgtttttgcgccaaaaaaggggctgttttttgccattttggggtcaaattttcaaaaaatacggtaaaatgggggtccgtccggtggtgtcgacaggcaccgccgggaaaaatttgaaattttgagtgatttgttaactgattttgtcaaaataatgtccaatcattgggtattttattggtctatggatgtttaaaaa

SEQ ID NO: 27145 - DNA, 903 bp, Heterodera glycines
gaattttcgactctttgttcgaattcgggcccctttttcggaataggccgaattggatgccggattcgtgatcagcaaccccgaaaagccttggaaacatgttttcatgacttttgaaaacattaaaaaaaaattcgaaaaaggggggaccagccttaccattaccgagaagcggtatttccgtgttcagctaaggatcacgaatatggtgtttgttttgacttcttctgatgacacctgttcagagatttaacaaaaaatccaacaaaaaatccacgattttttgaaaatgtaaaatatgaatttttaaaatttctcaaaaggggggggggggtagtaaaacccggaaattaccagagaagcaacaaagttaatcaattggtctgtgcctgtgcaagaaaatgtccgcaaattttgtcctgttcttcttaatgcggcgtttttcgcgcttttcttccacaaaaaacattgccaacaaaccgccgcttttaaacttgccccactgttgacggagttttgttatacaatacattttttaaattattcactacctaaaataataatataccgtaggtattattataagctggctggatggttgatgggcagggctcccaagtttttttttctaacaaaggacaaacgatgctaaaactaagatttagaagacccaaaaataagattttttgagaaaatgactttttaccttgtaaaaacagttaaaagcattaagcttttttgattttcaaatccaagaataagcacaaaacaaggaggtctttccaaaaaaggacaaatcttagaaaaaaaagacattttaactttctaagatccggcccgtctaaaaaaggacaaatcttcgaaaaaaggaaattgggagccctgttgatggggaaagggggg

SEQ ID NO: 27146 - DNA, 1243 bp, Heterodera glycines
cggtgaacgggatttttaacgggagcgggatttttacgggattcccgttcgggactcccgtcaccggaaaattttgaactcccgatcctgctcccggaaatttttacccaaaaacgggagtaaaaatgcatctggtaagaattgatttttttggtaaaaataatgatttttcattgaaaatctgttaaatatatagccaaaatttcaaaaaaatttcccggcggcgcctatcggcaccgccggatacttaaaatccttaattttcttaaaaaaacttgctcaatttgcaaaaattggtcatttttgaacagaatctaacaatgtattgtattaaaattttcaatttttttcccggcggcgcctaccggcaccgccggcctccctcctcctccttggtcaccaaaaagttttttcaagaaatacaccgcaaaaaattttgtaaaattaataaagggagtcaaaaatataaagttaataaatgttttgttcgaattaattataaaaaataatttatttaagcaatttgaaaaaattttctgatttttgactcaaaaataagatttttttatttcaattctccttactaaattttctatatatttttaatttaataaattgattgtcctttaaatttgtgcattaaaaatatttttgtgagtttttaattaaattttcgaattactcccgctcccgcccgggactcccgttaaaaatggacgggattttaacgggagcgggatttttacgggaatcccgttcgggactcccgtcccggaaaattttgaactcccgatcccgctcccgcaaacggaaattttttttaccggactctaataaaaaagaagaaagaaagaatttttttgtttataaacaacaaatatgttagtatttttaatttctattttatttaaatgttctatcaatgattccatataccctatggttgccaactgaaaattttcaaaaacagcattttgtagaaaaaatcatcattttagaaaatttttcaaaattaaaaaatcaatagtttttttgggcttttacaaaaaaaaaactttttgggaatagagggccggcggcgccggtaggcgcctccgggaaagtttttcagaatttgaatgcactttattttgatcacgattcacatatattagagagatagagagagaaagagaagacgagtgagagaagagagagagggaacgagagagagagaaaacggtacttgtgtggtttacctgac

SEQ ID NO: 27147 - DNA, 1969 bp, Heterodera glycines
atatttccaacctattaagccattatttatttgctttacttgagagaatttatgctgggcatcacttcatttttgggccgattcgatgcctcgccaaattaaataaattcagagcaaagtggtctttgcacaccaataacatttagcggcccattatttgggacaatccatcccgattattatacatatgtttttaattaggatggattaatggctttttgatcaatccgtaaaaatgagaaatttgtttagccatgaaaacatttattttgttaactttaatttttctgaatttcattctgaactgctgtgccgcaaggcaattaaaaatgtgcgtcatttttgaacagacggatcgaacgcgcgaaatcgtagtgaatttgcaggcattttctgccgtcggatatagcgaagctacgcaaaaaaatatgcaaaacggaaaatattacaaaatttttgtgcccgattttattttattggatgttgttgagtgcaagtttggcatttttataaagccaaaagagcaaaacgaaaatggtaatgagaaaaaggggaaaaagaaggcaattattgttgaaaaccaaatggataaagatgaacaaaaaatgtggacaatgcaccgatcagtaaagcttaatctgagcgatatacacactttgatgaagaagccaattgtggtcaatttgggcaaaattggtggccccgagctttttttgaagcgacgaatttttgtggagacgaataacgatttgggcaattaccatgcatttttgtacgcaattatagagggaaatgaacagaacgccaacgaaatgaacgaaaaaaaaagaatttttattggtcatgccccatttgtgaaatttgatgaggaagcatcaagctcaagtcaagcaaatcacaagaaaaaatctttgctcaaaaatttcttatccggcaaatcaaagcagatggaaaaggcattgcccgagggacaacaggtgaaacagtaattaaattaaattattaaatagttttttgttaagttaattgaatatcatttatcaattccaattgaagagaaacgcatgtttggacataaaatttgtgatttaattttggctatttttcatgatcaaaaggtatgaaagttcggagtgatgtacgagagtggaaaaatctgtgaaatttcaatccgatagcataattatttcaatcttttcggaaatcccttttttggattcccgggtttatttatcagtttcgcatctgacttaaaatgggttatttcttgcttatctaattgaaattcagggggataaaattgaagaagttttaaatgttacgaattttgaagaaacagaaaagtgggaatgttcaatttgcaaagatcaattgaataatgaaaaatcgttaataaaaatacacgggcaaaacattcaggtgcaaaaattataatttctttaatttataaaatttttctagcatttatttcacaaaccatgcatctttaattggtaatttggaaataattagtaagattttttaatttaaaaaaaatatatttttataggtttgaagcacaaccaaaaatacgctgcccaatttgcaattggcaaccaacatttgtcatggtcggtatttgatgaatgaatctgcatgctttttaatcagaaatttaggatgctagattgaatgcaatttttgatggacctattggattttcttcgatttttgccataaattcgctgggcattttatttaaaattgccaacggtcaactggaaattgggcaatttaagcaaaatcaggcacaaaactttattagcaaaagcaacggaaatttaaaaacatttgagcatgagctgagaataaagttttctattgcgagtttttttcatttatattcattaattcttcaaaatttatttgaaattactgccaaagggttgcgagcagagtgccgtccttcgacaaattcaaaatgaactcg

SEQ ID NO: 27148 - DNA, 1516 bp, Heterodera glycines
gctgtgtttcgctccgctccgcgacttcttccgcctccttttgctccccctgcggtgtcggcgcttttggcctttgctctccgcgttcaccggcactttccatcgcaacgacaattggcaacaatttgtcttttttggtgggtaaagaaaatgaaaaaaaggttaaaatttgccattaaaatttaaaaatgccttcaaagcatggaaagagtgaaagaatgcgttactaagccaatgaaagagttttgagtccttacgagtcaattagccaacatttagagaagtaaaaccaattaggcattcaatttgtatatatattttgttaaatatcgaatgtgttgcacttgccaattttaaatgcctccgggcaaaaaaggaaagaaaattgcctaagagtcagttaaaattatgtaagcttttaaatttaaaattacactaatgtatgtttaggcttcttcatgcggttaattttgcgttccttttccctttttgtctttttaattggttttgtgcctttctctgccggggagggggcggcggcgacgcattggcaatggcatttcctcagggattaattaaatttaggaaaaaagcacccgccgttggggacgacagaacgactggcgcattggcacgtgcagcggcaacgaaacccaaaggcaattaattttatgtcgggataaaccctccggcaatgcgcttatgtttttggcctgggagggaaattgagacacataaaacggagaaacgaacgaacgcattgcgaagcgaatggggcaccaaatcccttttccgtcacttttcgatagtttcttttcttaattttgtttttttcttccttctaccatcacttcctttctttctcatcctcttcctctccctctctatctctctctctctctttctctctctctctcccccctctctatctctctctctttctctttctctctctctcccccctctctatctctctctctttctctctctctctcccccctctctatctctctctcacttactctctcctctctctctctcccccctctctatctctctctctctctttctctctctctctctccccctctctctctctctttctctttctctctctcccccctctatatctctctctctctttctctctctctctctccccctctctctcccccgttctcttctctctccttccctcactgtttctctttctcttctaccctctcctcttttctcgctctctttcctcttccaatcatcaaatttcttcgtctgctgctgctgctctgatcatattccatttgctcatctgcttcccaatgcttctccattttgttcagtgtttcgtttgtcgctgttttgcactggcgactatcgaacagagtgattgatgctaacaataagctcaatcatcatcagcaaaagcagccgatcacatcactctcacattgccaccagctgaccccttccgaacaaaagcaccccccgagggcagtttcgattctgtccaactgtt

SEQ ID NO: 27149 - DNA, 1341 bp, Heterodera glycines
ggggaaaaagaaggggaaaaggtaaatgggtgaaaaaggggttccagccaaatgggaaaaaagggattttatttaaatttaattttaaatatttttattatttttttttttttttaaaaaccattggcccttttttcggagtggtatattatgggtatgaccacaaaatcttatcaattttatttggaaagatttgaaaattccacctctcaaacaaattctgccactttaattttttgggcggcaaattggtggcgagcaaagtaaaaatggtggggacatttttttgcggctaaaaatcttatgatccgaaacacgcggaaatttgagtgccaaatttgttttggcatttgagataaaacatagtgtaatggcggcagcagatttgcaattaatttgttttaataatggggtggaggcgaatggcgacagacgaattgtccgattagtaattcgcgcgaccttttggcgggtgaaagtcttagttcccggtttattttatggcttcaaatttaagccaaggaatatgccgcaagcgcaacggattaattaacatcattaattaacatcatttttttgataagagatctcacgttaccgtaaaacgcccattggagaattttaaattgcaaaatttgcgggaaaaaaaacttaaggaaaaatacacgattttttttaatttaaagcaattttcttaattaaattgcattaaaatttccaataatttttcccggcggcgcctaagggcacctaccggaccctcaattttacgatatttttgaaaaattgaccctaaaatggcaaaaattagtcatttttggcaaaaaaaaaaagagagaagctaagccctggcactgaaaattttaatgtaaagaaaacattcatttttggcccgaaaagcacagatttcccgcctccccccccctccgaaactttatttttttctggttacgggccttcctgtgccaacacgcacatttttcacattatttaatggacataaaacataaaataataaaaccggcaatttgcagtgccggcggggcacaaaatgcacattattttctgcataaattgcacatcatataatttggatgtgtttaaaaataacagccctcagggcaactgatttgatgattgattcccttgctgatgctgttttggactctgtgcggccgaatgacccaacgacaacgacaatgacggcgaacgaccaccccgaaggaaattatggggccaaaaagagcaaaaagggagagaccgccccgggggccaccgatggatggatggatgacgtaattgcatcaatttcatcattcttcattcattcattacacgcct

SEQ ID NO: 27150 - DNA, 996 bp, Heterodera glycines
tcgattttttcagtgtccgtttaggggtactcaaacatttattagggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacattatggggagcaaaatccaacgcagaataaagtacaggctatagggaagctattcccgaaggattcggtctccccataaatctgggcgcatcggttcgggggggactgccccgaaaacaaaaaaatcgatttttttca

SEQ ID NO: 27151 - DNA, 809 bp, Heterodera glycines
  misc_feature (17)..(17): n is a, c, g, or t
ttcagtcaaattttccncaccgtgagaaatgacgtggcactattcaattgaatggtctggaaagattcttaggtgggcggtaaaaagtgccgatgttcgccatttgcgcaaagaatcaatgccaaccaaaaacattttattcccatttgccaaaatgttgacatttaaaatgccatcaaatgcgcttctttctcaccaaaaaactgtcaccttcgtttttcatttgcttctcatttcattcatattcggctgaaaatcctttgctggaattaaatgacaactcaaagaaatgaattcgtcgtacggtaaatggggaaaagataaacagaaaagaaaagagtgatgtgacacagaggcaatggatgaatgataatttgtttgccaatttgtccgtccgttttattgagggaccatcgtttaaaagggccgcccctccccccccccccccccaccaaactctcattaatccccgtcaaattcgatgaaatgatcagcagaatgtgtgattggaaggtgaaaaaatgattggaatggcatgtacaaaatactgaaagaggagtcaatacacttatggaagtttaatggacaattaaatcgagtcaaaactgtatcaggcttttgccatttcaaaaaacaattgaacgggttgctcgtctttcgctttcaaatccctaccgggaaaacaatctttgcccatccaatccctcctcttcctcggcggatgccaacctttgcccatcgcccgtctcagctgacttcccaatttatgacctgcggtcggtcgtttcttatgctcataaggaatggag

SEQ ID NO: 27152 - DNA, 1215 bp, Heterodera glycines
gaacattttttagaaggtcagtttaacgaaaagcaaaattttgtgaggatttgtgtgattttcgaaaaatacgggaattatgtcggtgtacgttccggggttcttttttttgttaaattttgccattgtaattaggcattgcatttccttatgctttctctccttcttcagcttgccgtcggctttctctccctgctctgttctctgatgctttggttcaccgcttctgtccattaccaacgcttttaccttgttttgggttgaatttcgctttatatttaactcttggttactttttagcgtttttgtgcacttttctgctctgtctgacaacacttctcatcttttccagcaccgatccgttcatgggaccgttggccagcatggcaacgtccatccaagtgactggccacccttttcattgcctttgacaatgagtgttttgtgacggttaccaattcattcgcgccaatgtccaaaatcgggttcaacttaatctttttcattccctaatagcctaaacatttattatttaagtgatagaaagtgattgtgtctgataatttgatagttaataaattgttgaaaattcagaaactattcaaaacgcagaattaatgctcctatagaagattgtgttttctaaattttaatccttttaggctatagggcttcaaaaaaaaactgttttaatctgattttggcatagacgcaaatgtcttgacacggtgtgtgacagccttattgcaatttgcaaaattaaatatttcccgggcacaaataatctcgatttgatttgactgttcatgtcgttcaggttgtccttctcgtttacaccgtcattcccctgcctctgtacctttgcattctcatttgtgcaatttgtgagttgttttttggttttggatgggttttttccatattttcggttcattcccccacttttcccccacagattcgctgctcttagaattgctcagttccccccaaagtccgtcttcctctttcaccgcccttctccgtcccggcacaaaagcgacgctccatttctgtgtccatttgctcggcattcatttgtacattctgacccaagtgcggcagcggaaaacctttctgaaggtcggccagtcgttgttggccaggaaggacttggagctgcagacgcagttcaaggaccacatgatccagtctgtgatgccaaagaaagtgcgtttt

SEQ ID NO: 27153 - DNA, 1519 bp, Heterodera glycines
aaaaaaacgaataatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaatttttttcgaaatttggcaaacttggaggtgtttttgatacaacgaacaacaataaaaaatatgcatttttaagttttaaacccatttttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctatttataactcactaagaaaaaaaattgtattatattaaaaaaaaattggcattttgtatgaaagcaatgaaattatgtaaaacagtcagggaatcttcaaaaatttctttttcttcaaattctcatataaaaaattttcagaaattaggctagggtatttttatagttttttttaaatattattttttgatagatttttttaagattaaatttctaaaattacttgaacaatggacttccaaaaacgaagtttatttcatgattgatgcgccaaaaagattgcttgtccattaagcaattgtcaatcaacaatagttgtctgagcttttctttgatcttttccgccatttttggattaattaaatctttgatgatttgttcaatctgttgctcatttaagtgttcaggaaaagcaccaaacgaccacattaccttccaaaaaatttgttgtattgcaaccactaaaattgaatttgtttttgaaaaactcaaatttggaacataatttttcaatccctgggcgcgcttgggatgtaaaataagaaaacttggtcagagaatatggtatgagcttaagtaaaatatgtgatttagaaccattgaaaatttgaataattttttagaaaaacctaaaaagaaacatttaaatttaaaaaattcgaaaaagctaaagcaaaatgagttatatttatttattttatgtaaaaatatatttttttattatttttgattttatattttataaggaaaactttggaacaaaaattttaaaaaatctaagcaatttcaatgaattcttcaaaaatatttaaattttttttaaattttattccttttttattttaatatttataatttttgtttaaccaattaaatatctaagcaaggctttattttaattttgttcctttaaactcaattaacatttaaaagcatttcgtggcattctaaaaaatccccaccatttgaccagtttacttttttaagattagagtcaaaaaataaattttttgaacactttaactaaaaagtattttttatttttt

SEQ ID NO: 27154 - DNA, 1274 bp, Heterodera glycines
  misc_feature (18)..(18): n is a, c, g, or t
ttcacaaaaataaataanttcgggtctctttaaatttagctttggtcaaaattgagccgagtatgggacgactacaaattgcgtaaggaactcgtgaaacggcgcaataagaaacgtctgtctttggatttgtcattaattgcttaatttattttaattcaaattcccaggctcgcattgccgtcagtcgcaactgcctccatcacaaccgttgccgttatatgttccgccagtgattacgggggtcagtttattaaaattttagaattgtttaaaaaaaatgtttttccaagtcaattagaattaattcaaaaaaatttcccaggtcaatcgtcaggagcaaatggaagtccccgcaatctctgtggcagtggtcaccgaagtgccaaaagttgagcaacagggtggagaggatgagcaggaattggacttgcgttaggacatgtaaccagagaaaattttagataaggggaagcaactgggtggaaaattgtggaaaatatttttgaattattaaaaaagaattttctctacaatgccaatcatggacaaaggttttaagttgattacaggaaaaaaagataaaaattggaaattgttgaaaaaaaaaagtttttaaatttacgacgatagtaaaacagatttacgatgtatctttctctggttacatgtctaatggaaattattaatccgttaaaaatgctattttttcattggttatttaaagcatttaaatattcaacgcctttacttatttttaacattaaattgatatgctatcattaaacaataaaataaaaatttttttgtaataaagaaaaatatttttaacctctcaagattttaaccgaaagctcacatttattttggtaatattaagttttttcctctgctcacttcgggaatcctttaaactatttcgcttactcttgttaactctccacagcgtatacgctatttcatttcttccctctctgctattatccctattgtcaacctttacactattccattcctgctctaaaatgtgttcactcctacagttttctctttcatttctgctctacactccatagcgtatacactatttcttttctcatacagtattcgatgtcctgctctaaaatgtgttcactcatacagttttctctttcatttctgctctacactccataacgtatacactatttcttttctcattatgcctcgtattcatcctaggtgatgcagggattactgtagttgtgtttgacaatatgcattaatctcgactc

SEQ ID NO: 27155 - DNA, 861 bp, Heterodera glycines
tcatcgtttcacttcacttttcgttcgtttattcaccaattcatcccaatttttgtagtctaaaacaacttccacttccattgttcacttatgttttagtcctccgatcaaatgacaattttcttccaaatataaaaactttcgtaatttgctacttaaagggacccctccccccccccccccctcagtcccaccattttccattgttatcaaatgacactcaaagtttcttgtttgggcttctcaagcatttttttctatgtaactacaatttaccaaggtttaggatgaattcagaacatttttttgtaccccgggtccccccccccacggataattcagacaaatggaagcaataaaaaattctatcgccgttataaaacaaacattttttatttgctaattaaatatcattacataaattaaattttcccattttaatgggtcgctaccgccctcctctcgcattattaaacaaacagtccggtaattcttaaaataaaagccaactgctgaaagacaaaagccgaaaagggccataatttatattgtggataataatggcacattgaccgagaaaagagaccaaaagtttattaaactgcccttgtcattttcctttgcgagtaacggcacaaataattcccaaagtgaccaatcagtttaatcagaagaagaaaactctgttcgcacgattattagtcagatatgaaaagagcaaagagcatcatttgtcatttgtgtgctcccaatttcagcgaatggttaacgacgccgcggggggggggggggaaaatcggacatttgaaaaaggggggggggggtcattaaaaaaaaggtcaccggaaaaaaggggggagg

SEQ ID NO: 27156 - DNA, 1275 bp, Heterodera glycines
  misc_feature (53)..(53): n is a, c, g, or t
aactttcatttttttaaattttttttctctatttaatcatttttcgcgaaatntaaattttttgtacaaaatgccaataatgataataaatttgaatttttccgaatttactgcccctcctcctgcaggggccattcgctgacgccctcaaatgggtcatcgccatattcgtcaactgctggcagctcgacatgaacctttttcggagaatgttctctaaaaaatgataggaaaacaattattttaattaattaattgattaattaatttaattattattgcattaattacccattttcattttgggcgctgactttgggcgcattttgaaattgaaattgcttctcagctaactgtctaagagcttccaagtcttctagtgatgttgcctaaataaaaagtaatcttgtttaatttttaattttattttcaaaaattggaaccttattttttaaataattaaaaaaggagaaaagaaaatttggactaataaatttttggcaaatttattttattctactttcaaactttcaacccagatagataaaaatatatatttttaaaattatatttcacaattcaaatttatttttttaaaagaatgtgcgaataatgtaattaatcctaatcctaatcaaaaacactatttttacaatcacctcagaattttttttatcatttaattaaatgcatttttttatatttaaatgataaaattttaattaatattttaatttgctaataaattttaacaattctgattaatttcagtctgcattctccttcaacatttttttgattaaaaattttattttccaaatttgcgtaaaaaaatgaataattattttgcgccttttttagccctcataattccacaaatttgtataaaaaaatgctgttaaacaaaattccaaaaaatgctgtaacagagttcaatcttcgtaaaatcattttccggtcgaattattattaaccagcggcccaaaattgctctcataaaccatcaaaatttgtttttgttggccaattggcaatgtattgaaagtttaaactaatttttttgtttttgttttggcgttccatccaatgaaaattgttttaaattttttgggggccattaggcccatcggcgattttcgattggagcagaagacagtcgtcccaaaacataataatatggacgcggagaaagcaaacaagcaacaaaacgagtttcccccgataattcattcagccttccaacccattaaaaatgttttgcatcttttttgaaat

SEQ ID NO: 27157 - DNA, 1576 bp, Heterodera glycines
acaatttgtacaatttttattcaattgtttatttcaggttaatagccaaaaatgaagagatgatctgcgattctcttttcaaacatgcaatcaccaattaaaaatcattgaggaaattacatttttggtacaattttctttgtaaattttctcaaactatctatggagatcatcatcatcaatcacatttatttgtcaatttttgttcgacttttatctgaacatactgttggtaaatagtaggagtcgtacagcaaagggaattcacgagcaaaaaagtctaaaatcataaaaatatgaaattgcgtaattaggtattttctaacattaggcgcaaatgccttcgataaaatcttaatctagaaccgatcctttctcccccccccctctccccgtttccccattacctttccttttcccccacccaaactttgctaccccgccaattgacttctcccaccccttcgcccctctcacttttgattgatcgcttcttcgggtgctttggccttagaataacattttccttccccgtgcccctcggggatggataaatctctcccattgccattgccttcccatcgcccttctttggtccaaaaagtccccaaaccctccgagacgacgactgatttatggccatcagccgagggacaacagccgaaaagcggcggcagttaattgtcatctcagtcaaaaagcatttaacaataatacccatccgaaattggcgactcaaaagctcattactgattaatggcacaagcatttctgaatttttaactttttaattctcaattaaatgttaattcttcgtttttatcctcgccatttattgggaagtgccaacaaaaagtgggggcattttggccccgcccctttgcctttggtcattgcccccgggggacgacggcggagggacaagggggagggagggggagggacaagtgaccgcccccaccccgcagtgcggttaggaattgaatttcacatgaatccgatgactgcaaagcgcctcacgaaccactcaaatggaaagaggtgttcactgaacaatgcgtgccaacaatactaaaatgaataatggaaatcagaaacgaatctatggacgaaatcaaaaaatgccaaaccaaaaacccaagaaaaaccggatgaactttaccaccctttcatagaaagagaaattttgtcttgatcaacaaacgtaatgattgtgattaatgacgcggacctaatccatttggacgacactgacctaacacaccaaagattaacataagaaaaaggaaaatgaaccaaaaaaacacaaaaacgaccttcacttcaactaaataggaatagggtcgctggtcgcggtccatcacatgaagtatcgatgtgatggaaatatgatacatgaggtctaattcgatctaaaaacataaaatatatttatttcgaagaagaaaaattgaaaatatcaccgttatcccggaattcgcttgattcatcaaatgttttgcgaaagaacgatcaattgggccgacggagggaagcatcctttccttcccgacttttgttcgacagtaaagccgta

SEQ ID NO: 27158 - DNA, 2251 bp, Heterodera glycines
agtctctaatgagttgagcagctccgccgtacgtttctttctttgctcttccacagcctctgatcgatcattgttttactgcgcgagcgcgagtcgttcacgtggatgcagcgtgagacgaactgcgcgaacatgtggcacgtgacaagcgctgttgaagaacgaacttatcagcagcagccgttgttattgtttcatgaaattagtgcaataaaaataaatgattacgaaaatgcggataatgagaaaaggcaacgaccgagggtaattagtagcaattaacggatttatatttaagcataaaaaagaagaagaaagaaagcaagactttagcagaaatgaataagaaaaattaaaattatttgcaacaaaaactaaattctaaaaaatttgatatttatatcgcaagtttaaaataattttaaacaaaatgatattgaaaaaggataattagttaaaatatttcattaaaaaataaacaacccaaattagcaaaaattaatttggtagttgaattgatgcaagattatctgtgtataaaaaaataaattaaatacaatccgggacaataaacgcaaacttaaaaaaaagtttaaattttccacctatttattattataaaatataattgaaattaaatgataatttaaatcgacaaatttggaaagttacacaaaaatattttggttgataaattacaataaaataataataattttttcataaatgatccgtcgcccaatgaactttcacactcaaatgcacacactgaattaatttgctcgccatttctgtcaattgatcattttcacctcgcgcacattctgtccccttttggtcgtcacacgcgccacggtcattcactccgtcgtcacattaaaaaataattacagaaaaagtcattaaacaaatgccgttcgccacaatgcgttaaggcggttggaggggttggttggctgatgcaccaaacaatcgcgcacattcgttccttcgataattgggcgcggatgattagcgctaattaatcgtaattgcatagattgatgcaaagaatgtagataaacacaggcatttattcaattaataatgtgatcatgttatgcgttgaacgaagaaagagtgaatggaaaggagattgtttgcatgcatattgtggtggaaataaaataaacataattgaataaaaaattattgaagttaaaacaatttaaaactattcaattcggtccccggctgtgtttatgacgtcatattttccaaattatcaaaattaaatttaaaaaaattgattacaagggagcggatgtttaggggtgaaaaattccaatttagtggtctaaataggggcaaaaaatggcgaaaaaggggcgcaaaacggtaaatatgtggcgaaaacttttaaaatctgtgctttttcaatgaaaataaatttaaaatcaatataaataacttatccatcagtaactttcatctttttttctttttggttaaaaaatcctgaaaaattttgttacttttcctaactttaaagaagtcggtccttatggatgcatttttatgtatttttgctaagaatttttcaaaaatgccgtaatagagggcgaaaataggggcgaaagccaaaatgtgcgggcgttaaagcgaagaattttcgttaaaatgttttttttgtgcgtttcttattgaattaaaaccgcaaaaaataataatttcgatttatttcacaaattcgtgaatatgcaacttttatatgtttttataatgttattcatattttcgaataattttttatttacaaattttaattttgaattttgaattttaatttattttaagtctttagccatttttatcttcacattgggatatcagaaaataaaacttatgccgggccttcgcgtctgtccctggcagaatagggtcggccaattctgcgcatctaccgtccgtcccggaatcaaaattttcaaaatttcttagaaattcaaataaaattgttgtaagctacttaacaaatctcatgaaaattttgaaaaactattaaaactccgactgcgacaaacgacatgattaattaccccgtttttaaagtcatttttgattggttcatttgttgttttgagccatatttggcattacagttatcacacatttttcatatgaataaaaaacggaaaaaacagaaaataacattcaacaaaaagcgcattattggtgaatcagcgtttcctttttttatttgtgaatggat

SEQ ID NO: 27159 - DNA, 1308 bp, Heterodera glycines
ttgcaaaattccctttatcaccgttttttgggacatatatgaaacctgaattgttaaaaatatttttgggggggttctaattgccgatcatttttagtagggttgagcggtaaccggtaattgtaaaaaaaccggtaccggtaattttcgggttgaaaaaccggtactttttggctgggaaaaccggtaaaaaaccggtactagtaccggtaccggtcaaaaccggtactaggttctcagttgtaccgtttttttcagtaccagtaccggtaccgctcaaccctaatttttagtccacattctgagccgtacggtgcaaagcatttgtacaacgggcactgttggcggcacatttgactatgaccagacatggatttgcgcgttgtaagtttttctcatatttgccaaaaatttcgaaaataaattttcaaaagaaattctgctcaagtggttggcacgaaaaaatttttgagttttattctgctagttcgtttttaaaattccttaagtgccccacgccaagagagtaagaaattgattataattaaaacaatttaattaattaattctatgacatcgaaaataaatattcttgaagtcaatcactcgacagttttagttcttaattaccctgtaaaatctcaaaagaatttgacaaattccaaaaaaaattgtgctaaataaaattcaacaaaatatttgacaaattttaatttttaaaattcgatttaaatttattttatttcttttttttaatattcaatttgcagatgcatgctgaacacggtgcagcatcgacatgtggccattgcgcgactgtcccatccgacaaatttgggccgtaccatgcaagacttgcgcttcatcattattgtgattgcaccgtccagagcggtaagtatacttattttaaattataaaattatttaaaaatactattaaattgaaatttttttttacagtaaactaaaactcatttaatatagcttataattatttatataataatttattcgatttagttaatccaaaattttttcttaaatttacatattcaaaaaccttaaatttattacatataaaattaattcaatatttctatgcatttcaaattattatcagaaaatccattacacatttttattatttaataaatttattaaattagtcgccattaaattttaatattaatttttaatccatttaaatacatttatttcactttttggactcacagaaattttttaaaaataaataaaatgcactcaaaaaaaagccaaaatttttggagttgatttttaaaaaatc

SEQ ID NO: 27160 - DNA, 1388 bp, Heterodera glycines
ctggtcatggacctgatttttattattaataatacatcttgtcgattatacaagaactaacataaatagtacgtaagacagtatttcttcctccttaaccataaaaaggggggggggaggggtcgaataaaaattattgtcggcacatttgtgtcttatataattcgtcatttttcagctgagttcgccttggtttcgcctgtttctctacgagttggcgggcaatgggccgccggcactgttcctgccgttgggcactcgcctgggccgtttgccaaaactgttttggcacagtcggcgattgatgctcacgcagggcacccatgagccgctgattttgcccgtcgaaaatgcattggtgccaaccgctgatgcactcgtgtcggcacccgtttttatacaggtacacccatgtttgatacttgacgagaaaattggcatttcttgttgggacaaattggagcaaatgggacgaaatttgatccccctttaattgcctaattagtgagtggggagacaacatcagtcagtttatatagaaccgaggccgaaaacgtggggcccgaaaaactggccaaataaaagtccaagacctctaacaataaatatctctatatttttaccggtttgataatgttcaattttacggtaggcatacagtgaattggcgtcggatgccgaggtggtcaatgtgccgttcccattccttgacgacgacgaacatgccaataacgacaactataccaagcaggatgctactgttcatgatcattgccatgaaagggttgctgctgatgcagcagatgatgctgttcttcttcaaaacggtgatgttgtacgacatcatgaccaccatcatcatcatggtgccaacacaaacaacgacggtactggcacagaccgacaggacgaaactgtacatggaacaatgccgccggcaccgtcggaattgccatcattcagtcgacatcccattgtgcgaaaactgcgtgaactgctccacctggaccacctctgcgggtctgaaatatgttagggtttcgagaaatcttttggctgctcacagtctcagccctcttggtcaattttcaattctcgctttccagtcaagaacactcctgtattagtaagtaacacttccgagagtttggtctcgacaaaagttggggtatttttttagtcgtggtcttgagttctcggcaaaatttccgttttgtacatcattactaaactcatccccctacactctctcgctctctctatctcttcacttcccttctctcttccttccttcactctctctctctctctcgctctctcgctctctctctctctctcgctctctctctctctctcgctctctctctctctcgctctctctctctctc

SEQ ID NO: 27161 - DNA, 1235 bp, Heterodera glycines
  misc_feature (9)..(9): n is a, c, g, or t
tcgctacanatttcggagtcaatacaacgactttcgaccaaatcagcagcaccagtgacaaggcgttggtcagccaacaatgttgggcctcaaaattcaacggcattcccttggcaattggctgaccaaagtgtgccgtcctttggcaaagtgccgttcctcgacccaccccttttactgcggccttttcctcggcttactcttcgacttggccatcgtttggcttttcctcccctctttgtctcatgcgccgaccaaagaaaggcaatcgtcgatcagtgaaatggcaaaaactgtaaaattgccaaaacaactgatgggctacgaggcgtatttcaacaaaaacttcacttaccctttcgattgtgagttgcttttgttctaagcggattaattgtccgggaagtttgcccgatttgccattttttgcttaaaagaggaaatgaaaaataatttaattgtgttcagcccgagggaccgttgcgcaggaaattgcgaggaaagtgcgcgtgttctgttggattttcacctacgaaaatttccacgagagtcgcgcgcggcacgtgaaagcgacgtgggcacagcactgcaccaaattcatgttcttctcctccaaggaggacagcacacttccggcgattgacctgcaaattccgctcggaaggcaattcatttggcggaggacgaagaaaattgccaaatatatttacaaggaatatttggtgatgggaaaatgaaataatttaaaattggcactctctgctcataattcattcattcgttgtcagaatgactacgattggtttttccgtgccgatgacgattcctacgtggtcatggagaaccttcgactgatgcttttgccatattcgccaaaagaacacgtctattttggctgcaagttgcgcacaacgctgtacaatgaccgcgtgtttccgcagggcggcagcggatatgtgatgagccgaagtgcgctcaaagtgcgttaaaagggcgaaaaattttaaaaatatttatggtgagccgacaggcaccagcgggaaattttaaatttttgcgtatttatcaagaaaattggcgcaaacgctcgcacactttgacgaatcgggtcgtttcaaaggatgcccttgggcaatttgaatttttttcccgttcccttaaaaagggaacccaatttcgatgaaaaactttttttcctttaatatattccaatgcctttctaattaatgtgttta

SEQ ID NO: 27162 - DNA, 1887 bp, Heterodera glycines
tggcacctttacgaaacattcccaagttggcacttttacgaaacgaccacagtggcacctttacgaaacattcccaaggtggcacttttacgaaacgcccatagtggcactttttacgaaacgacccagcacgcctccccctaaattaaaaaaaacaacatattttcagcttcctaaatttcttgggatttttaaaaatattcactttaaattgtttaattccatcgatcaaatattattattttgaatttttgttttagcccgttgctgtcttatgaagcctgtgaactgcttcaagtctatctgtttcccaaagagacggaggtgtggcatgccttaggtataaatctcatcaatggctgcttttagctcagggttcgatctcaaaattttgaaaatcctcatttgccactaaaataccccaaaaaaatcctcatttggaatgaaaaatcctcattttttaaaacataaaattgcgaacaaaatcagtcaactatcatatttttcgtttgaaacaatcacggcgcctatcagtgccgccggacctatttttcttaaaaaattggcccaagaatcgcaaaatttgtaatttttggtaaaaatttgtaacaatctcatttaaaaccaccaaacaaataaaaaattcgatttttattgttttaataaattgacaattctcttaaattttttgcttttaaattgcttttttttttgtgcgcggtttttccaaaaaaactttttgggaacgttggaggggggggggggcagtgccgataggcgctgccgaaaaaatctgagattttgagtgcgatttgttaacagattttgtccaaaaaaatgattttgactgaggatttttcgaaaaaatgtttaagatttgaagaaaaagttcgaacattttgccaaatatattttttgtcactttttttttcaaaagactacaaaaatccgcaaatcctcattttcccaaaaaaatcctctttgaccctctaaaagaccacaaaatgaggaaaaatcctcagatatcgaaaccctgttttagctcctcttttttttgcaattattttttctttttaggaagggcatggaacacgccgccgtaagttccttcttttgtttaaattttattttttcaaaattttaattttttgttctttccagtgaagattggcttggaactttgccgccgccttacaggtcaaaaaactgacttttcgggttttcgaaaacaaaaaaaaaattaaattttttctactttttttttgttgtgattttcgagtcataagtccaaaacagggctgcacgaaatttcgtgtcgttttcgtttcgtcctacattttcggcaatttttgggtttcgtttttgtgtttcgttttcgtccgttaaaatttttttgtttcgttttcggttttcaaaattttatttttcgtttcgtgtttcgttttcgtatcgaatgccttttttcgtttagttttcgtaccagtaaccagattaaatgacagaacccgggggggggcgaccagtaccatgggaaaatctttgtacagaatatttctgtcctatccaagcttaccatcgaaaagcccaaaatatgaaattaaaatttgctttttaaatatttttcttctaaaaatttgctttctctgctgtcaggcccgtgttcagcgatggttgggcaccgtatgggtactcggcacaaaacattgcgcaaccaccgccaacattaacggagccttctgtttcatcgtcaatccatcatcatcaaattgatcagcaccaccagcagcaacagcagcagggacagcaaaggcgagttcaacaacggtgttaagtcgaacctaaaagaacgtgtcaatggggcgaaccccgaaaaaagtgccaatgaat

SEQ ID NO: 27163 - DNA, 597 bp, Heterodera glycines
ttaattacataattaattttttgtagaccaaatgttattatcaaagccaacagcagaaggaataaggaacgacgataagaaaggaaaaaggatgccgataaagaaaaacggagagagcgaaggaaagggagggagagggggacgaagggaaagaaagagatagagagaaagagagggtgccaatgccaaagggggagagtgccaatgctaattaggctgtttgataccgctcggttcgagtcacgaagtgagactgagactgatcatcggacgctttatacagatcaagaagatacaaaaactggacgctttatacagatcaagaagatacaaaccgaagtttttatcaatttgaggttcggtgtcgagactctcaaacagccctatgccaattgctaatggaaatggcaaaacgttattctgtttaaccgccccctggcaaaatgtcataatcccgacaaacaaagacatttttgttaatcgcctgcttaatttgaagttcggtccaccccatttcatcactagcaaaggtttgttaggctgtgatttttgttaaagcaatcgcatgtagaaccctgagattaataccaacccaac

SEQ ID NO: 27164 - DNA, 939 bp, Heterodera glycines
gaagtctccgaatcctgaataaataaatgaaaactaaaaaaaaatttttctcttcgtacccaaataacaattctgtaaatgtccttgtcctccctctccttgatcggtctgatgtaacatcccctctccacatcatgacaaacattgcacagccggcaaaacatctccccacattcatgcagcttcttcgggttatgcagataggttttgctgcatataacacatcgcctccacagtttgcaagtttggtgtccctgatggtaatcgaagcattgccggttgtagaaaaagcggtggcaatggggacactcaatcttcactccaacatccttcacacacggcacgcccccaactcggttgcagtaataacaccgggccctacattcgtacgtatgtttggtttccgttgaataaaaacactcgcagtccacgcaaaacttcttccctcggttgaaaaagctcacataattcttcaatccgtcccaatgatttccctccaaaaatatcggcaccaccttctcccgggccatcggtcccttccacaacacacgaatcgacttcctcgggtccgcggacttttcaaacgccacaatcctgtacttttcagcgttcaactcatccttaaattgttgttattttgctgaacatttttccaaaaccaacccaatgcgtctgaaccatcaccaaatgctcaagtccatagccactttcattcctctgcactcccgaattttgcaaaagttcgaacgctgcctctctctgcctcgaaatgttgttcataaaacgacgaaaattatccttctgcatttctaaataatttttcgccgcgaccagtgcgtagaacaagcaaaatttgtcattgttctctatccttaattttttttattcatttaatttaatccacgatcactcaaacctactttaatcgctgctgctcct

SEQ ID NO: 27165 - DNA, 2248 bp, Heterodera glycines
  misc_feature (152)..(152): n is a, c, g, or t
  misc_feature (185)..(185): n is a, c, g, or t
gatggacggcgtgggtcagcgacacgtacggccccatctgtcaatggcgccgggtgtgtcgtgcgtgtggacgtatcgcctacgtggccacacatcagtgcccacatgaccagccagccgacgatggaatctgtcggcgctgcaatgggccncacacccgtcgatgagccttgctacatccagcnccattgacgacggctcagttcgacaacgtgcatcgattgctgttgacaacgacgattctgacgacgacgacgacgatgaagaattgccgcttcgtctgtgcttctttgacgctgagacgtcacaggatacgccattacagctgaacaaccgcaccgtccagaagcacgtgccgctgctcatcgtcgccgaagtcatctgcgaacgttgtctgcaggctggtatcagcgtgagcgatggccttggaagacgggctcctggctgcgtctgcatgacaggaatggtgagaggtcaactgtttcgccagtggtcttcgccaccatttgccaatgcaccgggagacaacagcgcttcgccagttggagcaccagcgttcaaccagcgccgcttcttcttccattcgtttgacaacgacggcaacgacccagtggaccaatttttggattttttgctgcagcatggcccaaagaaggcacacacggtgtgcatcgcccacaacggtggaaagtacgatttccatctcgtacttgaggcactacaccgccgaaaccgtccacccaagcatctgtgcaccaccggattgaagatctactcgatgcgtctgtccgggcgtaaccaacgacgaatcacgttcaaggattccatcaactactttttttgtgccttggacgcgttggtgaagagcttccaagtgccggaccatctggcgacggtgaagcccttctttccgtatctctacatacgacgacaacatctgtcgcagcgcctcaacggtctaccggctcaagagttctacgcaccggacacgatgaaggcagagaaacgggcgcaatttctccgttggcacgccgacaacaacggcaatggattccagctacgcgagcagctcataatgtactgcgtcaacgacgtggccattttgagggagtcggtcatccgattccgccaactcatcgccgacaatactcaaggcctcgacccattcctccacgcgtcaacagctgctggtcttgcgctggcaacttttcgccgctgtttcctgcccgccaatcgtctggttcactcacccgagggcggctacttgcgcggacgccgtgcttcggcagaatcgcagcgctacatccgcttcttcgagctggagcacccggaggcgcaagtgcagtgcgccagctggtccgttggtgaagcgcacatcgaagacagtggctaccgcgtggacggactttggcgacgagaagcgcctctccgtcccctggccattgaatggcttggatgctattatcacggtaattaatttttttttcgtttccaaaatatcttaaaattgaggctgtcgtgtgtgctttcccgaccggcagcaacaattggcggcggggcgaacagcggaagatttgtacgaacggacggagcggcgcctctttgagctggagcacgaccacggctgcgatttgcacgtggtgtgggcctgtcagtgggcggagcggctccgccacgatccggacctgaagcgccgttacgatgctgtgttcgtcccttgcccgctggacccgcgcaacgacgcgttgaggggagggcgcactgaaccgttcaagctgcaccacgtgtgcagtgacgacgaggagataatgtgcatcgacattgtcagcctctacccatacgtcatggtaggtttttcttttaaacattcgcatattcatgatgaataccagaaagccaatcgcttccccgtgggcaacccacgggtcctgacgcgcgaggtgctgctgcgtccgccaacggtaccgctcccgtggaatgcaccggaaaacaacatcttccgggggctgctgctcgcccgggtgctcgctccacgcaacatccgggtgccgttgctcggctaccgcacaaaggacgggcgattcaccttccctttgtgcgcgtggtgtgccgaccgtcggcagcagcggccgtgccgacatgacgacgacaagcgctcgtgggtgaccgcctacacgcacgtcgagctcaacaaagcgctccagcttggctatgtggtcaccgaccctatttgaggtagtcactcatt

SEQ ID NO: 27166 - DNA, 1046 bp, Heterodera glycines
  misc_feature (10)..(10): n is a, c, g, or t
aaaatacaanctgggcaaaaaattcattccctttgctggggagggtaaaaaaattgtggaatcaactcgataaagaattaataaaaacaaattcttttaatcaatttaaaataaaacttaaaagttcactagggtaatctgtaagaccgggaaagttagaatgtaccaaatttctaagtgatttgtatttcgacctcatttgactttgacctcaatttatttattatttattttcacatattttgtctttttttaattcctgtgatcatccatatattttgtcacttactctacgacatttatctgatagtcgtcagagtaagtggttctcgcccttctgatgacttttttatttttatgaataaataaacaaataaatttcctaaccctggacccaaatataaacataaaattgcaaaaaaaatcaaagctcctaaaaagagtgctgatcaaaattcgaacaagttttagggttcctatgccatccgaattctctatagacacaccctcagcttcacatattaaaaaaataattttattaaacattcaataaaattcattacgggacatggacaattgaatcatcaaaattctcgaaatccttcaattttcctgcatatccctcaatttgtaaaccgagcgccctcataagatcatggatgtcaccgttgttgttgtacgacgcgtccaccaaaattcgcataatgacagcatcctggaggatgtatcgtttgtgtctcttgtgaatgaaatgacgagcagatcgggcagcgtccacctgtcttcgatgctttcattaaccccacaaatgaagtccgagagggcggggtggtgacagaggcctttctaaatgtttcttttcaatttgcttttaaaaaattaaagaccataaaatgaagatgagttgcttccagtccgttatttgtacgagcgagggcagacgttgcctgtgagtgcatgttccacagcggaattggaaaatgtggcgtccgaacgatttcatcctcccacgctggaactgaattttttattaacattaaacggat

SEQ ID NO: 27167 - DNA, 758 bp, Heterodera glycines
tttgcattttaataattttttttcattttttctatttcattaaaggtgaagcaggctttcccggaattcctggcgcaaaaggtgaagctggcttcccgggtctgcatggcgccaagggcgaattgggattcgatggattgcctggccaacccggattgcaaggtgggtggccaatttacagacgtttcgataaaaaatttgaaaaaaaattcaggcccacctggactgccaggttttcctggcgaaaagggtgaggctggcacacccggctacggcgtgcccggcttgccgggcgagaaaggcattcccggaattccgggaaaatcgggcagatcaggaccacctggcgagcgtggcatggacggaccacacggattcactggcataaaaggagaaccagtaaaaataaaaaaataattatttaaatttcattaaaaattatataaagcaaaacttgtttctattaatttttctaattttaaagctttaaaaattttataataattaaaatttcgtataattggttaattctcataaaattatgtgtataaagaaaatttttattaattttaatatttaaaattaattctccagggttttcccggccaagacggactgcccggacaggatgggctgcccggactgccgggcccgaagggcgatgctggtctgcctggctttcccggcatacctggccaagaaggacagcccggtctcgtccgccctcctggacttcccggtgatcggggcccgtccgg

SEQ ID NO: 27168 - DNA, 881 bp, Heterodera glycines
aaatgtatgaagattgcaacaccgtttttgcacggtcccttgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccaagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccaggtccaggaaaaatccaggttgccgaaaaatggcctggacctggacctggatccaggaaaaatccaggcctggatccaggtccaggccgagctctaatcacatcattttcggtcacataatcgcatcaatcaatcaatcaatcgattaattaattaattcatctttcttctgctgatcactcggcccgggagaagcggcgtcaagaaggctgaaaaaacgatgattcaattgcaattataactcat

SEQ ID NO: 27169 - DNA, 884 bp, Heterodera glycines
aaaatattcatgtagcccaactgactcgaacttcatccctttgtacctttattatcttacaaaaccacttcaccacacatgcatttactttttgaactgggagcccaaaattgactcgttgtgttgatgagttaatatattggcagggcgagtccgggcacccgaaggaaattggatgaaaagaaatttaagcaaaaatggcctctagtcttgaaaataaaaaatggcaatttaatgttaattttaattattttgacatcttatgtaaaaatgactgattttacagtatgatcaaaatttattgtttttgtggtactcaatttagacaccctatggtgctctgctggtattagtcgtagaccaaccattcaaaaggcaattcggtagagaatttatatgctctttctgataggcttactcattttttcagtaaaattttccgaacaccttgttaatttttcgaaagttttcacgattttcagtgtatttcgggtgttccggtcgatcaaggttcggacaccgccccgcccccgcccctgggggcgggacaggttttttggcctcacccccgtccccgcgactcagacccccgcaacccccgcccccgcgcgaccttcgcccccgcgggggcacgggggtgaaaaacacacccctaagaatggcatattcgtggaattaaaggcaaaaatttatacaattttgaattttttaacaatcttttacaaatttttatgaaataaagtaaatttgcttatattttttaaaatatttgtggtttaatggttagtgcttcatcattaacaatactttttgttatgagttcaacaccggttgacgttttcttttgattttatttatttttccaaataatacagggtttttct

SEQ ID NO: 27170 - DNA, 752 bp, Heterodera glycines
caaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagagccgccgttgcgtgtcccctaatagttggtgagcaatgaccgaaaattgctttaaaaagaaaa

SEQ ID NO: 27171 - DNA, 1767 bp, Heterodera glycines
  misc_feature (359)..(359): n is a, c, g, or t
aaaaaaaattattaagtttttcaaacgttatgacaattgttccagttttttggctagaacttttgaaaaacttaataaaattttttgaaatttagcaagctaataaagcaatccaaatgatacaatttggttgtgtctgagaaaagttatgagttgatttagtcaaaaaatttgcactttttgtgaagtgaccctagcaccttctcactcaaatgctttaaataattatccgctgctctcttttaagaattttcttctttttttacggaacaaataccaaaaagaaagagaaggaaatgccggaaagaaaacacagagaacgaaaaacaggaaaggacaaaacgccaaaccgaaacggnggggggggtttattcggaatggtgccgcgggtgggcgggtggcaaaggtgcctcgtcggaaggtgtgtgcccgttgatgactttcacccgggcggatgaaccaaacccaactttcgctttgcgttatccctccgtttatctcgcgccaccctccgtccgtcccgcgtcagccgtgacccctctctctttcctctctcccctttcccctccctttccctcttttcccctctattcccctctttgccctctctttccctctcttccgcgcccattacccttttgatcaatcattgtccgctctttcttgcgccggttcattttcgtcattgacccccacggctaattaatttattttctccaaattcggcacttttaactttgttttaccttggcatatgtttgccgctttcatttcgctactgaattccaattggatttgcaggcgaaacaaatccaacgaagcccaaccgaactcactaaatgatcaattagtaaattaattaattcatttattcattcgttcgttcgttcattcctcgcctccatccatcggtcatttccctttcatcaaatttgataattggtagacaagttggtgtggttgtctgctgatttttctggtcactctctctctgtctagcgatcgttcgtcgcattttgctcaattgtcgcgtctccccaccccccccccccccggtgaagttgcctttcctttcctttcctttatatccaatattcggcagttgcggccaatctcttttgggttgtgatttttggacaacgcggagagagagagagagagatgagagatgagagagagagagattgaatggtatgatgagagaacagagagaaaaagcatagcgagaaaccaataaagagagagagagagaaaagggaaggtacggatattttacatgtgggagaggagggaagcccgggggcagaatattgcaatcgcgcgcgagaatttcacattggcttctcactgataacgaaaagggaaggagccaggggaagagaaagtgagcaacgggattagctaatcggagacgaaggagagatcggcgaaggggcgggtggaggagggggcgcaaaaaggaccataatgtgatatgtcaaagaatagtaatggatccgttgaagtcactggttgtaacggttgctttccggattgattcggacgtgtccataggtggtcaacagccaggaaagcatttcaacagcctgaaacagaataccccataaatttattcaatttttaatgggtcattccaacttatgagcgtgaagagtgccggcaatgatcggataaacgctttttgtatgggccatcgccaactttggacagataagtcaattcttgctcattgatgggcagggttaagcaaaaagaaaaaatcaaaaa

SEQ ID NO: 27172 - DNA, 922 bp, Heterodera glycines
tttcgatctgtgggtggacggaagtgctcaaatttgaagagttggcgcgagttgacgctgacgatcagctccttctctttgtcgtcattggtgaacacgtcgatacggaaggggcggtaattgagcaacactttgtaggagggcaacgacttgcgtttgtccccgacggcagtgacgaaagaggccgagtcggcacccaaatcagcggccaaaaagctaaaaattcaatcaaattgaatttgccattacagcttcgaatgcattcgtttttgtattgattcattcatcattgcaagtccatttcacctcctatgttttggctctccgtcaagtgcaattgccggatgaaatcgctgtctgattggttttatttcgtcgatcagtagcctcagctggtcgtcctcgagaagtgccaaaaccatgctcaatcggttcaccgaactctccaaaattgcctcaatggacgactcgttcgttttgaccgattccgctcgtacattgtaaatcgggttgtccttttttgctctgtggcgcctgcaaacaaataagaattaaaatctcaaattttcggcgaacttatatgtacttgcaaaatcctgactgatcacatgttttaaaattacttttgtccacggaaaaagcaaaagataataaaacaaaaaagaaaggcgcaaaagtcaataggttcgaacgcatttctaaagctgaaaacacgacaaatgcattgggagtggaaaaaatcaaaatattaatctacggagaagtactttcattcattaaatattacagcataatattagaaagaatattcgcgaacgaagtaaatgggaggaaaacaccacagaagcagcagcaagatgagggcggacctatctaatccaaataaatcctacccccactcttttcataaatccatcttctc

SEQ ID NO: 27173 - DNA, 1419 bp, Heterodera glycines
  misc_feature (35)..(35): n is a, c, g, or t
  misc_feature (56)..(56): n is a, c, g, or t
  misc_feature (99)..(99): n is a, c, g, or t
tccgggctctagctaaatcgaccccctactcgttnttagtcactagcggggttacngcatgcggcgtccaaatctctttttaacattttctctaccttnttcttcctttttggtattttcttatggcacaatcattttcctcgtcttttttttgtactattttcttatgtcacttatctttttttttgctcttttcttatatgctccgtttaaaaattataaggtcaagaaatttttcgtcgctttacaaattttttcccgaaaatggccccgaattgggcgattcgtaattaattataaggtcaaaactttaaagccatgtagtaagcataacttttaacgctgatcaaaaaaagcaattgcaccaccgtgatcagatcactcctttagggtgttctgaaaaccttaaaactgcttgaaatcgtgaaattttcagaaaaaaattctttgagaggcttgaaaattttgtgaaatatgattatggtggacaggaagagcacaaaatttgctactagatgaaaaaatcgtaagtctcaaggacttctgtactcatcgcgaagcaataacttagaaaaacttctaacatgttaagctttcgaatgataccaaaatgttggatttggatgacaaaaattagtcatagttagggatgcaatttttaggctctaaaaactgcaaaaataggtaggctttaggctctaaaaaaccccaaaaataggcactaaaaatcctcaaatttaggggtgtaaaatgacaaaatgtattcaaaaaaataaaaaaattaggccaaatcagtattgagataaataatttttaaatcacaaattcttgtcaataaaataaataaataaattttggagatgaatttttgaaaaaaattttcatttcttagggatgtatttttgaaaattttcgggtcggttgttaggggatattttttgaaaaaaattttacgttgattcttaggggtgtatttttcgtttttattgcatttttattaacaaattttgggcaaaacgccaaaataggcaaaaataggctctttcaaaaatttttaggcgctaaaaataaaagcctagaaaataggcactaataactcgaaaagtagcttaacaacagccgaaaaaaacatgtttttcgtgcgtttcaagccacggggagctcaggaaaaaaataggcttttgcctaaaaattgcatccctagtcatagtaagttttgcaccaaaaattacggtaatactctagtttgtccccccccccattttcaaaaaatataaaaatttaaaaaagtgatataaaacattttcctagggttttcggggtcgctgatcacgatccgacatccatttcgaccaatttcgaaccccggacccaattcgaacaaaaagtcgaaaaaatatttttcaccaaaagtcacat

SEQ ID NO: 27174 - DNA, 1003 bp, Heterodera glycines
ctatgagttttgctttgtgattgctttctgctaatagccaatcgctgattaaaacatttccacttgctgattctcgtttcatgccccccccccgtctttcaataaattttgcaatttgaaactgatgactaatgcgttgcatgccgactgattgtgtgcgttgcgacagagttgagcgcgatgaagtgaccccggcccgggcgacggacaagaaacagtcgatttagacgagaggacgaaaactgagcgtttggagaatgaataatggggtatttccatcattgtttaggctatcgccaagcacattctcccaccatcattattataattattattcctttttttaacatattttattgaattatgtccgacaatagaacaatgctcaagaacgaaaaaattttcattaatactaactcatgaaaaattaaagaaatactgccaacattaatttcacaaaattctcaatgtgtgattaaaatataatgatcagaaagtcatttattgaaacaaataacaatacaaaatatgtgaaatgaaatggttgaacataaattaaataaatccagggctggggtatttaatttcaacaatttttcccattaaaaatttctaaaaattcttaattatttcctccctgagattgatcaatctatgtatttcggcttcaaagctttcgaagtccctttgcctcaagcagcggtaatactccggtcgccacccctcatcaagcgtgaccggcgcgcatcgcatcccgcggcgcaaaatcaagttcataaacagccgggcgatcgcccattgccgtcaaaaaatgggtggattcggacctaagaagcaaatactatagagcgtctaaaaaaataaataattaacggtattccgaaattttccgggattaggactgggaatccagtaaaaatcccgtccatttttgtagtccagacagggggcgtttaatgactaattttgaaggggaattatttttacgaaagaaaaaatgcat

SEQ ID NO: 27175 - DNA, 697 bp, Heterodera glycines
ttgtcagaatcaatataagcatcgtcgtctccatccgagtcgaaatcgaggaaagtgtcaattgagtcagtaccattttcagataaggaaagggtaagatcttcgaggccccggattatttggaccgtttcagggttatttttatgtcgttggatggttgaatttaattcatcaataagggcgtccattggaataggaggaggaagaaaatggccaaagaaatcggccggagagcagtaggaacgggggggggggaggggacccctcgcatacctaatttgcattttttttggtgtttctcacaattgtttcggtaccattcttccttttttaatagcattgaagactccgatttattttttaccaaaaaaattatttttattcttatttaattcaaaaattgttcgagttcgggtcaggcgttcggcattgggaaaactaaacgtcaaattcgcgattaccggccccaaaaaccgcaaaaataatctaaatacgactttacagggatgaggatttgaacccatagcccaaaaccccatttttaaccaactgagcaaatcgtttcccttcctttcgctcggccgagaatgtgccccaaggccaagaaaatccaatttttgaggggcctgaaactttttgaccaggcactatgcaacgcttaaattaaaatattcatcgtaaaaatacaccccgctct

SEQ ID NO: 27176 - DNA, 973 bp, Heterodera glycines
  misc_feature (855)..(855): n is a, c, g, or t
agcaattactgcgcgacacgctagtttatatatatatagagaaaaagggggactcgtcttaaaaaacaaaatctcccggccgaaggccgggagcgccctgaaagtagtggaagggtcttacaactttttgaggcgcatctgggaaaaatacgggtttttctctccggtggccaactgagtcccggcggctaatttctcacttttgcttgcgtttgatggcccgtaactttttttctaaaactctgatcaaaaaatgcccgctgcgagggcaccccgccaaagtgtcctctacatgctggtattttttatttttttaatagagccaccccctggcctgcagaaaatggcaactgaagcgtgctcaaaaagtacacttcagtaccaggcgaataccgcgtcggcgtttgatctgagggaaaggtgcccagcagacttattgtagagttttggaagctcgattttctgaaatttaaaaatttcgaaaattttcaaaatttttcgagctaggcctaaaaaacggtttttgggtttttgaattttaagaatttttaacgaattttcccagaaaaacgaagaccacttccaaaacatagtttttcgagctctatcgactggtatttttttcggaaaattttcgattttttcccggaaatagaaaatttttttggcctgagcgggacatttgagtcccgggcccataactcgtcaggagttggttttagccaaaaatggccttagggcaaaattgtagagcttttgaagctctatcgaacggtgtacttcatgttcggaaattttcaaaaattttcgagctaggccccctagaaattttcgaaaattttttttggggtgaanatgggggtgaaaaatatttttctggggtattttgaggtgctgagcacgaatatgatgtttgtttttcctttcatgattttggaattttttaaaaattctttattttttggcatttttt

SEQ ID NO: 27177 - DNA, 931 bp, Heterodera glycines
attttttgaatttttgaaatatatgtatatcaaaatgtagacaaatggtaaatttgggtgcaatagagatattaatgtctataataaggatgcccttgtattcaagtacaaatttaaaccctgcattgaaaagggaaccaattctgtcttttggcgcccatttttgtcgacttacctatttttaaaaaattagttcaaaaactccctaaatgagttcttgtaagtatttttggaaaatatttagctctttttagaagataattaaaaaaaaattcgcttacgaaccgcgcaatgaaatgatcaccgacccattgtttgggtcgtacacaatgacacgtgtgccaatggcggccaacagttgggtgccgtccggcttgaaggccaacgaataaatgcatgaactgcttgggaaaatttaaatattttttacacactttatcaaaattattttaatgcatttttgattttaattactaaaaaaatgggtaaaaaaatattaatttccatctgctaaaccattcgctaacccagcagcggcctcttcctgatcttcaaaagaatgcttatcgctcctgcaattttccgaacattgaaaaattgaatataaatttaaactaaccactccaatttggtgaacatttttttaattttttgaaaattcaaaagaggaaaaatatattttttggatttattttataatttttgttggtttgctacttttccatgttgtcatgacaacggtggaggccaaccaacataagtaaaattttaatgattaagtgaaaattatttatatttaatataaaatttggcaaaaaaatatatatacatatacatataagaaacaatacagtaatcaaaaggtggaacaataaaattcgtccttaaaaataaacaccgaagaaatgaacaatgaaaataacaaaaaata

SEQ ID NO: 27178 - DNA, 1071 bp, Heterodera glycines
cagtgttcgcagttgataaatggcaaaaacgcggtaagccaagaaaagaagtacagtgacaacgaaggataatagttgaatttcgagacttaatccccccccagtctcgagtcgatcattttattggttttgagattgagccgtgttttgttatgcttttcggtttcatcactccattccctaaatgccaaggtgttgcccctccgcttcgctcttcccacaacttggcactttccctcttcttccgctcccattacgcgccttttctgctcaacaaattcgtccaatcgctcgtcctttttctcttcggcttttacctggtcagccagcttctcttccgtctcttaattttcttcttcattgtgctcatttatcagttgatctccgcttatggctgcttgaacattgaaattggtttggaaccgttggatttgttaccggacaattcgaatggaaaaaaggctttactcgaggcggagcagtactttccgggtttgtcctcagctaaatttatgcaattgaaacttcaatgtaaatatatagaattttttattgaaaaaattgaaaattgatattcagaccacggcggccacctgcacgtgtggatgcacaatttgtctcgcgttaatttgggccatcgtcggctttggctcgttctggagaaggaaatcggttggtgatcaaaattggcagcaatgtttgaatttgagtgatctgatcaattcagaattgtacgagcacaccgaattcacaggggcagccgactcgtggcaagtgaatgtgcaggaaattcgcagatttagcccccttttaaaggcttcacgtgtttctgcaattttatcacgccaaaggacagttcaccagcaacgaaaattttgtgccaaggctaaagaattttctgaaaatgaaaatgcacagaaagtaccgaaggtggggtcagtaatttcaaagttaaaatggtaaatttatttcaattttgttatcttttcaacagtgatcagcataaaaggaagctgatcagtggcatgggtgggctgtgatactaagggaccacccatctgatgcttttgc

SEQ ID NO: 27179 - DNA, 985 bp, Heterodera glycines
tttttaagaaaaaataataaagttttttgactatatcgcataaggcaaaaatcgaaaaaccccgacccatttggtcaaccccgaccccgaccttgctgatcccgacaaccccgacttttccaaccccgacggtcggggttgaaaccctagtccaactctccaaattgtgtttctcatatatcccctaccaagttgaaagccactgaaatttttttaggtggcccactaatttaccaagatgtgagataaattgaaattgaattaacttattaaattttgcagttcatccattcgtttgactctaagccgcgtctccgcttatggacgctttgttaaattttaactaccaaaaaatgaccaatttcaagccatcttccttcatttttgagacattactttttaaccaaatgcctaacaaaggaggggtcggcaagtgaccgtgggatttccaaatgaaatttggtgggtggatagatgacgcccaggttctattgtgaaattttgactatttttgccaaatgagcatgagtgccgagatatgacgtgccaaacttttttaatgaacaaacaaattaaataattatttgcaaccattcgcattgtcaaatggtgtagaggtaatgcgttagtaacagtcgcaccaggttcgaatccgctatatgcaatttttttttttttaaatttttatttttgctttttatgaaaagtcaattctcaaaagattagttttataaaaagactttatttttaattttactttttattttggtacatatgataataaaaaatatttttaattttactttcattttgatatgtacataagataataaaatatttaaaaaaaacgacaggatatttattgcacctttatgtttaatgtagtaatttttgatttctaaggaaaaaaaataaaaataaaaatatgtttttaattaaaaatttttagatagattatttttgtatggaaattaaaaaaaaaaat

SEQ ID NO: 27180 - DNA, 747 bp, Heterodera glycines
aaggaaggaaggaaggaaggaaggaaggaaggaaggaaggaaggaaggaaggaaggaaggaaggaaggaaggaattgcatgcagataatattgtgatggaatagcatttttatttagtagaaataaatgcagtaataattataaacaaatttattcaaatccaataaaacttgtgacaagtatttaaacacaagtattaatgaatttgaataaaaagtttttttggagttttttcgctccagtccaatccgggaccaaaaaccaaagcacctgtaaaaggaaaagaatcaacggactaaaaaagtgagttgtttacaaaaaaatatttgttgtggctcatcaataattttgtagttaaaccaccacctgaaaattaattagagcatttaatgagaccagcgaaacttatttaacttacaataaaattgtttgtgctctttccgtcatccaatcatttggtggcaaaataataatgcctaaagattgtttggaacctttaatgagatcagaaaaactttgttcttacgaacaaaaattcagtgcggcggctttcatctaatgtatggcaagaaattacgcctgaaatcaagaatgaaagattgcatgagaacgtaaggcttcagttgcttactaaatttgtgatggaacaacgcacaatctcacgagctcagaatatttcagggcattcctggaaagaaataaattaagcttgtgtgattatttaattgttttaataaataaatttat

SEQ ID NO: 27181 - DNA, 934 bp, Heterodera glycines
cagtccatcgacattcaaaaaggacaaagagacgagcggagattccaaaatcgcattgccacccccaaaattggccataatcgttgaggccaccgaaacattggacatcaccatcaccaaatcattcctccaacagcttacccaactctctgaagtatgttctttgtgtttttttatttctttttttctgtttaggcctttgaaaatgcatccaaacatatcagtactccgcggcgtgagttgcccggcacttcctcccatttgttgcgcaatgacactgggcttggcgtcaatgtgagcagcaccgaatcggtgaaggtaaattatggccaacaaaaccaggaataaaaatgcctaaaatagcgcttttgatgaattttattaattctaagtataattccatatttcagatcattgcctcctccccctccgatggtcgccaatttgagtgttgcgccggccaatacgtcccgatggaatgcgtcgcttcgtcggcggaatcgattcgcgagatcaactggcgcatgaaggaggaccagcgccaaattcagctccaattggcattttccgacccggacacggaacgaacagtgaacatcgctcggacggagaaacagtgcgtccatttgccaagagaggcggattcgggtacgaatttgtacaaaattggaatattcattccgctcaaatcattaatttttatttcattacaggtaaaaaatggacatttgtcgtggaaaccgtgaaggaagatgctcgtcatgttgttacgctgaagtcattggttacggttggtaaacaatcaaaatacaaaacaaatcatttgtgaaccattgtaaaatctgtcaaatgcttttaattctctaaaggtgctgaaccatttggaaatgccaatcgaagtccaagcattgcacgactcgaacagtttgccctg

SEQ ID NO: 27182 - DNA, 1781 bp, Heterodera glycines
taaatgcgcgatccgcgacaatttgaatgcgcggtgcgcggccgcggttgttttttttttttttgcgcgccccacccctggctgccagaagagaaaaaacttgcaacattttatcaaaaaattaaaaaaatgccaatccttgaaattattacaggtgatacccttggccgtccacagcaaaggacaatatacagtacaccttggcttgaactcgaccttgacatgttcgaccgaattggtgagtaggtgattgcctcagtcagagccagggggttggctggcgatttacaataatttacaaaagctggggatttcaaagtattgtttattttaaattttacaattcaaaaaaataaaaatatgcttacaacggaacaaccagaatgtaactgctcaaatcactttaaagccacttttatcgtgtagagaatagacaatttttagtgcaaattttcgttgtttttttttgttacggctccaaaagtgatcagaaaaaatgacaaaagtttcgaaaaaacgtaaattaaatatctgcggagcggatccgagctttacagcataagttttaaagtgatttgggcagtaacagttcaggtggtttcattgttagcagatttgttgcaaattaaaaattcctctgcgggtccgtagtctatcgcccgccacatttatttttgaattaaatcgcctcaaatttggattttttaccaaactttgcaccaataaatagcattaattggccatcatttaattgaaattagcttatctgttaacttaatttatagaacaaccagcaaaaatctccatctcccaaacatttgtgtattttgttctgtttttatcgatttcgatatatatttttggttttttaggccaattgctggtcggggcaaaaaatgcgcgactgatcactccggaaaaaatcagccaaattcccggggcacagtcccttttgaacaaaatttgtgttggcacttaccgatcggaggactttttgcgcgccaacggattcaattattacaatatcattgaccaatggcgcatcaaattgtgctcgggtggacgatttgaggtgggttcaaatcatttcgttttttttccatttatttttgataattcaaaaatgattttaaattacaccgtacccattaagcaaaatctttggtccatttccgtcccatttttgaatgttataaaaaaattcggcatgcttaaataaaggatgttaacgcagaaaaaatgccatcgccaaaacacaagaattcaacacactaattcaaaaaaacaccgcaaaaaatttaaataagtaaacaaaaattcggcacgatctctaaaagcctttaaatgccgagttttctagacaaaatggcatcatataaacagacaaaatttacatatctctcaattccatagaaaaggataaaagagatttactcccaacatgtggaagttgagccgcattttaaaggctaaaaaactttctttccaattcgaccggtaaaattttgagctaccgtttccctcccctcctccgctgtttacagtattcagcatcgcctcggataacaccttggacaacaccatggattacgcctcacacaactccctggacaacgcccaacaccaccaattcacccacgccaatcacaaacacacccataacattttcaccaattacaaacacaccaatttcaagttcaccgattacaaattcgccgtcatcaccccgacgaaacacaaacagcagcagcatcagtttgtcgccccaaaattcgcctcaa

SEQ ID NO: 27183 - DNA, 1906 bp, Heterodera glycines
ggtttcattcgcgtacagaaatgtttttagggcacaaaaataattcagaaatcggaatttgtaattttttgaagaaaaagttattttttgaaaaaaaaaatcatttttttaatctaaaatgccaaggtctgtgccaaaaactgtcaagcccctaaattatgcttttgtgagaaaaagtccaaaatatgttttttatgccttaaaaactcgctcttatgaaaaaacagataaaaaaagctattttgatcaattgtatccattgtaaattattcacagaaaaatcgtgaattgaccccgttaattgcagggcttcgatctcaaaattttgaaaatcctcatttctgccacaaaaaatcttcatttgccactaaaatacctcaaaaaatcctcatttggcatgaaaaatcctcatttttaaaagcataaaaaaatgcaaacaaaatcaattaagagtcatatttttcgttttaaacaatcacggcgcctacatatcagcgccaccggacccaaaaattcgatttctattgttttataaattgacaatctcttattttttttacttttaaattgctttttttgtggcgcggttttccaaaaaactttttggaaactttgggaggagggggtccgaaaataatttggattttgagtgcgatttcaatgaaaatcatcattatttttggcccgcttaattactccattaaattcttttttgtaagaatgaagaaattttcgtttcgatgacatttattttttattaaaaattatctaaaggaaattagttaaatttattgcaaaatgaggatttttcgaaaaaatgtttatgatttgaagaaaaagttcgaacattttgccaaatatacctaatttttcaaaaaatcattcgtttttgtcacttttttatcaaaagaccacaaaaatgcgcaaatcctcattttccaaaaaaatcctctttgaccctctaaaagaccacaaaatgagtaaaaatcctcagatatcgaagctctggcatatccgtaatccataaaaagcatttattttttatatttttcaaaatttctttgatgccgaataaacgtcgtcagaaaatttagaattaattcgaaaagaaaaaaagccaggaaatttggaataagtttgattcttattgctaaggaaacagtagaaattcgttttttttaatcttgcaagaaacccagccctggtcctgacacaacccaatttcaaacagttttcgattactgtttttagcgattttccataattttagtcgtgtcgtatcattaattttgattctttttcgaaacgatttcttgaagggttctggataaaaatttgtcgtgactttttggttattataccaaattttatgaaaattttcaaacaaaaaatgcggtgaaaagataagcgaaaatgccaaaaaagaagatatctaaagacaaataagggtcgttaatttcgttcatttctcatgaaataaatccattgaaaaataaataaaaacctaagaatccgattctaataaagagtataatgtgcctttgatttattttttattcccgcaaatattcgtttacttccacttttgcataaattaattgagggataatagcaccaatgcttgcaagaaatcgtttcaaaaaataaaccaaaatttatttaaatgctctcttttaaatcttttaatcctgaaaaatatataattttcttgactttgtctcatatttttgacctgggttaaagcttttcggataaacatattttcatgatttttttttctttaggctttttcaacacttttatcattttcgttttgcgattttggtaaatccttattaaaaaaagaaaaagacacccctaaatatcaccttcccaattatcaaaatacttcacaaaactagctttt

SEQ ID NO: 27184 - DNA, 991 bp, Heterodera glycines
ctttctttctcctttttttgcttttgcattgtgccaatccctttataagtgaagcatttgaatgctttgcctttgaaaagggcagtgactgcggcatttgttcttttctgctgccgtcgagaagcatttccctggtgtgggcgataagtcgggagcggagaagggtttgtttccagcacagatcggacgactgaggctgttatttggcactgattgtcctctgactctctttctctcggctcatttgtctcccctctctttccttccctccccgtcattctttctcccactcttttcatttcctctcttcctttatttctctctcactctcttccttttctcttaacttctttccttttttcccttccatccccgtctttctctctctctctctttctctctctttctctctcttccttttaccttaacttttccctcaattttttctcttccctccctatctttctttctctctcttttagatccttctcttcctttatttctctctcactctcttccttttccctttaattttccctccctttttctcttcactttctcacctcagtcactttgccctccaacatttttcgaccatctctcagatagcacagcatttttcgagcggattttgagttgttccgctgctgttcaaagcgttcacaaattgacgaggacggcgcattgtcccaaacgaaatgcggacgagcggagaaaacgtcgacgccgaacagaggcgaaccgggcggaatattgcaaaggccgatcatttgaaattgataatttgttgatggacaattaaaagaatttaacgctaatgaatgccttttgcgaattgtgtgttttaaatgcttttcatgtgcgtgagattagtaacagtgacataagtcgagcaatgaatgctgctctcatttgagtggcaccagcagcacaggtgctttttgtctccttttttgtttttgtacgcctcccctcccccctcttcccctcc

SEQ ID NO: 27185 - DNA, 1830 bp, Heterodera glycines
  misc_feature (159)..(159): n is a, c, g, or t
catccaaaatcctggtcaccccctatggtccggatcccaaaatcactttatttttgtaccattcgtaagaaagtgataaaatgccaaataaaatttatataatagcgcaaaaaattgcggatttttgtagtattttattttccagaatgcttttcaganccgaggtataaatttttttttgaaaatttgaaaatttccagaatttctggaattacttttttttaaatcatgatagaaaatccaattaaatcccataaaattctccttatttttctctatttttattgctttattgtattaaaatcgtccaacatagaagtgagttacgaattttcaaattttaacccaaatttccaagggccaaaaaatttcctaaaaataaagaatttttaaaaaatttaaaaaattatgaaacttaatacaaacatcataatcgtgatcagcaccataatttacccaagaaaaataattttcactccccttttcgaccttaaaaaattttttgaaaatttctagggggcctagctcgaaaatttctgaaaatttccgaacatacagcacaccgttcgatagagtttcaaaagctctacaattttgttctaaggcattttttggctaaaaccgaaccttaaagagttacgggcccgggactcaaatgtcccgcttaggccaaaaaatttttctatttccgggaaaaaatcgaaatttttctaaaaatcccaccaatcgatagggctcgaaaaacgatgttttgaatgtgttctccgtttccctcggaaaaatctgtaaaaaatcataaaattcaaaaaccaaaaaaccgaattttaggcctaactcgaaaatttctgaaaattttctaaattttaaaatttcaaaaaatcgagctttttgaactctacaataagtctgctggcaaccctccgctcagatcaaacgctgatgcagtattggcctggtactgaagtgtacatttctgacctcaaaaagttgtagaaacgtacagaccagggggttagaggtaggggttaggggttgctggcaataatgtcaggcatagtccaacttagtttcctacctgcaagcgtttttcgatctgagctaaaggaaaaattttcgtaacactgagactgccagcaaagtcagttttagcgccggtgggactcagttggacttcggaccaaaaaacctatagttttcccggatgcgccgtctcgagctaccccttggtgcagggtgtcaatgcggtgtacttagtgggtataagaatttattcaagcattcagcatagggctattaaatgtagggattaggttctattgggaacgtttgcggggatagttagaggttagtgcatcacagcaagattgaagtgatgccggtgctaagaaaaaatattgtagaagaaaacactgcaagggataacgcgtaataagtcatagggtttcagtagttcactctaaatattattctatggtagcattggatagtcctcatagagttgtatcagcaatacgatctcttctcaggatttcttacttaagatagaaagagttattgtctcataaattgcaaaaaatcttaagtcagcattttttgttctgatattgggtgagcgtcaatgagattttttaaaagtgtaaatataaatagagaattggtagggctattgaatatataaattacttttggttcagtttcatttgaaagactgtaaaattttaaatgtttattattatatatccgttattcgtagcaaatacacatagcgcatgttcaaagtgcgtttataaattgtttgatagaggagttacaaagattggaagaggatct

SEQ ID NO: 27186 - DNA, 992 bp, Heterodera glycines
  misc_feature (855)..(855): n is a, c, g, or t
ttgttctcctttccaatgttaatgagtggtccttgccatggtcatgctgttctcctgaatcggcgaaatgtacccgcccttctccacaagtttgaccacctccattatgttcttcgtttccacaatgttttccccaatcgccgctctcagtgacatttcgtacgaactgttggccatgagaatttcttcgaaatacctacaacggtcagtcagccaattcattgtttatcaattacctttttactcttgctaattttcctcatttttccctttgtcattcactaattgcggtttcaacccaaaaacacaccacacaaaacgtcaccaccccaaaagtttaccaatccaaaacgaacgtcaccaattccaaatgtaacaaacagcccagcagaacgtcgtttggtgggatgagttttaaaatatattttttttaatattcgtgaagacatgtttcctatggttttcggggtcaatgaacacgaatcggcaccccgcttttttgcgaattctgtccatatttctggctaattaattttaatcttaaaaatggtatttcttacaattagttagatttattgtttttttaattttgtgacgtttttgattgatgaaattttgagtttgtggcattttggctggggaatggtgacgtttgagttggtggcattttggctggtgaccttttggaatggtgacgtttgagttggtggcattttggctggtgaccttttgggtaggacccgccgattttctcgtccattgattaccaactgtgcttgtaattcgtcacgaattggtactgtttacgtgccaccaatttgatcatttcaccggcatttgtgaagggattattgngcgccggctgaagaagtgaggagagaagcagagtttggtacatatccatcagaagacggcactgcataattgtgaaacacagcagagagaaattgcctaattggggaaaaagcgatcagataaagtaaaaatgatca

SEQ ID NO: 27187 - DNA, 1180 bp, Heterodera glycines
  misc_feature (1150)..(1150): n is a, c, g, or t
aaaagataaattgggaaatgataacacgctcgccacctcttactcgccaaagagcgcttaacctgcgtatgttcggaaatgtcgaaaatcggccggtcgctgctgcaacgcaaaaaaatcaagaagaaaacagagacaatacgaattctgctaataacctgatctccccaaacataactcataatttggaggaacataaccaaaataaaagtcattttagtgaagacgaaattatgggcgacgacgaaattcgaaacgcattactgcgtgtgtcgatcgagccaagtcatgcacgccaacaaaatgtgctcggtaccgaacagcagcaaaaaggcaatgtcgcatgtattgcggaatttcgaaatattgggatagtcatcaacagaaataacgagagagggcgtgaccccggcaatttgggacccaaaatgtcgcagtgaaccgacaagttgcgcaatttgattcgatggtggttttagcacaaaatattcctcataataacctccgcacgtcgacaccattacctgataatggtcttcctacaatatccagcgttcttcagtcggtgtttttgaccaatacaatatgggtaaccgacagttacaccaaaatcaccacttaagtcaccaccctttggctccatttgtaccaattgaacagaataacgcacgcattagaaacgtagaagaaagagtgcaaaatcggcacgcgattccaattcaacagttacgtcaacagattccagtaaacgcagaatcttactggaaaagagggaatggataaagttcgaaaatttttaaaaagtttgatgtatacaccgaaggatggcccgaaaaaacccgtatttcggcacttcaaagcaaagtatatgaaaaagctgagagagccttagaagctgctttgtcaacacaaccatttcgttatgaatgcattagaagagaaatgcttcaacaaatggaagaaacagattcgagaaatctgaatgcgttcgacgaattgatgatgggagtatgcagaaagcccaacgaagggatcgatgacttagccaacagaatttcaacattagtcagaagtgcatacccgggattgaccagtaatttgtctgatgaatacttaattaaatttctcattcgtgcaatggataatcccngagctagccttgaattggagctggttagaa

SEQ ID NO: 27188 - DNA, 1480 bp, Heterodera glycines
ggagggtaattagagaccaacagagcaattaatggagggaatttcaaattgtattttagtcccgcttatcattcggcacttgccgacggcgtcaaaggctacccgggcataaaggcgcggatgaatccccgcacttttcaatacctttcggacattgccctcggagttctcagttagttaactaaaaattgtcaaaaataattttatatttgcaatttcagactaccaaataaagcgagctcgtctccccaacataaatcagtgccttccgcaggtaaaaaagataattttaatttaatcaatggcaattccaactttggcttaatgttcaatatttccaatgcttcatctccccctcccttcagttgaacggttgtgtccaggtgtacaatttgtatgtgtcccgctaccgatgcccccaaagtgagcatttcgccacgattgttttggtcaatgcctttctttcctcccccatccctttgtaaggggtcaccgtttacccggctcccccgaatctcattgtgttggatgtgcaaaatttggacattgggtgagttggggttcctctggcactattttcctcgactgagttcatccgtgcctcgcccccccccccttaagagtcacgggaaatctcggcgggcaaattgtcattttgttgccgttggcattgtttggcattatccaagtgaacgcgtatcaggtgaatggtttagctaatgcttcatttaacagtccgtttttaatgtgttaactaacagctgaatattcgcgtcggcatttacctcgtccgtggtcccaccggatgtccgcagattcgcgtggccagctgtcagtttgggagctattttatcattttaaaaatattttaacaaaattttccatttgggtaaggtgccgccagtgttggttatgtcgatgtttacattcaaaacggcggtcttttgggtgacattgccaacagtcaatttcgagtgaatttgtttcttttttttttgctcattttacccatttaaatttcaaagggtaaaatcagcgaaatggtccgccaacaaattccgggacaggtgccatttgccattattattgccaattaattagtgataacatgataatttttgcagatttgccaacgtttaccgtccatgttggatgaacaggcgaaccccaaactttgctcaaagatccctcagtttatccctgtccggaaaatgctcgaagtggcgatcagtgccaccgggttgggcaatatgttgggtgggacggcacaggtccgaccgatcggcgtttgaaaccctgaaaatgtttttttgcctttagtgtcctgcttcttgcaatttcgtcaaaagaaaagtggtcgcccaggcggcgccaaaagtgaacgcaactttggcattgcctccggcattaaatggcaaaaacgaaaagacaaagttggacagcatagcacagacaacgccagtgaatactaccagtgctc

SEQ ID NO: 27189 - DNA, 992 bp, Heterodera glycines
gtccaaaaaccccgcaatttccgtaatttccgtaatccgcaatccgcaattaaaaaaaaaattttttttaataattttacattttattttaaaaaatcctataaatcttttaaagcaatttaaaagcatattaaaaagcaaatttataaaagcaaaatcattcaattgaaaatccggttagaagcaagttatggtgaatttaagtttgacatttttaaattgctaaagaaataagaatttaaacaaatgtaaaaatttttttgttttcaaaagtcatgaaaacatgcttccaatgcttttcagggtcgctgctcacgaaccaggcatccatttcgaccaattcggaacccggagccgaaattcgaacaaaaaatcgaaaataaaaaatttcaaaattctctttttgtttctaaaatagattaaaacaaccaaaacgttttggcgccgacgttttgacgccatgtaggggggtagaaatgatgaaatcgttataatttttctgacgaagtctatcaaagagccggatttaattcttcatttactctttttcgctttgctcacaattaccacataaacccaaattttcatattattttagaatttctccgtggaatttcgcgcaattatcatatgaacccataaattgtttccatttcttcattttgttaaatttattatatttaacgaaaaatttcattttttataatttttacaatttcttcctgccttttttttcatttttggcttggcgccaaaacgtcggcgccaaaacgacccctggcgccaaaacggcggtgccaaaacgacctggtcccaaaaaattcattttataagaaataatcttacaagaaatcgtctcgaaaaataatccaatagtcaaattacggatcaaaattgcggataaatcccaaaaatccgcaacccgcaatccgcaattacgggggtccgaaaagcccgcaatttccgcaatccgcaattgcgtccagccctgg

SEQ ID NO: 27190 - DNA, 715 bp, Heterodera glycines
accatttcggggggcggggggtcgtcagcgaaagggcaaaagaggaaaaattattgaaattttgaagagattttcttaacaaaaatttttcatgtcggcgcctattggcgcagccgtcccataaaatgccccttacgatttgaaaagttgacctaaaatttgccatgcaaaaattggcctttttggtgaaaaggcaccgccgaactcccccgcgacaatacccggacggataccgcgtcattaaattcgggatcccgacctcgggacccgttcatttttccaaaaacccggattgggaaaaactctttgttcggcttcgaaacttcagttttttaggattcgaacttcgcctttgagcaattattaggcttcgctcggcttcgagtgttaagccgagctccgcccagcctagtaacagatccctcacacttataaaattgccacaacaatttaagatgaatgccatcaatctctgctgttttggctacgatatcgagtggaagtattaaaatggtcaaagccgagtgtttttaccaccctggcatcaatcgttgagacatttgcggtccggacatttgcggcctgctgaaaatcggacatttgcggcacgataaatgcggttggacatttgcgcatcggacatttacggtccatttctcaagggccattttcggacatttgcggcccgacattgcgccttgctggaaatcggact

SEQ ID NO: 27191 - DNA, 895 bp, Heterodera glycines
aaaatttatctcaaaaagaggagccacttttctcccctaatcttgaaatttaaaaattctcggaacaataaaatggccattgctctccgcccctctgctcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgataaaaatttctctcaaaaaagaggagccacttttctggcctaatcttgaaatttaaaaattctcggaacaataaaatggccattgctctccgcccctctgctcatgctgcagagcatttgttcgatgcaaaatttctctcaaaaaagaggagccacttttctggcctaatcgtgaaatttaaaaattctcggaacaataaaatggccattgctctccgcccctctactcatgctgcagagcatttgttcgataaaaatttctctcaaaaaagaggagccacttttctggcctaatcttgaaatttaaaaattctcggaacaataaaatggccattgctctccgcccctctactcatgctgcagagcatttgttcgataaaaatttctctcaaaaaagaggagccacttttctggcctaatcttgaaatttaaaaattctcggaacaataaaatggccattgctctccgcccctctgctcatgctgcagaatatttgttccatgaaaaatttctctcaaaaa

SEQ ID NO: 27192 - DNA, 1254 bp, Heterodera glycines
aaaaataaataaaaccaataaaacaaaaattaaattacctgtaatgtaaataaaatctaaattttaattgtttgaatattaaaatattatattttgcgctataattttataatgcttccttttagattgttttttttcaaaaatatttataaattttataatattgcacagagtcttggcttcggatcattattaaaaggtcatggagtaaaaattatacataaatttttaagataatgaatcaaatcaaattttttttttttctagcggcgcttttggcaccgacaaactcttttttttaaagcttggaggagctcggggttttgttaggaagcaaaatcgcacaaggttatcatgagatgaataattaattaattacaccgtaacaatccataaacaaaaaacaatttaatataagaaataataaatacaattatttaattaatcaaaaattgaaaaagcacaaaacaccgctgattttaattaaagttattaattagcgcatatttaataaattgaaaaaacaataataacaaaataaacatagaaatactaatctaaaaatttaaaaaaaaaacatttttatgcgataaggaaagtgatttaaatttttatatttactgtaaaaattaatattaaatataatttaatttaacaaagaaaaaataaacagaaaaatagaaaattactcaatacttattcaatgaaataaaccacatagataaagccttcaaatgaaatttgacacatattttgtcaattaaataataatattaataataatagaaggatttcaaaattattaataaaaaataaaaggctagaatgattattatagaaaaatataattaattttttcaaaattgaaaacgtaaatgaaaattattagaactattattaatttcaaaacatagtttgattgaaaggaataaaaatgaatttaaataatattcaaaagagcaattaatataaaatatataaatgctaattaataaattatttgattattatttatctctttttcaaaaatttaatttaatattcatcactccaaacagtgagtggagtcagtgaccgtgttgggtggaaggacaaaaagtgcaaatttggcgaaggacaaaaagtgcaaaatttgcgaagtttttgactaaatccactcataacttttctcaggcaaccaaattgcacaatcttggtatcttacgatagccctaagagttctctattagcctgccaaatttcaaaaaattttat

SEQ ID NO: 27193 - DNA, 980 bp, Heterodera glycines
ttcaagatgtcgcagtcgaactgcaaattctcattctttctaaaatttaagataaagaatttggtatttttctcactttatacctgaacgaattctcattaaaactagtcagttgaaccgttgttgccaccgagcctcccttttgatgttccttgccagatgctgtggaaaattctttgcaaatgaattcgatggattgtccgctggggtcgatgatcaacgggaaacggttgaactgcctgagcataatggcattctccgtgcataattcgtccttcggcattccattattgttccattgtaagcgctcgtccgcagttgacagatactcaatgcgagcaagctcatgacggaacataatttgtgaagaatcacatattcccatccatttttgaaaattgtgtcgcgcagcagttgatcatagtagccagagtaagaaagaaaggcggcagaaagaagaacatcgcccaccaatgtctcattttgctgagcaaatcgttctctgccggcctcccaacgatcgcattccacccgcaaagatttcaacagatggatgctcctgttgactttttcctgcacaacttgcaggtcctgtttgatgtgttccgcttctccgatgagttgtgcgtattcatcctgcaattaagaaaatattttgtacctgtaattcagttggcagttaccttcagttcctgaattcggttctcgagcgcttctattttgtgcttcaattcttcgcctttcactgttttttcttccgcatctttctccagacgcttcaattcattgttcaacggttcgattttgttcagcatttttgcgtaggaaagttgagcccttgcccatttaaccattggtccacaagcgacagatgcccgattgaccttgaattgttggatttcttattttattaatatttgtaataacggaccttctcaattcccagtcagggttgccttcatctgcttatttttctccgt

SEQ ID NO: 27194 - DNA, 1353 bp, Heterodera glycines
  misc_feature (53)..(53): n is a, c, g, or t
  misc_feature (1251)..(1252): n is a, c, g, or t
gacagatagatgatgattgcttaaagcatatgattatttaaaataaataatangataaaattaaaaaaagcatttttaaggtctctgatgtggatgattggaattcgttctgtacggcatgacaaactccttttactatacaaccgaagaattgttcatcaatttttggtgattttttttttaatataatttttgtgacatttcaataattgaaaatatatatttttttattaaatattaaagtttaacaaatttaggtggacacctgagcgtggccaattgtcttggtcaccagacccgcgtaccacggagacaccactccatgatttacgtggacgcatttggaccgatcgtaaattggaattggagccagaaaaatggtcaaatattttcgcaaattggcaattaaattgaattttttgaatattttttaatttaaatttaaaatcttcttaatcctttaaatcatcataatcttccagggaaattgtcaacattttaaaatttctgtcatttaaaccccttattttttggacttatttataaatttgcatgtccatgcttaaatttcaaattttcataagttacatattccagggaatattcaaattttgaaagtttctttcatttaaatcttaattttttattatttttttttatttaataattttttcaagtccatgttttaatttaatttctttaattacttttctaatttacaaaaaatacatcttaatttttttttgtctttttaggtaccctttcccctattactaccgtccctttcggccctaccgtatcacccgcgatttgaccataatgcccggtgccacactgaccattgagaagaatgtggaagtgcatgtgtggccaaatgtgcgcattttggtgtacggaaatttaattgccgatggcacactttggcaggtgccgtggagtggaaatgaataaaattaaatgaaaaatatttttaaattaaattaaaagagaaatatatatagatttaaaaaaaaaattaatttatttaaaataaaaattggtgattttcattttttaatttaatttttcataaaaaaaattgaaaacctaatcaaaattattggtaaatttaaatatgtaaaagaaatttttacaatttaaaaataacacgaataatttcacaaatttttctaaatttacgaggaattttttttcagacaatgaaaaatgaaaattacctaaatagtgtgttagaaaaaataataaaaaatnnatttttcatatataaacattattagatattcagcttccaaaaaaatctaaaaaatcatttttatatattttttttttctgaaaaataacccaatttttttg

SEQ ID NO: 27195 - DNA, 1476 bp, Heterodera glycines
  misc_feature (184)..(184): n is a, c, g, or t
  misc_feature (207)..(207): n is a, c, g, or t
aaataaaataaacaaacattaagtctcaaatgagttttccctcactagtgaagattaattttaataaataaaatttattaaatggattatatattagtcagaatattatattaaaatttttaaaatgtgaaagaatttttcgaaaattgctttttttatgcacaatgcttcaccttttctcacngatacaatttgcggatgcaagcncagcaaatgagacagacaaaaatagtagtaaattaatataaaatgtgaaaaaaataaattaaaactaattaattatgaaatttaaaaatgaaatttccattgcctgaagaacaatccatcgctgttgtggacctcaacttggaaactttaattgatgatgccatccactgggctcatatcaatggaatggtcacaagaacgaaggaaaaccgactcaagtataattaaataatctaatataaaatgaaacaatttagtttttctcgaatttttattgttcgagtcggtacttttcggtttcggggcctagaatttgatttaaaaaagcaacggtacttttcggttttgttcctacacctcaaaatttaaaattaaatattaaaaatttcataaaatttttttattaagattaaatgtattaattaataaatttggtactttgcagttttgttcttacatctgaaaattttaaaaagccaaaaagggcgtgtggaaagccatttttagctcacgccgctattttggaggcattgacaaaaaatttcaccaaaatattaagccatttaatgatgctgcatcaatttaattttgcttttttggaatgaggatataaaattgagtgccgttttcagtccaaaaataggataaatagaaaaatgaaaccgattttatgcgtgtcttttgttgctgttgttgttttatgcattttgaggtgtaggaacaaaaccgaaaagtaccaaaaacaacaaaagacgggcagaattgcaaaaatattaaattaacgaaagggcatttgcttcccacttcactattctaattgaaaataaactctgtaatttggcattttgatttcatttttttctttttgctttagtcctgacattgccgcttttaagccattttcactgttcctaacgccttttccacgcgtaatttttgaacaagcgcagccagttcatacggtaggaactgaaattagcaagtattttaaaggtggagatttctataattacttttctatgtatcattttgccggggatgcaaaattgaaacattaattagaaaagtaaaagacaataaactcactaattacaaaattggctacccactttttctcaatttaaaatttttctaatgtttgaatattttccacgttttctttccaatttaattttattttatttatttttcaaaatttatattaatttttttaagtaaatttttgggttatattgaaaacaaaaatatttttgtcccaattttgttgtt

SEQ ID NO: 27196 - DNA, 1023 bp, Heterodera glycines
cttttcctgctccaccacctcctcctgcgcaatttgaacatggagaggcaactcgagttgaaaaaatgagggcacagctacgcgaacttgctgagaaaatgacggacaaagatcctaaggtgggaattcggcttcaataattgtctttttattatgccatttagcgtctgtcaccgagtggacccgacccacatcatcattagggccatggatggatctaacggaggaagaaagaatggatgcttagttttcagcttttattctatcctcttttatttattagtttttcaaaacaaatttcttccacaactttttaaactatttgttgttttgaatctttttagataaatctaaacccctaaataaattataattttattataaaataatgagggaaaaatattaaattttgcaattaattctaatgcaatgatttatgaaaatattttttatttatcttatggtattcgagagtctcagtgtcatctctcggtcttgagattcgcgaatttccgataccgaaaagcacttaataaattgaaacttaatgagcacttaataaattgaaacttcatgagaaatttcataaaacaattatgggtactgaagattgaaactccatttttggaaaaagttttaaagaaacaattttcatttgcttctcattcaatacaaaaagtaacttacctaacaaccaccaaagaaaacaacttgtttttcgtgcgttttaggtcactgggaaatcaggaaaaatgagctaaaacctaaaagccggagcaaatgaaaaaatgtatgagtgatcagtaagacatccaaaaatatggaaatccattttttcctgtaccatatttccatatttgtccatacctattttggttttaagtccgtgttttatgtccatattttggcatgtctccaaaaaaccctattagaacggcccccatcacctaaattgtccgttttgacatcaacgaccggaaaattttccaaaaaatggaaaattttgtttttggtcggttttct

SEQ ID NO: 27197 - DNA, 1363 bp, Heterodera glycines
  misc_feature (1317)..(1317): n is a, c, g, or t
gcaatgatgccaccatcgacctcagcggcaacgacggccagcctaaacggcgccgatattgtgaatggggccaccgggtttggcatcggcacagcgttcggcacatcggcatttatgccatcggcagcagagctgacattggcacaacacctaagcggcgtggcaacgggagacgctgggcttggcactcagtttggtgagcattaaaattgccttcggagacctttggctgggttaaaatgccggaaatggttctttatacggtaggagtgagtgcacattactgtaaaatcctgtaatggccaagtttgcttaagaatgtttctaatttcaatcgctttttgtcaggttacgtcgcccccgcgccctttcattacgccgcgttaggctgccccgcggcgccgtccgcgctcggcatggacccgtccgcttttgcgcactttccgcccgcttattttcccggcaccgccccgtccgaccattcgctgggcaccaaattggacccgtccatggcctacgccccttacgacggttatgcggcggctgccgcgttcgccggcggtggcggcgcgtattcgcacttttacggaggccaattcaccagccaatgacaacaaaacgaagcggaaaaaacgacgacaaagagggaaaaatgagcgaaaagggaaaagcgacgaacgattcgacggagagaccaccgaacttcggcggactgatcaacttctgctcctgcacctctgttggccaaactgtgttcactcactctttcccctccccacctcacaattttactttttgtgccgcccgcgggtctccggcaatccctcccaatggcaggccaaaatgtctccccctgttgatcagagtaggtaggaatttcgagcccaaaaatgtttcgaatttccataatttttccagggtcgaaatcgcttttcataatttcactgttctcccagcaaattaatgtccacaaatgccgatgagtttcgttttggcctgccttccctccctttcccctccccatttgtccattttcatcccttcttcttcttctatctcacaaaccacagaattctgctcctaatgctaacgtgattttttgattgtttttctttttttcattttccttttgtccgatcaaaacatttaaatcacaaaaatataatctaattgagaatagaaacaagcaaataaagaacatttctgtgaagtaaatgcgtaaagactgctaattcttatacacaacatgctaatttaattaattggtcggattattaattattaatggcttaattcgagtgatcgtttgttggccanagtgattggtccgtctgtctgatcagtccttctgatcactcctcta

SEQ ID NO: 27198 - DNA, 921 bp, Heterodera glycines
tgaaaaatttcttgtatgttttcttataaacagtttaaatttttctaactttctgacacaggcgccggcacggccctagtcctagtaatagtatatttgttcatcagtttggatgcaatttttgaataaaatttgttaaaagtaaaatattttaagaaagggataaatttttatctttttttagcgaggccaacataatgaaacagtgttcacacaacaaccttgtccgcttgtttgccgtttgcactaacgaggaaccgttcctgatcatcacggagttcatgccgaacggaagtctgcaaagttatttgcgcgcacaagagacggacgagaagggcgtgaacattggtcgacccaaaaatttgctcagcatgcaagcgatgatcgacatttgtgcgcaggttattccgacaagaaaaattaaaaaatatcttcggtcgtttcataaaaaccaaaaaaaaactcttgttcagtttgtgcgtacaatagacttatttttagttggccaaagcctacatttttgtcataaatggaaagcttaaagtctcagaaatttataaatgcaagaacatagcaaataatggtattaagaaaaaattacattgaccaaatcaaaccatggaacttgaatttttcttttaagcttttttttattaaattttattttgttaggcatttcaagtttgttaagctgaccaactcaattcatttcaacaactctaccatagattatttttttatgacgattgggaaaggattaattgttcattaaaattggatgaccaaaccctttgattgatacaatacattaatttttcaaaagattttttttcaggttgctaacggaatgaaatacttggaggagcgtaaattggttcatcgcgatttggccgctcgtaatgttttggtgggcgacaaaat

SEQ ID NO: 27199 - DNA, 990 bp, Heterodera glycines
aatttgattcaattcgaccactgcgaccaattgacacggacaaccattgcgccggacaatcgggaaacattggacaaattgacgccgacaattggacaaagacaaatcgcgcaaatcggacattggacgcgcagaccaaattgcaaattggacgcattggcaaatcggaaattggacgcacagaccaaattgcaaattggacgcattggcaaattggaaattggacgcgcagaccaaattacaaattggacgcactgacaattgagaattggacgaactgacaattgcgaattggacgcattggcaaattggaaattggacgcacagaccaaattgcaaattggacgcattggcaaattggaaattggacgcgcagaccaaattacaaattggacgcactgacaattgggaattggacgaactgacaattgcgaattggacgcactgacaattgggaattggacgagcggaacaaatcgcgaaacttttattccatcacccgacggaaggtgctacaaaaatatcccagtcaatgtatcgattggggaattaacatgggcattaggattcttagatccattgcataaggtaatcgaagaagcttcagagttcgtctcatgcgaacaaaatcagttcctgacaattgaattggaaggagaagtacgagaagtaaaccaattaacaggaacatgggagataattaagaatatagagcatttagagatctctgataattttggaaaaatcaagaggcctgaatttccaattcaaacgttccaacaattaattttgggtaatgtgagtaatgcccaaatagaaatcttacaaaccattcggtctctcaggaccagcagattaatggagagcgtagtccaaaatcccaaaaaccgttacatggaaaataattggattacaaatttaaatattctcggagccatagactgggaaaaaaccgtaataagattagtcatactgtgcacaatcctctta

SEQ ID NO: 27200 - DNA, 654 bp, Heterodera glycines
cggatccacgtagtggggcgagacggaggtcgaagtgtgcggcggttttttagcgcaatactggatattcaaggctaaacgattttctgcattatataagaagaaaactttttttcgtactgaagtgtccattttcactgggactcagttgacccagtgcctagatggcatcggtttgaatttgtactttgttttttagtcttagctgatccagagcttgggattgatacttaatttgtctgaatttgtctgttttaaagggtcaggggctccctttttctgtcaatttttcaagttttaagccggttcaaaagccggttttttggcatttccgcaactgtagatcctttattagcctgcaaaatttcaaaaagttgcttttctaaacatttttggccatgtcccgacttgctctggggtcgggccaaatgaattcacggtgcggggttcaggggcaggcagggacgagacacggaattaataaaaaatttattccgggaaatgacctcaaacttgggtaattaaacaaaaattttgaaatggtgaacaaaatatcacaaaattgatcacagataaaatgccatcaccgggggattaatcacaaatgaattggaaaggcgggatgggacaggaaaattttcagaaaggaagcat

SEQ ID NO: 27201 - DNA, 1915 bp, Heterodera glycines
gaatgaccttcattttccattaatttcgcgttgaaattggtctttttgcctcgtcaaaattttatggcgcataaatttggggcggacaatgttccataaaaatggaccaccatcatttggtcattccgagctagtttcaaattttgtttaagaaaatgcagtacattttttaataaataagttttaaaatccatgaatttttgactaatattaaattttctcaattttttgggaatttttaagcaaattctttaaattatttagcctttaataaggagcactctttagaaataagcaactatttgtatgactaataggcattccattagaactttaataaatgatttatcttattcatttttgccaaatttataaaaaggcttactaattaaacttttaagaatttattatttttttaaatgtttatttttccttttttaaaaaattaaaattaaataaatcctttaatttctaaaaattaaattgttatattttcaattataaataaattatttaaaatcatttgatgaaataaattctatcgccgttttgttttcccatggctatcaatttataaaattgtcgccgcctcagtcaaagccggtttaaaataaatgaatcctttctttccgcatatccgtaattaattgtttttaaattaaagcaaccatagcaaccatattagtttttgtgaatgttttattaaatggaaattatataataattatcgccaaatgatgaaaatcaaatttttcttttttaattaagaaaatcgcataaataaataagactataaataattctatatttatatttttttaatataatatatcaaacatagatataaatttattttcataaattttataattctatggtttattaaacagaaataaatattactttaaaaatacaacgaaattcaatttcttttttttaattattaagaaaaaaatataaataattaattataatatttttaattataaatatattttattaaataaattatataaataaataagactataaataattatatattaatattttttgtaagatataaatattacattttcataattttttatattatatttaacatatataaatattattttaaaaatgcaaatatttaaatataaataatattaataaaataaactaaataattcaattattaattaattttgattattattgttacaatatgtacaagatttgtgcgtacaaattattaatgtgtatgtttatttgttctctctccattcttgaagagtcgtcgattcttatcgttttgtcgtccattcaaatcgtcgccaattttatgagtttgattgagcgtctgttattcacaccaccacacaaatccatttggaaaataatttaaaaacaaatttttaacatttaatttaatttaaaataatttttgttttaatttttaaattttaatagaaatttgaatttttaacttttaatgaactttcccttttcatatcataaaaaattcttttaaatttttttatttttgctcttatttaattattaattaattttaattccgtttttaatgtttgttctttttcaagcattttcgtaaatatgtctattgaatcattttcatctgattttcaacaacagaagaaggtggtggaccaaaatgtgccaaaattggaacgaccattaaaggcattgttaatttttaaaactaattaaatttaaaataatattataattatagtttcagcatattgttaatttttgattaatccaaatgaattaaaatttaaaaaaatattaataatcaaaaattttagcatattctatcgcatgaatttggcaaagggtcgctgtgcaatcggtgtgattgtcccgggttcggacatgcacttttggcggttggaaaaacaatttt

SEQ ID NO: 27202 - DNA, 1935 bp, Heterodera glycines
  misc_feature (1925)..(1925): n is a, c, g, or t
ttttatgtgtaatgctacctaaaaagtgttaacaaaaaattttatttgcctatttgagggtttttgtgcctatttgcgatttttttctgcctttttaggtgcctatttcgcgattttttgtgcctaaaaatggagtccataatcattaattatcggttttgtgaaattttaacaaggttaattttaaaatgatcgggaatttcagttcccaatgagtcatttttaattctttcactttttttcctgctgctgtcatcttttaccgtaccaaaactgtccccattaccgtataactaccggttcccttttcacagacccttctcggctttgccatcggcacccgacgtgccgcctcgttgctcgactgtttggagctgtgcctggcacacaacaatttcaacagtaatcaccaccaccatcgccaatcgccggcaccgtcctcctcgtcaagttcaagcagtacaacatcaatgacgataatttggtgccgttccgtcgttttcttttacgaggaaagtgccatttccgccgtggtcggtggtgccggtgatgccgacgatggttcttcgtcttcggttggcacgggcggcggcgatggccaaaattgtgtgctgaactccgagagtggggacagtgcgccacaattttttgtggacgaaaccgaggcattggtggactacgcgtcgtttgacgactgttaccaattgggcgacgctgctgacgctgacgccgacgacgccagcggcgttcaaggcacagtcgctgctgcggccgcgacggcgactgctggcgagaagcgatcaatggcggcgagtgggacggacaaaatgggcatggacagcgacgccggcgggagggcggcgagcaatagcagagcggacgtcgcagagtcgcgcagcaggccgcaaaaggcgattgcactcgacaggaaggtacggtatgccgaaaggaactatacggtaaattgctgagaataggtgccatttagtaccggaaaagaaaattctcaatgtttgctgtaactgttaccgtaaaaggtcaatcccaatgtttaccgtaaccattaccctactaaaattgcaatttgtccagctctaatatatatttgcagaagagcgcttccaaaattgcacaaattgcgtctattccggaggagcggcaacaacaacaacttcaccaacaacgattgttgcttggccacgatcacgacgaggctgtgggcctgaaaaacattggactgaaatggccgcgacgaatgggcggccaaaaaattgtgtttccatcggacaaaaatgtgcagcaacagcagcagcagaggaagccaattggtgctggtgatggccaatttggcacaaacaccgctaatggccgtgggcaggcgccattagcagcagcaacagtagcatcaattagtggcaaacagccaccgccgagggcagcagcaatacaattaacggcccctgtggcggagtcggcgacggcggcggcaaaacatcaaatgggcaaggcgatggcggtacaacatcaaaggggtaaaggcggtgaaggggggcaacaacaacaaattgtggccgagctgagcgccgtctattcagtagaggaggaggaaggggcgagaaaaattaataatgataatgataataatgatggtgtaagcgggagagtagcggcagtaacaaagggtggtgaaggaggagaaagacaacggcatcagcagaggcagcagcagacgatgagagtggaagggcagacaaaaatggcacaacgccaacggcacaggtcagagaaagaaatgcctgcggcggggatactaggagagcatatttatccttgattgagtagtagtcttaaatcaaattttatgggataaaatgattgcaggatttaaaactcgcaacttttaaggccgtcccgaattcgccganattaattttc

SEQ ID NO: 27203 - DNA, 1011 bp, Heterodera glycines
  misc_feature (971)..(971): n is a, c, g, or t
cccgcccgggccacaaaaatcggaccgcaatctcggggcgccatttggcaggcatgcaactccaatttgtggacaaaagtgcgtttaactccaatgtttcccaagaaatgtttgagatcgtaccaaataattgagttttttgtcgatttttttgtcattttgatcactgtatgttaataatgtgaatattttgtgtttgcaattttccattattcggcagtagcgcgcttctttatttgttgacacattcattcaagttgagctcaacaccaccgcagttggatcctggttgattccttctcggggagatttatattgtgactttagcaaataaaataaaatattggaggctcagcaagctagacttaaaaaacacttagtcattaaaaaatattgaaaaaaaatgatgataaattggctttatccatgtgatcaagtgccataaagttgcattttttcttctcctacacattattagggatgcaatttatagttttttcactattttttcctgagctccccgtggcctgaaatgcacgaaaaaatgtttttttcgataaactactttttgagcgtgctggtgcatttcataaaaaccgccaaatgggtattttgttaaaaaacgccacccatgtgcttttcgtaaaaccgccagcgcgtttcgtaaatccgccaatgggttcgaaacaaaaattgtaataaaaaaattcataacttggcccaagttcaaccaaattaatattttatggtatttttgatagctttaagtgttctctatcagaatataattttataaatttttaacttaagtataaaaaaagttataaatcattgaacattttatgttttttgcaatggtcaagcatatataattataaacaactattaagtctataaaatgcaattgagccaaattaatttatatattcgatagctctaagaattctctatttacctttaaaatgcagaanattcattgagattcaaaaaagttctgtacacaaattctga

SEQ ID NO: 27204 - DNA, 1669 bp, Heterodera glycines
taaaaataatttgctttttgcaatgtgcacttggatttcataaaaaaaataaattcaattaaagggaaaaaattatggggcaatctgggaattgaacccaggacctctcgcacccaaagcgagaatcataccactagaccaattgcccttgtgtgcgcaagtgctaaatattttataagaaataaatattaaagcatttgtttggcagaaaattcttttaaaaaataatataagaagaaaatttaataaaaaattcttataaattcatggaaattttaaaaattcattatatttttacttttttttctcattcttggcttcatttatttatttttagttaatattcggtcacacttaatgtataaataaagtaataatggctgcattaatatgcgtaactaattggccacaccattttgactaattaattaattaactagccacacccatcgttttgtttttctctcttcaaataataaatgaattaataagtaatgtttgcaatcaaataagtgtcaattcttttgcttttttattcattttccttttgtaacattttcttctgcctaattattcattcaatgatcgccgtcggcactttctttttgcttttgttgttttgcgggaatgccaaggaaaatcaacgagttcattaatttatttcataatttatttttattttttttgttttcttcagcaaattgtccttcccgtcagtgcgcggctgaaaatttccgctccgtcagctgacaatttcaacggaacttttataaaaagttcaaaaggagaagaaatggaagcgccgaagtcgaaggaggaggagggacagcaaatggaagtgatacggcagggaatcgcagttgaaatgccaattaatagcaacagcggcagaggatgaagattttaatgatatgatgataatgatgggtaattacaatagtaaaacaataagagaaaaagaaaacaattatgcagagattggacaataacaaagaaaagactattaaatgttaattgaaatgaaaaaaaataaagaaaaagtaaagcaacaattttgaaatggcagataataaaacattagcggaacagactcttcaaattcaggtcaaaaaagagcacactgattgatttgattattgagcataaatcaacaaatcccttaaaataaaagaatgcgttttgcgcgaatgattgcttaaaattaaaacagtgcgcatttccaccatcgcttttattgtattaatttgagataaactcaattaaacaaaacttttacatttttcattaatctattaaattcgaaaattgattgtccaactttggtcaaaggctgatcaagtggaagaaaatgatcaagcggcttaaaacctgttcacaaaacggcaattcaaacattggttatgctcttgtctcataagtgatgatggtgatttggtgatgctcatttgtcagaagatgaagacggccctttctttctctcttctttactttcctttctttctttggttggcttttccttttggtggcatttgacactgacattttgcgttgcttcgatcatcggcggcagcgatcacttcagcagctgaccccccccccccccccgaactccattttttatttgttagcgcattccccgagctgaatttcccttcggcaaaaagcggaa

SEQ ID NO: 27205 - DNA, 714 bp, Heterodera glycines
  misc_feature (6)..(6): n is a, c, g, or t
tatttncggggtttattcagatttggatttaattttaggcataatcaaatttttttcctaagggatattcaaatcgaaaaatatttgacgaaaaatggcaaaatatgcaaaaaatcagaaaatatgtaatcaaaatttgtcttgacaaaaaagcaacaagttttatgcaacaggatccaataaaagtgaatcatcggttcatcaaaatcactaatcaccacatcattttacatcctcctcattcatcatcttcctcgctctcctcatcatcttcctcttcccactcatcattcatgtcttcatcgtgtccttgtccttcaccatgctgttctccctgctgaggttggtgttcctgattctgttgttgcagttgttcctgacggaggcgttccgcttccttttccttacgcttctgttcttcctttctctcacgctcctcttcctcctctcgttcctttgcatggcgtgcctcacgttcctcgtccgattcttcccactggttctccttctcaactcgtgcccattccggatgtcccggtgggtacggctctttgacgccgaatgccttgcgaatttcctgcggcgttttgccattgatccatttgacttttacgatttcgtacacattgtcaatgtaatcatcgttgatcaaacgattgatgttataaaagtcggccgccttaacattcatacaaataaagtttattttaatgc

SEQ ID NO: 27206 - DNA, 1248 bp, Heterodera glycines
  misc_feature (1075)..(1075): n is a, c, g, or t
  misc_feature (1132)..(1132): n is a, c, g, or t
  misc_feature (1153)..(1154): n is a, c, g, or t
  misc_feature (1183)..(1184): n is a, c, g, or t
taccgtccatctgcaaacagcagaagggaggacaaagttcaatcagcaatcacgtgtcttctgaagttatacaacgtgtgaagagacgagctgatttttgctccgaccacaaggcactgaaccgttttgtgtccaatcgggaccggctgagaattgcggtccaagagctgatgcgtgcagcagagattgcaccggatcaagatgcttatggaatggaacatcttattctaattcaacaactatgggtacaaataatttaaaaaaaaaaaaaaacaagaaattttttaatgtaaattcacaaaaaggaccgcatctatactggaatgtaccgcattgtactcttcacggaccagcctgaggagcttccaagaccaatttggaagggtccgatgggacgccgcttctgtgtgtcgctgtttctgtcggatgggcactatcacggcatcaaaaaaattcactgcttcttcaaacttgggataaaatattgcgttgattgcgagtgtttctatggtagagacgctaaacatacgatgtcctgtaagagccgttgtcaccaatgtggaaaaggttactaatttaatccaacaattaatttgatatttcctacagttggaccgcaatatccttgcataagagtgcaaggtgtctgtctacactgtcaacaatgcaaacgatttttcttctctcaaagctgctttgatggtcatcgtccgcagatgtgcaacttgattaaacgttgcgatgaatgtaacagaacttttcaagtggatagaaaaaatccccacaaatgttacagcaactattgtgcgcgatgcaaggtattttttctctatttatttattaataactcctccaaaaaacacaggtataccatgagaaggaaggcgcgtgcttcatcaaacccattgtggtgcctgacgagaaacccaaataccgaatggtatgctgggacacagagactcgattggaacagctgcaacaggcgggacaacagcgacacaaggtcaactacctgtcagcacgaattacctgtacggagtgctgtgattctgaaaatggcctgcgactcaattgntaaatttgtttgacaacatacggagcgatggaacgaacgaaggattggagcgaatcngaaggacatgagccaatttcnngcattgtcgagtggattttgaaggcttgnngacacaatatcaaacattatttgggtgagtttgtgatcttttttaacatcattgttatgcaaaa

SEQ ID NO: 27207 - DNA, 1222 bp, Heterodera glycines
  misc_feature (3)..(3): n is a, c, g, or t
  misc_feature (25)..(25): n is a, c, g, or t
ttntgttttaattaagaaaaaaatntttgtaaaattaaattcttaaagagaaaattaaagctattgaatgatacaatgaaatattaatttggttgaatctgagccaaatcaatgaatttatataaagaaatttgaaaaaagatttaatataatctgtgactgaccgttataaatgatggcatttaatctatcactggtctattcacatgtattgtacttatcgttggtgctaattgtaagaagttactcaaaaaaccatcaaatggaaaatttttgaccgaaaattattcataactttgcccaaaattaaccaaatttttttatcatcgaaatgaattttgtaaaaaaaatttatggaaatgccaaaatcaatttgatcaaagccggaaccaatcagcagagtttaacaaattcatccacaaagtcggacggacaaaacaccccaatattctttgctgataacaggcagaaactgttcatagtttgtcttgaaaaaggcacggaatttattgacatccaaattcaaaaaataattctaaaattgggaaataaattaaaatttgtttaaattttaaatttaattttttttaaattagggttgagcgggaccgggaccaaaacacggacaactgagtaccaagtctcggttttttcccggtcctggttttcgatccgaaaaggtcccggttttgcccaaaattcccggtcacgctcaactctattttaaataataatcactttcaaattgtcgagtccgtagcgctcaatcagaaggaaacggtcgatcagcggaatttccacgcaattgatcagatgcgtttcgcagcgcgacttcaacgcggtcacctcaaagcgaagcgacacttttttataagcaaactaattagcgaatttggggtcatttatggccattaatgttctctattagcctccaaattttaaagaatttttaattaggttacaaaaaaattagaaaaaaacacaaatttttttaatagttttggtcataaaaattttacaggctgatagagaaaatttaaacattaaatgaggttttgataagtgatcagaggaactcgcctggaaatagttggcaaatttgagcagcataagtacatttgtggctaaaatttggaatcaatttaaaaaaaaattaaaaattacattttcaacccctcaggggttatagtagtaataaatacagtatcaatgaattacggtt

SEQ ID NO: 27208 - DNA, 1801 bp, Heterodera glycines
ttttacagctccaaccgatgtgttatcaaaggacgaagttaacgccatttatcagttccattcccttccaaattgtcgtgagatttacaatgacggacttttcccaatgcaatttccttcttatgcacggatttctgactggaaaaagggtacacttttgatggacattgaaaaagtgtcggaatttgcacgagaggaggttgagagcagtcggcacagccagaaagtgtacataaatggaatgccatggaaaatattggcacaaataaaaacgaaaacgggatacactgacaatgagaaaagtttgggcatttacctttcgtgtgccgttcccaaagaaggtggatggaaattaattcttaattaaataataattaatataaatcgattgcattgagcagaaaattggagctgcaaatgttctgcaaccattcgaattgtttcacaaaagtgcggtgtggcggatttaaggagaaaatttgatggaacatttataagcaatcaaaatattgactgtggattctattatttgatttcctttgcggtgagtgccaattaaactttcggtgtaaactttcccctaatattggcccaattatgaacaattaaggaattgctggacccgagcgaaggcttttacagcagaagcaaggacaaagtgaaattggccatcaattttattatgcaagaagcaaaaagggaggaaaaaacaagcaaaggcttttacgacaaaagcgaggataaagtgacattggctgttgatgtcattgtggaagaagcaaaaactgaggacaaatgataatcaatttggcatattatctatttgaaatctccattaatgtcacttatcataagggccgcgatttttagtgaaaaaatatcgaaatagttaaactaaaatagtataattctcatccgaaatcggataaaatagttttaaaatttttgtcaattttggaaatgaattttttaagaaatttttcatttctttggagtgtatttttctgaaatttggggggggggccgattcttaggagtgcgattttattttttattacatttttgttgagaaattttgagtaaaaaatagtaattttcactaaaaatcgcggctttgatccaatcaattgacaatacctgctttctatacatcgtattcgaacaaacccaatctttttggtattatccgaaagcacaaagtctaaataatgtaataatacaagaagccaagagaattttaacatttaaagaaagttacaaacgaaaatcatcaacaattactaaatcaaatccgaaaatatgtattcttcggttttctgggtcgctaatcacgaacatatctgagaaactgatatatctgaaatattctgactttgggatagtgaccaaattttgttctgatttcttaaatatagcgtcaaggttacactcttcatcatgggcaaaagaacattaaaaattggggccaaatacaaaaatggtagaaataaacacacaaaaaagatttatacaaatcaaaaatcacccaattacaacaataataaatacctaattaccaaatcaaacacacatttaatacataataaatggaatggaatcatttgcggaaaatcgcactgaaaagcacagagtcatcgcgaatcagaaaggcacagaacggatggtcagcgacaaaacgcaagttttgtcgcggtgcttggctcgcttggtaagcaattcggacgtttgtggctgccgcggcgacagtgccctcctcattgacctacataaatcgaattaaatagacaatttatgcctaaaa

SEQ ID NO: 27209 - DNA, 1211 bp, Heterodera glycines
cccccccccccccccataaaaaaaaaaaaaaaaaaaaaaaaagaaaaagggggagcaccccccccacccaaaaaaaaaaatagatggttttttttttccttttttttttttgtggggggaggggggggggggggggtaaaaaaaattttattatattttttttttttttttggtggggggggggggggggggggggtttttttttttttttttttttttttttttttttttttttttttgggggggggggggggggggcgcgccccccccccccagggtggggtgtgtggggggttttcttttttttttgggggggagagggaggggggcgctctttttttgttttttttttttttttttctctctttgtggggcgcgcgcgcggggggggtttttttctttttttttggggggggttttttttgtttttttttgtttttttgtgtttttcccacaaaggtttttggggaagacaaccaaaaaaattttaaaaaaaatttttttgtggaaagaaaaaattggggggcaaaaaaacacaaaaaaaaaaattttgtattttcccccccaaaaagttccacccccggggaaaaaaaggaaaattcttttttttttttttggggcccccaaaacttttttttcttttattggggtttttttcaacaacaaagtgccaaatgggccgaaaatttcccctttttatttttcattttttgttgcccttttttttcagtgggaaatttgaatttaaaaaggcgggaaatggagagaaatttcattctcgtcacatttctaatttttatcttctcaactattacatctgattgctgctgctcaccgactccatcgacaacgacacgcgatggaagaactcgtggcgctctcccctgaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaggggcggaaaattggcaattcaatttaaatttttttttcaccacccaggctcacgtgatgaccaagctggacgcccttcgagacggagacgggaagcacttctgccgctgcttggacctcgggcgcgatgagcaaagggaccaacaatcgggacaaatgaagaa

SEQ ID NO: 27210 - DNA, 968 bp, Heterodera glycines
actttatttggccatttggtgcagttcacggacactccgttccattcaaaggcgatcaagccaatgcttgagaaaaatgtgccgaatttgttggcatttgtaaagcgcatgaagcaacgcttttggcccgattgggacacaattttggacagtttggcactcaatccgccggtgtacgaagaaaagcaaacaaaatgataataattctaattctcgctaattaaaaagtgagcataatacataaaattgtctgtccttttataaatgcttttttcaattttatttttttctattttggtgtaaaatgttttaatgcaatacaaattcaaattaaattaaaagctttttgaatccaggtgaaccattgcatcgattatattatcatagttaggcattgtatgaaataaacaaaattttctagtaaattaaatttttagaaattttattagaaattcattgaatgatcaattggaaaagtagaaaataaatatatattttaaagatagtatttgcgtttacgtgcaaatagcgcagcggtctaagtgcgccacccacactcattcagccttgcgagttcactcccgcctgcacgcaagcttttttttcaaaaaaatttgaccaaatttctctcctcttcaattgttttttttttttaatattttaagatccaatctaaaaatattttattcttttgctttggtcttgcatctgttcttttggcttttgaacatgtcgtcaaatatttcggagttttttctgtttttttaattcgtttcaatgcaaaattaaaatttttaaatttatttcttatttatgtttttgccctctatttaagaattatattttcaaaaagtaaattgaatttttaaaaattattggattaaaaatcattgactcaaaaaattttgaaaataaataaatcaaaacaattacagaaaatataacatataaaaaatttttaagttgaa

SEQ ID NO: 27211 - DNA, 920 bp, Heterodera glycines
  misc_feature (820)..(820): n is a, c, g, or t
ctttgcccccttaatttgttgccaagtgattccaatcttgttttgtttttttcttccttatttccccctacgcttgtgatcggtgccaacggactcggcttgtacagaatggcatttccgcaagcgatggccggcgcaattttccacgacgcggtctgaaaaggggggacggagagtgctaattgtaaacaaatctgtgtacttttcggttttgttcctacacaaaaaattttcaatttattatgccattttcacgtaggaatattgatagatccattttgttttgtcgcccaaccaatttgtgctatggtaattaggcaaaatttgtgatttccgtgcgcccttttgtcctttttttttgttgaaaattatgaagtgtaggaacaaaaccgaaaagtactcaaatctgcgcccgtttagccccattttggcgttgttttccgtttgcctgtattgggtaattccacgctccgattgcccccaccacaccgaatggttcgcgtcgcgtgtacgcaaaacgccccgacagttcgcctccgtacggaatgtgttcgccggacaaattgacaccagcataaaacctgcaattgaatgattaatggaaacattcgccacaaaaccaaccaatcgaagcgactcactcaaaagtgtcggcacacgaaagcacatcggctttagcctcactgatcggtttgccgttgtcgcgcacttcccattcagcaatttcgttggcgtgtcttctgaaggcaaaaaaaaagtgtaaaaagaaatagacacagctttcttaaattatcaccgataaaatccgatttcacaccanagaaccccacccaacgggggaaagagatcattcgccaatgcctaatttattgtcccgatcatccgatggtctgtctgtcccaaatacgagcgattgtttt

SEQ ID NO: 27212 - DNA, 1788 bp, Heterodera glycines
ataaatatatgaatttggctgagtttcctaatgcattcattaatgacaatcgtccaattatgccattacaaaagcaactcttatttaaaccaaaaacatttgttaaaaatttaaatttttaattaatttattacaaaataatattgaagtacgaccaaaatgtaataattcatgatttacaaaaaaaacttataatattatttattaaattttcatttgtattatttttaaaattttttatatttttataattatttttcaattattaaagtgactctgaggttgtagacattacatcgctttcattctatcatttttagtttattgtttaaattttttgttttaaaaaagaaaatacatatgttggtcatgaaaaagacttaattttttatcttttttggattatatttttattaaactttttatcattaaatgattaacatagtgtaataataataataatattaattaaatcattgcttactaattctgtgtgaatttcaatattttatatatttataattgttgtgaatttcttataaaatttaaatttttttaattaaattattacaaaataattgcgaacataaaatttattttattttcaaaaattaaatacggcctttattccttgatgaattgaaacaaaaaggcgcgaactgagaaaaaaagcatatttctattctatcattacatgaaatgtaattttaataagagcaaaaaaattcaaatgagttttacattattgattgataatttaatacatgcaaaaataaaaaaccgtaatcagttattaaaaattaattaaaaagtggtaaccatattacttagtacaacatatttgaaggaacgagcgaatcgcacggacacacaccacaaactactatttgaaataaaaataaatgtttaataagaaatttatacaaaaataaaaaaatattttgcaaattgttgtttgaatatgtttaaaaatgtaaataaaaattaatatgattttgcctaaatttatgtaagaaaaactgacttattcaaaatgtcagagagctcactaaaatcctttattttaaactatctattcaataattcaaaaaaaaaaatcggcttacatacattacctcaaaaatattactacgttaaggcatgtcaaaaattaatacaaataaatataaaaaattattaacttgtgaagaattttataataaaatttctaaatattcttattttaaaattgaacattccaaattgaaaattatatcatgaaaaatcattctcataaatatttgcttatatattgacttttcaataatccattaatagactacttctatacatgaggaatgattaaaagacataatatgataaaaataataaaataataatacaatttacagatgaacaaaagcataattaaaggtataaatattataacactttcagtgatcgcgctgtttgtttccgcatgcattttgctgcttcgttggcttaagaagcgtttatccaatcggtcgtccgccttttttctctgtttctgtgttggctcgatgtccggctcagccagcttccatcttaattaaaatatttttttataattaaacaaataataacaaattaaaaacaacattcacattataccaagaaatacaatcaacaataaattataataaatgaaaaactaaaaggcttatatcaatctacaaaataaaagataaagtcgagaatttttaaaacactattccgaagcatcaaaaatagaatattaaaaaacgcaaaatgaagtttaactcagag

SEQ ID NO: 27213 - DNA, 1241 bp, Heterodera glycines
gggggggggggtaaatgacaaaattttttacaaagcacaacaaaataaagccaaatcagtattgaaatatataatttttaaaatcaaaaaattcttgtcaaaaataattaaataaatatttttgaatgcatttttgagaagtttttgctattttaggagttgtttttgctgaaattgttgaatttttagggcgggggggggggttcgtttccattaaatttttattaataaattgtgcataacgccaaaaatatgcaaaaatagagatttttcaaattttatttggtttaaggctcaaattaaaagcctagaaaataggccctaataactcgaaaagtagcttaaacaaccaaaaacaaattgttttttcatgctaagaccgagaaataatgatgttctttacatctgtcagttgtgaatgtttaaaaaccgataaaaaagagaaatcattcgaaaatttgaagtaattaaagaaaaattgaagaaaagtggaaatttcaatgggaaagtcaaacaaaaattgagaggaaaatgaaagaattcattgaacgatttgatgaatttaaaaggttgtataaaggcaaacaaaaaggatttgcgaaggaattgggcatttctaaagaacattacgaagatggaaaaaagaattgatgccaaaatatcataaaagtgagagaatttgttttttaattagtttatctttatttttaagtacaagttaaacattcaaatgaggacaaattaaaaaagatgaaaaaatattttaaaatcaaagaaagaaacctaaaaattagcgatgcaaaaattgcaaacataataaaaaaaaggttgactcaaggatgggaggaatgaaaatattaatgaaaattaatttataaggccaaatagctatgcttacagagttggacctggacctggatttcctggacaaaaatctaggaaaatccaggtccggaaaaatccaggctcctcgggacctggatccaggcctggacctggattttttaaaaatttgttttaaaaaacaaacaaatgcttgaaaaatcaattaattgcttgggaacgtctaaaaaaaaataagaatgtattttaaaaccaattaagcatttttttggaaaacttgaaaaaacaccgggcagtttgaaataataagatttaactccaacaaaaaaaattattttaatatgtaccttgaaaaaaaaaaagttggaaaaaattttaaaacggattttcaatttttt

SEQ ID NO: 27214 - DNA, 1434 bp, Heterodera glycines
  misc_feature (1412)..(1412): n is a, c, g, or t
cggcctcaggacggccgctttgcgcccgtttttaatttttcgggggatattcggccgcttcgcggcctcaggacgggcgcttcgcgcccgtttttaattttgttgggaacattcggccgcttcgcggcctcaggacgggcgctttgcgcccgtttttttaaatttttggggaacattcggcagcttcgcggcctcaggacgggcgcttcgcgcccgttttttaattttttgggagacgttcggccgcttcgcggcctcaggacgggcgcttcgcaccctttttatatttttaattcggccgcttcgcggactcagcacgggcgcttcgcgcccgttttttaattttttgggagacgttcggccgcttcgcggcctcaggacggtctgaggtcttgaaaagtaaaatctgatcacgtattcgtgatcagcggcccaaataacccctaaagacatgtttttggaagatttttggtgaaaaaatttttccactcaaaaatactggtcaccccctttggtccagaatcccaaaatcacttttatctttatagcaatttgtaagaaggtgataaaaatatgaattacaatttatcttatagagcaaaaaattgcggatttttgtagtatttttaaatcctccgtttattaattgaaaataacgttgaaaattaacaattgaatatttaataaatttaagatgaaatttacaaattcaaaaaataaataattaaattctttaatgtaaaaatttttttaaataatctacaacaaatcttcagattaattaaaagcattgaaaaataactcaaaaataaatagaaaaataatgttacaccgtccggatccgaacctgccccctcccccctcaaaatgatgcctcagaatccccaatcacacagggattctgaggtcttgactatgtcaaaagtaaaatctgatcacgtattcgtgatcagcggcccaaataacccctaaagacatgtttttggaagatttttggtgaaaaaaattttccactcaaaaatcctggtcaccaccctttagtccggaatcacaaaatcacttttatttttgtaacatctctcaaaaaagagataaaattgccaaataaaatttatattgtagagaaaaatattgcggttttttgtagtaatttacttttccagaatatcttttcagaaccgagttatgaatttttttctgaaaattcgaatttttccagaaattctggaataacttttttcttttttgtgataaaaaactcaaataaatcccataaaattctccttatttttctctatttttaaagctttattatagttaaatcgatgaaaccatcaccgagttatgaattttcaaatatttggccaaaatcccgagggccaaaaaattgcaaaaaaataaagaatttttanaaaattccaaaaatcatgaaac

SEQ ID NO: 27215 - DNA, 1668 bp, Heterodera glycines
  misc_feature (599)..(599): n is a, c, g, or t
  misc_feature (1540)..(1540): n is a, c, g, or t
  misc_feature (1544)..(1544): n is a, c, g, or t
  misc_feature (1578)..(1578): n is a, c, g, or t
  misc_feature (1637)..(1637): n is a, c, g, or t
tacaatatttagcatttttagttttttttttttaaatttgctggctaattgagagcaattaaggcagggtgacgaagttttttttcaaattaaggataaagaacactaaaattcaggtttagaccccaaaattcaggacaatttgtttttcagataggtacccaccaattcaggatctgaaaaatcaggacatttggtcaccctgaattaaggttatctcgaatggtaaaaagaactgtacctccacttaaaattcttgccatccacggcaatgatttgtcatccacaattgtttttcctttgaatatctattgtatttgttaaaataatttattttaattactagttatttttacatgatttgtgccaatttccacttttggtgcaatgggaaattcgggttcaaagtcggaaatgccgcattcggaaaattctgaaatatgctcagacaacgaaaatgatttgtatccgatggtaaccaaaataattgtcaagcaaagtttaagcataattctaaaactaattttaattttattcaaaattattatgattttaaaaataataaatgcattaattgtattagaaaaaccaataaatanaaatgtatttataagcaattccccaaagggcattttaattaatttcatttgtctaataaatgctttaattaagaattagaacaaatggtgaaatatttttttagcttcaacaccttttacagtcgtaattagtaattactcactaattgcttttcgattaaagaaaaataaaagcaatgttaaaaataatttatggtaaaagattgataaaacctttcaactaaaaccgcgggtcaagaaaagtgtcgagtcgcgattcgggtcgggggatacgttcaaagaaattcggcgtacggttcgggtttcgggactccgggttcgagtgcgggacaacccaaaagctcaccaaatttatctcaaaatggatctggtgaaattattatttccttaaaatttttaagtcgaaatttagcagaatattttcgggttttctgtggagatgatgtaaatgcttcaaaccctgttcagccggttaaaattcatcatagcatcaatttcgaaatttacttgctcattactattttcgttggttcggcaatactcaacaattatgccaaaagaactcatctccaaaaccacgtgatcggtcaatgcttaaaactcatttttctgttaaaaacatttattttactcaaaaatgtatgtgaccgttttgaattcaatgctttctaattaatttatttttattaatatagatttttctagtttctatttttaggctcaacaaattgaattggccaaacttagtagcagagtcaaatttatgcccaataataagaataaaaaaataataactaaacagtttaaaaaggacattttttgttggttgatcagagaatttccaatcaaattttttagcgaattttaatcgctaatgagtttttgctaatttgcttaattgctggcggtgtcttctttttctttctgctgttgggattccnactntttgttctcatgttcttttttcgttttggcaaantttgttgagtcatattgtttctggtggctacgttctaagtgatcccaaagatgggaggntgaacttctatttggaattttacattcttta

SEQ ID NO: 27216 - DNA, 1931 bp, Heterodera glycines
  misc_feature (76)..(76): n is a, c, g, or t
aatgagtgaaaatggaagaaactttcggcatttgcttatcgcgacaaaattttgggcaaaaagtaaattaattatntaaaaaaacatttattttttgaaattattcttaagacaattacatttactcaaacaaaatgggctttttgaacggaatatctttggccataatggttgccaaaattgggctgctctttccaaattcgtcactccaatttcttctggaaaatttttttctcatttatttgacacggtaattttaaatttttgatttattcttatttattctttggcttccaaatttcactggtttttgaaagtctgattgatgttgatatttttgtttttgataatcgactcataccgaaatttttaaaattaaaacattttagaaaatatttttataggaaaacaacgtgaaaaattttgaaatttcccgattatcttgcattaccaaaattagatattttcataaaaatctttttttacccccttaatttttacgttttgttggaaaccaaaatttggaagtcataatttattatccaaatgttttttcggtttgcctttaggcctcaacaaattccgattcaattaacaaaaattgacgcacacaatttcaatttgtttgttgcaatgaatgaaaaagaattggaaatgcccgtcctcacgcccgaattacaatttcacccgctgcaaaacgccacgcgatttgtcacacattcaaatgccaaagtgattcgacgtgaaatggcacaaggcgaattttcatattttcttgcgaatttatcattttttaatttaataaatacgattttttagcgctccaaaaagtaaattcattgaaaaatgacaaattcaatttgggagcatttctgagtgagcccattccattcacagagaaggtaaaatcgaccaaatgaacttgaattgttatgataaagcaatttttgagcaacgaaattttaattaattttttttaaaagaactaaataataataattgtttgttgaatatcaaaaataattatttaatttaacatttaatttaaatttttctttttcagttccaaaatttcctcgtcattcattgcatctccgagcagaaagaattggccgattccttctgcgattttgtcgagtggagaatgcgtctgcaaatcatttttagcatcgacaaaaaagacgccggtggccaatcggtggcgacgcatttaaagccgaacattcaccgggaaaagtgcaatttgacaacagcaaaactgctgggcatctcatttcggtaaaaaaagtccaattaggtctcattttcaaatgcacgaaaagaaatcaaattaactaaaattaacaaaaaatactctttaatggggtcaagacaatccgtcagttatggacattccgtcagtgacaattcgtcagcaaatttttttttttttgagaaatatttaataaaaaagtttaatgggttttacaatattttaggttttctcattctaaagaaatgatcttaaatttttttaaaattgcttaatcattacttttataaaataaacttcaaaattatttttcaatttaaactcattttcacattattttatataaaatcttgcattttaataaaaaaaaaaaaaaaattctgacggaatgtctactgaaggattttatccactgacggattgtccgggagcctttaatatatcctttctgtttgagattctgaaagtgctcaatattttaggcccaatttctgcaaagtttggctgctgggcataattagccacccgatcaaaaaccgcgacgaaatcatttcaatgccaaaacattttgattcgaccatcaaaagtcacttccatcaaagacaaaacagagaaaattcggcaatttattggcttgaagtggccgcaaaactggagctcaaaacgatgctaatgagca

SEQ ID NO: 27217 - DNA, 875 bp, Heterodera glycines
gctgtgtcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtccgaatgtgggcgaagtgcaaaaagtcaaatgtgggcgaagtgcaaaaagtcagaatgtgggtgaagtgcaaaaagtccgaatgtagccggaccattcgcccatttggacacttcgtctcacttcttctcactgcttgtactcagcatttactaatcgccccttctcttcatttaatcacatatttatttgtgactaataaaggaattgaaaatgaagggagaaaaatttgagagaaagctcttcttgcataaaaatacaaaggaaaggccaaagcctcctcctttgtccaacaaatccatttatgtttcacaggcgaacgttgaaagggatc

SEQ ID NO: 27218 - DNA, 806 bp, Heterodera glycines
aattgggggtttctacagaaaattctttttttcagtttttcgttagattgtattcttaatcattttttcatatctttgatgaacctattcaatgttaagattttaatggttaaaaaattgaatgtcaatctttgtgactagtaattttttcgaattttcaataagttatttttgtcgatggcttatagttttagtaaaacttattgataatagtggaatttttatgaatataatattttttacagcgcggcgcaaaagtccatttttgctgggcggcgcaaatgtcgcggcgcaaatggagcggcgcaaatggcacggcgcaagtgtcgactttgctgagcggcgcaagtgtctcatcacgtaatcaaatcactcttgtacctataacaccaagatgatgaggtaatattccattttaaatattaaattcatataatttcaaaaatttaaatgattcgttgtaatgtttcattatgtgtatctttagcgattatggagctatattggaatattgtttgatcttttcttttatatccttaatatgtattaaaaattttatacaaatattgaataaatgagaattttttaatttttaccattattttggtttaaaataaacaaaaaaaaaattattattttttgttttgctggataattataattgacttataatagccctatttaatttttaataaattttactattaattaaatgttcactttttaaaatattttaaaatgaataatcatcagctgttaacggtaaaaaaggtttgtcaatgtgcgtgaatgtcaatttgtttttt

SEQ ID NO: 27219 - DNA, 1288 bp, Heterodera glycines
caagaaaagtgcatttgtttcttttttttggaaaattacattttatataaatatttgtttttttcccaacgctaattttaatggactgatccatccagattaatccaaaaaatcactcgcaataatggatgatcttagactgaaaaataaattccaaaatttccattggtgtatcctttttagggatcaaatcgctatacctaaatctttttagcaaatctttaattaattttctggaattaaagattatgaaagatttttactctttttcccctattttcctttgagctattttcgactttttggaaatttattttcgtcgtttgcgctcggaaattttagatttcaatgaaaagtttctttttttttgaagaaatttcatttcattaaaaaatggtcggaataaataaagtatatcaaagaattttttgtcaaaaattttaattggttccttttatccatttatttttatgaaaatttttttgttggaaaaacaaaatatttatgtttcaaatcacgttttagatcagccttcaccttccggtcatcgacaaatttgagaacaatttgatgatcaatgaccatgtcatgcaggtaaatttggtggtactttacttaattataatttatttaattattaattattgaaaataatatttacttgttttattgcctcaatttttaatttaaaattattatggaaggcactcgaccggtcctaatttgtcttctggtttttaacagattgccaaaataaagcagctaattttctcatagatgtttaaaattgtctttaattaatttttttttgcattttccgtaaaatttctcctttcactatttattcaaaatttattaatttttaggatgggggaaggtataaatttggtatttctcattttcccaaattttcagggtggatgggaggggatgaatatgggatttcccattttcatgaacatacaatttcattttttattgattcaacaaactaacaacttctaaacctacgggcctgattttttagtattttcctgaattatcacgttgattcctattcttaactggtttttcttagaattttcaaagcttttcttaaaaaattggcgctccacaaggaaaaaaaaagctaatttttgtatctttttccatagattcgcaatgtccgtttgaacttggacaatctgcaacacgaaacagaattggacctaaccgacacaagccatatcaaatcaggagtcggtcaatacatctcggccaaatttgtcgggactaagaaagggtagcc

SEQ ID NO: 27220 - DNA, 1071 bp, Heterodera glycines
catgccgctctcgaccctaactcagcaacgggtgggcgtacagcagcggcaactgcagcattcatgcagctcttcaaaagctgtccgaacatattttctttcttttctaacgcatctccaagcggagttacacccatttttggacccgtattttttgtaccctgatcacattctgaaaaaaataattgatgcgctaaccctaagtctccccagttattctgcgcattgctttctccaacgcgagggcaaagcagcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcggagttacacccatttatggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcggagttacacccatttatggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcgattacacccattttggacccgtatttttgtaccccgatcacatctgaaaaaatattgatgcgctaccccta

SEQ ID NO: 27221 - DNA, 1346 bp, Heterodera glycines
  misc_feature (52)..(52): n is a, c, g, or t
  misc_feature (71)..(71): n is a, c, g, or t
tttcatctgtaattaatatatatttttaatttgtccctttcttggtttctgncaaacccgcggcgggaggnccccgagctgccaaaatgtccacttctgtgtccgcggatccgttggccgctcctccgcccgcgccttcttcgcttggggacgattgcggttgctctgtcgtccgctccatctgttttgccgtttcagttccgcttgtcgttgtcgtcgatgccaatgtcggcgttgtggtggtcgcagccgactgagtcccctctccttgacctgtgttttcggcatttccatttgactttggcattttctcgccttcgttggccttctgttcctcttctccctcctccgtttggtgtcctccgttctcttctcgcgttatcacttcgaatccttcgcttccgtcgttttcctccgccgtcggacttctgaactgaccaatttcgagttcgtgctgatgctttggttgttgttcagcagtgtcggagttggaattcgcctaattaatttatgatttttaattttctattttcatttttgaatttggcactttttctttctctggcattttgtccccctctcggctcatgtgagtgatctgtgcccgttccggctgcggcattttctcctcctctccttcgttggcattgccaatgttaggctaaattaaattgtaattaatcttggaaaagtgccaaaaatgccttttctggagtggctggcgttgtgccattttctgcgttttctgttgggaaaacaatggctttttcttccccttctccgttcgacccttggctttttttttcactttcgcctactaaattatagtaaattacatcacaattaaaaagctcttctgctgatcattttaccattggcactttgcttctcgtctttactttgtgttgccatttgtcccgtcaaagtctaaaaaattatattttaaatgattgactaattagttaattaattgttaattggtcccacttcgtttctctccccactcggcttttcctccccctcctcccgttggatttgttcgttttggctatcgttcagttcgtctaatgctgcgattccatgatggtcatggtgattagggttgtgttctgctaacgatccaaatttgctgattattgctaattgtttctcacttaccattttctcccattggcttcgtcgcgttttcctctgccttctcttctccctccactttgaatgggctgtcgtcttctttctcttcttccgcctcctctgtctttctctgctcctcctctgtcctttctttcttttctccttcctttttcccactctctccttcctcctccttctcattcgtcgtgtgt

SEQ ID NO: 27222 - DNA, 1035 bp, Heterodera glycines
acaaaataatccttttctgccgccatttcctccggttgctttcccatactttgcattacttaaatttgtctaattacatatttaaacaattaaaatttaattttatttaagtacatgaaattgcttcgtcatttttttgaagtagttttgccacgtggctcattactggagcacccaaaaaggcatcaagtgccgaactcattgagcactcctcaatgaatttggctaccagttcaagtgcctcagtgtcttcagttaggacccagcatgaatgtgtttcgttatctaattttgaaaattttaaatttttggcactatttttatgaatcgttttgtacaaaaaaatggctttatttatggtttttttattcgagcacaattttgagaaataaattcaattgtaagccctgatttaaaatcaacatttaatgaattttcatttcatattgaaaagttaaatataaaattattttttaaatttatgtatttaaattgattatggttcaaggtatataccgtatttttctaattatccacccctttctgaggagattgaaaaataatcccccatggtggataattagagcaaatacggtatgttatattcttatttaaagattgatttttttttcatcaatgtataatctaatccaagtatttagagaatttcaaattaattagcataaaaaatttaacttctaaaaaattgttttctcaaaattttaaataaatcaagtataccttctttccattcaacaaaatatattctttgcagattgtttttcttctgataaacatacattgccaaaattttggagattgggtattttgggttgtaacggatctttttgactgctccgtttatgtttgcatcggcagaatttttatttgaatcagatttagtctaaatcagtttatttaaatttcaaattcaataatttcattgaatatttctatagaattagttcattttcaaaatatatattatgttattattagggatgcgaatttatataagaaatttgaaaataataa

SEQ ID NO: 27223 - DNA, 1686 bp, Heterodera glycines
  misc_feature (421)..(421): n is a, c, g, or t
  misc_feature (1651)..(1651): n is a, c, g, or t
aattaaaaaaaggtttttttttgacaatgatatttcaacttccagaaatcttttttgatttttattttattacaagaaatatctatttttcagcgacttaacatcaatattcatttgatattaaatgctatatttgttcttaatttattatattaaaaattatagaaatttttaaaaaatagttggattatataaataaattaacttatttttaaattttataattaaaattttaaaataaaatttttttgcgagtttcatttttcttttttgtctttaaaaggtttttcaatattttcaagagaattaaaatttaatttgtgtaaagatttgacttattttcataaataattttgcaatactctttcatcatagtgtttgataaaacggaaacgaaaaatgatgagcatgaataaattanagcaataactgatgaataaaataaaaataaaaattcttcaaaaagttgaatcaaaaaattaaaatttattaggattcataaaattcgagtggactcacaaactatgattgaactcattaaataatcgattggacttataatgtgcaatagagccgtgatttttatcaaattaatgcttttaagttgtgttttcataacttccgaataatcaaactattatttatttttaaaaatttatacattatattgtaaaataactattaaaaaacgattctaaatttttaattttaattccgagtccatgtagctgacccgggccagacccggatactcggctttttctagacccggtccatgggaccttgaccgacttttaagaatcgaaaagccgataaccgacccgattggaaacggtccaattgaatctataaattaaatttattttttttaaattaaataattttgtaatttagcttaaatttacaaaattaatttaattgattaaattttaatattattttatttagataagacaagaatttcaaaacctttttcagttatttaattaatttaaactatatgcggaatctccaaattaaaatctttacattatttaatctttattgaaagcaaaaaatgttttttaatttatcaataaataaataaaattaccaatgattgctacagctttttaaagaaaaggacggactaacacattcgacaagagtttcaataaatggaaaaacaaatacttaggaaaatatataattaataacactccctatctaaagatttgaattaattgatctaaaattgtcgaattttaattaaagtaaactagtttaaaaataaaatcaaaatcaaaatttaaaaaaaaaattttaccgtttaatcttgcagctttattaaccgaaattaaaattaaaataaataaaatcccaaaattataaaaactaattgaaataaatgcaaagaatatttaaataaaatgcttttattcattgagaagtaatttatatattaaaattaaaaaattttaattctatttcgcactttaagcttttcttaattttatgctcgacatataaatctttatttacataatcagtggccaatcatatcaaaattacgaatgacgaaagacaaattttagggggaggggatttcaacgccgcccttaaaactgtcgtctcagaaacgtcccagaaaattaaccattttcatccacanaattttatttcatttttaattccatgtgacctgca

SEQ ID NO: 27224 - DNA, 2227 bp, Heterodera glycines
ctcaacttttggctggcctatcttcaagttccctcctcattttcaatatcgtctaagttgttggttgtagtggacattttttgtactgggatgtgttcgctcgaccctggcacggtctaaatcatgtcgaacagcatccagatttaggtcacccgtgttggacatggaggtgagaccacgataaatttcttgcgggacaagtaaaaatttatttgccatctctgttaaatgaataatggaattcacaaaattcaacaatgatgagaggtatttatgcgtttttgttcacaaaggattttgccacttccattagaacgggtgtcaatagggcagcgaacaatccgccaaatcctgcgcctttctggacaagcactcgcttggcaccccgttcacttctcgctctgctgattcggcgtacagtatccacataaggcattagtcgcttcttctgtctggttgtcagttggaagcgcgaagcgacgagattcaaacaaatttcgaccagcgatagtagttgttcagtgtttgcttttcgtataagtttcctgcatttttttccggatttcgtcttggccaaagcacacaaccagtcgcgattctgttttatcagctctccaatctctacttgttgctgcttatgccgctccatttttgggaatgaatacaactgttccttcgtcttcgccctcctgctcatccttaaatatgttggttcgcagccgtaatgacggatctgatgcagcgtgcatatcaattagcaaatagccatagggacgggcggtcgctttgcgataagcatcaaggaaaaagtcgagctgacgcggaaagagttggacgccaatgttgcgaatggacaacagggaattaggggcccgcatcagcaccaggtactgagcggacaggcgggccactttgattttacgttcgaacaaattttgagtgacgaacaccaccgcaaattggtggtgatgtgactttttagtgaacaaatcggacaaatatttctcgtcgatggacagcattaggtcatcgagaatgagcaagaggggctttgggaggcgtttgagcaattcttcgggtgggactcccgaatacacatcgactcccgccttttgaagcggcggcactgccgaattcatttcaccaaaacaatagagcattgagacgggctttggtgtgattaattgatccgcttcagcaataaattttaacaaaaattcagtttttccagatgaggaggggcccgaaatgattagaccaaacggcaatttaaaacaaatatctttattggtaaagggttgtgtattaagcattttggggacaaaatgatttacatgtttgaggtcgaagctttaatactatcaaaaaactcgtcgagcgttttgtcaatgtcgccaaggtcctccttgtttttctcttcgtcttttctgggctcttcctggacataattctgttcctccacgggactgtttgtcactttgttgtccaacgattccgctaaaagtagattcccgagtacactgattgcggttttggccttcttccaacgcacgccgtcctgcatggcatcgggccattagcccggcttccactaaatcaagtgctaccttagctttgcgcttcaggtcctgctgctgcatatcggtttccgttccttgcgttgtagtggtggtggtggtgggagtaggagtggtgcacgtgtcggagggcaggtcaccgtagggtacgttgaacaccctggccttgtttttcacacggaagaagcagtggcccggcagatcataaacggcatcaaatgggacgaattgggacttgctgacccggctgcaccacaaggtgatcccctctttggtcaccattgtgtccacctcaacctctgtagctttacatgcgcggcaacggccgcattcatcgaacggaatgaaccgtggtgtggacagacgtggcccactcacggttatgccgcttgttgtcactgtaatgtccgcttgcccgaggatttgattcacaagcgctttcttgtcgcaaatattaattgccatttttattttggagaaaatttttgagaatgaaatggaggacggcagattgaccatctgcttatatacagccagccgtctgtgaaaccccgtccattttaagtttcaaattgcgcaaacggaatttttaaaaggatgagcactcttaacagagccccgtgtgagtgcgtcgttgattgggcactcag

SEQ ID NO: 27225 - DNA, 1273 bp, Heterodera glycines
aaaatatttattgaaaatgccaaaatgacgacgaaaactcaaatttttcgtgttttgtggggtgtaatttttaaaaatttccaaaaagttgatctttaggggtgtattttttgtttttttttcatttttcttgtgaaaatttccaaaaaatggccaaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctattaataatgctaaatgtaataaaaataaataataaaatttcattaaaaaaaagtgaaaaaatttttcaaaaggcgcggcgagttgggcggttccctttaccagtgtatttttgatttagcgcgcaaaaaattacgccaattacgctatttggcatttcgagcaattttgtcaaacactgggcctgacccatagtggagccatcatcccaaaggcaattcggtagagaattttgtcctctatctgataggcctacttaaattttccagaaaaattttcccgatttcaagccattttatggcttttcagatcaccatgaaggagcgatctgatcatgttggtccaaaagacttatttgatcagcatcaaaagatagcctagcaggaatttttcagaattttaagtcaacataaaaatgacttttggtcgattaaaaattttgaggcaggactttttccgtcgttttttgagcgaagtgtgatcacgtgactcattctcgggaatgaatgagtcgatcaaaaatgtttttggtgcatgaaaagcgcatatattggagtaattaaaaacacataaactaaaaataatcagttcaatttttaagtctaaattttaatttctgcaaattttatcacgttgaggcaagactttttttcatcagtgtaataaaaatttgcatttctttttttctccttttggccaattttttttgtttattttgatacagaatgatgaacagtaagcattaacagcacaattatggcgaataaaagtatattcatgattttatttaaaaaaattttgcgaaacaaaagggtacccctttggttttttgataatattcaaaatctttcactttttttgttggttttttttgtcattcgtaccatctggtaaaaaagcaaattttgtaacaataaacaaaaaaaa

SEQ ID NO: 27226 - DNA, 543 bp, Heterodera glycines
tcgcgggaattgagtcattctcggtggtcttattaacgcattttcgggcacaagaaaggcacatgaaatgaaaagtttgcctgcagaacggccttgcgccttggcatcatcatcgccgtcgtctgttgctgcagctgcgcgtgttcagcgctgctgcacgcgaccgatgcggcggcggcgccggcggatgatgcaaaatgcagcacactgttccggcgatggtgagtcccagggacggtcccaggattttggcttggggggggcacctccccccgtgcgacgacctttttttttttttttgcttttcacacccgttttttatgtggcgcggtttttccaaaaaaaatttttgggggacagggggtccggcggtgccgataggcgccgccgggaaaatttttgcggttttaaatgcggtttgttaacagattttgtccaaaaaatgaccaaattttgtgattttgagccatttttagcagattttcattaaaaattttgcggattttttgaaaaatctagcgaacatttcttggaaaggggggg

SEQ ID NO: 27227 - DNA, 1329 bp, Heterodera glycines
atgtcctgatcgggccaatttttccttgtataacaaaaaaagacgttctgtggtgtagtaacattatttggtgctctcattttttggcgccgggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttaagtcctgatcaggccaattgttccttgtattaccaaacgacgacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatggttatgtcctgatcaggccaattgttccttgtattaccaaacgaagacgttctgtggtgtagtaacattatttggtgctctcattttttggcgccggatcttataaagtatctttgcataatgcacaatggttatgtcctaatcaggccaattgttccttgtattaccaaaacaagacgttctgtggtgtagtaacattatttggtgctctcattttttggcgccggatcttataaagtatctttgcataatgctcaatggttatgtcttgatcagcccaattcttcgaagtattatcaaaactaatcgttctgtggtttactagcactttgattatcatcaatatgtcgtttgttatgtcatatagtgttttttcgtcatacactatgcataatatctgatcattttttaatgtattttgtggagggaggtgtagcaaatcaaggaagtacccccagtgttaagcattttgttaagcgaatgtttaaagatttggtcgctggcagcacattgtatccgattaatataatgtaacggtcaacgggattatgtgaaaagaccttaagaaagttcatttatattcacctcatcaatttgtatcatctctttgctggattcaaaatcctgcgggacaagataccattgaaaatttattcaaaaaatctaattttcgagcgcccat

SEQ ID NO: 27228 - DNA, 178 bp, Heterodera glycines
atggcaattgtaaagaattgtggtccctaatttaacttttttattctggactcagattcagtttcctgtggttttcgagggtgctgattacgaatctgaactcggatttgcccaatttcgaaccccggacccgaattgaacaaaaagtagaaaaatttttttccaaaaaataagttaa

SEQ ID NO: 27229 - DNA, 1026 bp, Heterodera glycines
ggcttcaagatttgaaattaaaattttcgtcggatttaatttttttttttttttgatcgggagtgagaaagtttttattttaatttatttttttaaataattgtctagttaaaatttattatttttcgtgaccgaattaaattgtataattaaatttaaatatttttattgacattgagactattttcggttcgcccctactgagacattttcggttcgcccacactgagactattttcggttcgtctcaccacgtgaaccgattgtatttaaattagagcgaagcgggaccgggaattcattaaataaaacatatcactatttaaattattaataagaagaattcattgacttgtgatatgcgactctctcaaactaatgaagagagctttctttcccctaaagttgggattgaaaggagtgcaaagggcgccctgtgtagctcagtggttagagcattccacggaaaggaagggacgtgggttcgaatcccaccgcaggctgatcttttgcacttacgccatccgccaataataccacatggcgctcctgggtggattatcgcgtctgtgttcgcaaaatgaaaactaaaggcctaaattaactggcatgcgacactccccactcttacgtgccggcgtacgacggcatataaaagagaccggggaccggtcttctcaagggccggagatgtgatatgcgactctctcaaactaatgaagagagctttctttccccaaaagttgggattgaaagaaagtgcaaagggcgccctgtgtagctcagtggttagagcattccacggaaaaggaaagggactgtgggtttcgaattccccccgccgaggctgattcttttgccacttacgccgtcctgccgatgaataccccgtggccgcacctgggtggattatcgcgtctgtgtttcgcgtgaaatggaaaactgaaaggcctgaaattaactggcgtgcgaccctctcccctcttacgtgccggcgtacgacgggtgagaaaagagaccggggac

SEQ ID NO: 27230 - DNA, 1121 bp, Heterodera glycines
  misc_feature (42)..(42): n is a, c, g, or t
  misc_feature (48)..(48): n is a, c, g, or t
aaataatttttaaaaaaaaatttatgtttaactataaaattntcattngatcaattaaaaataactacgtgccatttccggcgcctgacaccaatgctctaatgacaggccaaatttgccaaaattttattattaatattaatttatttttattagaaaataaaaaacctaattaaaaagatttataagaaagacatttaaaaaaatgtttcctcaattttctatacccttatcactgtgagcattgattgataaatgtttaaagtttgtacgacacatttgcgcctcggacatttgcgcccaaggcggaaatatacggaaattgaacatttttgttgcccgacttttgcgccaaactgtcccaaaaaagaattcaaaagtttttcgctataaatctctcaagaactttttcttgcgcttatgggtccgaatttcacttagggcttaacatattcctgatattcttatgacaaggaggaaatgtatcaaacaaaaatccaatttttgggcgttctgtcgcgatttgcgaaataatttgtatttcctccctccgcctagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttgatgaaggaggtagagaaaacaatttcaatagagagcgcaatgggaagggagttcatgtctcttcttcgctgattcttttggtaagagacgcagattcctcgctatgttctctattctctctctgtcttaaatctctttccataacactctctttttaattaatttttctttattctctttaccaaaaatgcttttgtatgactggggctgaatataacaccctctcacttttgcgttatctctctccccatcttattttccaccaaaaatcatttttgaaaaattgctttaaattttaaaaaattatccccaattttaaaaatagcgttgatatta

SEQ ID NO: 27231 - DNA, 1431 bp, Heterodera glycines
  misc_feature (1287)..(1287): n is a, c, g, or t
tcgttctgcgtctttggtgcgatgctgtcgcagtaccgcttgcactccgcttcgcccaatttgccaatcaatagttggacttttgagtggtcgctgagtgcttgtccatcctgggcgatggtctgcccatagcgcttgagccaaacgtcgtatgtatgccctaactcagggtcatactcaaatgtcgaaaggcgcgcatcgattgatgtcgccagtgccgcagaatttttgacttgtccctccgatgccttcaaaacagcctccaaaatcagtttaagctgattggggtccatcaaatttgtttagccaaccggcttttgtcgaatttgtcaagccgactcggcttttgttgaattttgtcgagccgacctggcttttgaagaatgagcagttcatttgtctgctttttgacgaaatcgacgagccaacccggcttttaatgaattcgttgagccgactcggcttttgttgaattttgtcgagccgacccggctttttacgaacaagagcagtttattttgactgcttcttgaagaatggccgacccggctttaaaacatttcacagccactcccggcttttcggtggatttgttttgccgtctcggcttttagtcctgaaaacaaaattggaaacctttatctcacccgaagatgtagagcaggttctttgtttgtgactgtgccaaattgttgtgtatttactacaacaataaaaatgttggtttttaaccaaaacaaatgttgtcaaataataaataaattatttatttacaaataaatatgggaggaggacagcagagatgtgcgattaatattctaaaatattttgttatttttttaaaatcttattattggtcaattgatttttgcttgcgtcatcaatgcttttacaataatcttcatttgaaataagaaattaatgtccattaaaagaaaataaaaatttatgtgaagagaattgtataattattccctcctaaatgtacaattcaaaaatgttggcatttttatttgccatctccgctttattatttgtgcatactgtccgtacagcagccagcaaaaaatgtgatggtattcccatctcagagatgattatgttcaagtacaaatcggatttatcaaacaagaacatcgagataagaatggggtttaaaccagttttgcgaaacgaaacggaaaaggtaataagcttcaggggacatgcaaggtaatttgccggactcctctgctggtcgtggcacaaggtttatgtgctggtgcagtttggatggggaataaaatntacaaaaaaaaattttaaataaaatatttattaaatctctccgatgaaatttgcatttttaggaggggtaatttgtatattttttcgtgcttccgctccgcggtgaaaggtttttgcacctttttatatgaatatctatcttag

SEQ ID NO: 27232 - DNA, 1579 bp, Heterodera glycines
  misc_feature (80)..(80): n is a, c, g, or t
gattggggggaaaaaggaataagccaaaattccgggccctggataaatggcctccccaaattagtaatccctggggcgcncactagatcgaatacgcgtacggggatgggcgagaaggagtaaaatatatgataaatattggccaatcacataaaataataattccgccgcgctttgctctcggctctcgctcgccaattaactgcccactcaactggctccttatcgagagaatgctcccgattaaatagtaggacttatggaacgaaaaatggaatggaagagagcggggatatgtgcttgggaaagagatattggattaaattcccataaaatttttcaaaattttacctataaattggctaattttcagtgaaaaactgtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgataaaaatcacaaaatttgatcattttttagtgaaaatctgtcaacaaattttaatcaaattttcaaaaattttcccggcgccgcctgccccctcttcccaaaaagttttgtttggaaaaagcgcgcctcaaaaaagcgttttattgatttttaaatttggaataaaattttaaaaaatgatttttgctttatgattttaactattaaaaagttgtagaaaaaatttcgcttttcgcatttcgcttttcgcattttcgcatattttggctattcgcatttcgctttttttttcatttcgcatttttcagtttcgcaaatttcgcttttcgcatttcgctttttatttttcaatttggcccatccctgatgtgtagttggggatttgcatggtcgaaaagaggcggagaacagggccaacacgaagatgatgccgatgaatactgtggcgagaaaaattcaaatttatttcgacacatccttgatgtgtatggccccagccctgaggagtgtgatgaaaaatgaaaaaagaaatttaatagaaaatatttgaattaaattttttcataattttttgttttatgtataaaaaagtttttatcaatttttggcccttaggtcctgtaccaaaagaacaagtttaaaatacagaaattcaatttgtgccctcttatgggcctccttttagttaacaaacatttgtttattttgctaaaaatttgtgccaaacccctcagagcattcttttggccttgccaatttgtcctcgctctttggcttaaaattttatgtgcataatgatttataataattttcaattaaaatttatttagaaagaaataaatttatacaacaacaaaaaaaatataataaaaattatttcacttaatttttagttcaaaaatatgttaggaccttaaagtggatgattaacggtcctaatgcttcaaaaaaacaaagtctttggacgcgagaagagacccaaggaaaatgaaatagaattgggaaattataaacacttcca

SEQ ID NO: 27233 - DNA, 905 bp, Heterodera glycines
taattttttataaattccaaatctcttcacaacacgatagcttatctaggtagcgaatctcaagaagcgcgaagcgctttatcccagtcccagatccgacggtccacgcacccgctagtttccttattattttagttaactatttcaaggttttccgacttatttggtttaaataatttttttctaaaatagtctctgtaaaatccgaaatctttgtatttccatctgtccaactgaataaattggcatgttgtaaatgttaataattttgtttaaattttgaactttatttaattgctaacatcattttataattttattttgcaattttagaatttattttgattttaatgatattataaaataactgaaatagttcttgcattaagtctataataatttcaatatgaacttctaattaaaaattaatttaatatgaagtgtttgaaaatgttttgcaaaatttgcttatttctcttattttctcacgagtaaatccgtgatttcgtctgattcatcaatattgttcataaaccacatagtaaggcatgttattatttttttcaattttatttttatatttaattattaaatttaaacctttgtattaattcaattaaaaaatttacagtaagaattatttattaatttttttttgaatattctttattatgtagtactttatttttattaaatgaatgcaaatttttaatttctataaaaatagcaaactgattatattatgttattaaatatattatatccgcaatatatgttattttaatattgtacattaatcaattaaatgaactataattagcactatttatatcaactttttaattattttttctttgaaaattttttattgtttaataaagaaagttaaattatttaaaatcaaa

SEQ ID NO: 27234 - DNA, 1559 bp, Heterodera glycines
aaagggaaaagggaataattcagggcccaaagtgcgcctgaatcgataattagctttgcaccatcgaatattacatataaattagccctatcaaatttcccttagggcctcagataatgactatctctttttcgaccacaatagtaccgatcaaagcgaaaatgagttaattcaggcagcaatgagcgcctgaatctctaaatatcttggcactttggaatgttgcatacaaattagccctcttaaattttccttcgggccccagaaaaaggctatctctttgtcggccacatcatgttccgatcgaagagaaaatggctcaatcgaggtgtcaaagaatgatctaatttccacaatcggggcgcaaatgttcagtcacctctcggggaagcttctttcttcttcttctctatctcactagggttgtctattttttatgagttattttttttaatattttcatataacaaattaaccaatcattcgccacatttttacaagcaaaatcaaaattgtaatgtgcgtgtaaattgatgcaacagcagcaggaaacggaaatgagtttggttgtccacgctttttgtcatttgaacatttatataaaaatgctgcaaagtgatgatgatttgtttattatatttattttttaattaaataaaatgaatttccaaatttgcttgcttctttctgtgcttctttcttatgcaatttgtggaaaaaatggcaatattttaatttaaaaattgtttattattcttttaaagcaaataaatttagacaaaaagaaggcaacagtcaacaatgataacaataaatctgtcccaacaatgacaaaggctttgcgaatattaacaaaaattttagccgcggtaattagtttcgtttaaaattaattttcatttttatttttattatagcaaagtgtcattggcttggctaacggttcctctaatcatccttgtcaatctacaaatgtagcagataaaaaagcgtgtcacaatgctttaaacctaattccgagtcaatgtaaattttgcataaaaaatttgcttaaattgagaattacatattcagacaaaaaaaaaattgctgaatgaaatcattatagatggaaaaagacaattttttagaaaaattatttttgtggtttttttgacaaaatttacctaatttatgagaaatatgtttttgatattatgagaattttttttagaaacttttctgtctttatgggtccaaggagctgctttaatagaagggccgttttaaaagagatttttttttaaatttacaattctgcagataaaatgtgcgcgaaatgtctaatatctacaaatatgcaaacaatgcatataaaaatccaacccaagcaaaaaaaattttttcgtgccttttaaactgtatccaatgcagaaaaattgcatgagtaattccaaaacctacaattactctttatatatatatatatatatatataaaaaaatatttttaagctaactttcgaacaatttattctattcactatgaataaaaaaatgccaaaattgatgaattttttt

SEQ ID NO: 27235 - DNA, 658 bp, Heterodera glycines
  misc_feature (625)..(625): n is a, c, g, or t
aattttggtacgattttattgcttattgaagagctagagcccgaagaaaattttttaattcaagcctaaactttttggcatgtttaaaaagcaaattaaaaattttattcatctccctttttgatagtaaaagcatcagagagccttatttaacttgtaaataacttggttgcgtttaagagcactttctgaaaaaatatttatgaattaattttgcaaaaaataataaacagtgaaaaactcagaatttctaaaaaaatttaaaaccaattacaattgtcattttttcaggttaagttagtcctgtaccggggagtatgcctataaaatttggtacgattttattgcttattgaaagagctagagccgaagaaaatttttttaacttaagcctaaactttttggcatgtttaaaaagcaaattaaaaatttattcatctccctttttgatagtaaaagcatcagagagccttatttaacttgtaaataactttggtgcgtttcagagcactttctgtaaaaatatttatgaattaatttttcaaaaaataaataaacagttaaaaactcagaatttctaaaaaaatttaaaatcaattacaattgtaattttttcaggttaagntagtcctgtaccggggagtatgcctataaaatt

SEQ ID NO: 27236 - DNA, 1313 bp, Heterodera glycines
gaaaactaaaaataaggtttgactccgctttagatgtcaatgaccgggtcccattcatttttgggcttttttcagtttagcgtcaagtcaatcactcactatgcactacgccagtcaccaattttaggtattagaatggaaaaagcaaatgagactaatgaataggaggaggagaaaactatgacattaattaaagtgagtaattaaacataattagtgaccataaattaactaatgaggaggacgaaatttgagcccggacttttgaaaaattatgagtcacaggatcaggattaatgaattagagccagaaaagatgtttctggataaaaaatcctgttttcgagactgactcctgatccgggtcaaattttcaaatatatccgaattagtattaggagtcctcaaaaccctgacaggaagaaatggccctgatcagtggtatatagtcgaatattcactttaatatttaaattttattttcttttaattctttcacaaccgaagaacgctttcccaaaaccttcgttttaacgcccctatccgaccctagaaatccctattttggatgttcgcccctaaaaatccctattttgagtgttcgcctctaaaataagtttttatccctattttggcgtttcacccctattttcgcccttatttcgcgatttttgggaaatttatttagtgagcgaggcttttggaaggacgaaatgcgaaaagtatgcaggtgaaaacagccctcggcaaagcattgcttttgcggccgaatttggacatgttgggcctcgtggttgaacacattgactaaagggagagagggcgaatagacggacggaaagcattcatttgatcactgatcagaggctaatgaatgctaatgagttttgagtcatgttcaaaactcgtacagaatagccgagacgtctcctcaaagattggtggattgaatcgggcctgttcaaaaagtcaaataaatttagaaaattcataattaattatttataatttaagcaaataaagcttagaattggactcggatcctatcagaattttcacaggattctacttcttactcagctttttttgaaaagtgcaccaagattaggtagggtccagaaaaaaaattcgagaaaggcaaccgaagagctttttttgcatctccagtgttattgttttattttttcagcccaggggcgaaaaagcaggattttgtaggggtcaaattttcaaaaaattattgtttcaataggttttggcgggtgccgacatgaagcgtcgggaaaaatttttttgaattttaattgaatatg

SEQ ID NO: 27237 - DNA, 1153 bp, Heterodera glycines
  misc_feature (27)..(27): n is a, c, g, or t
  misc_feature (1064)..(1064): n is a, c, g, or t
  misc_feature (1072)..(1072): n is a, c, g, or t
gagttcgctgctgagaggacgccccgnagggtggtttaccacctccagtagaaagacagagaaagcgaaacgagagaaagaaaagggtctttctttctctggctaaactctttcacttttttgtttctttgtcctccctctttatttgtgcacaaaccaaaggcagagaaggagagaaagaaggaagaaagaagagataaatggcaacaaaaagtggcaaaaaaatatatagaaaagaagaaggagtggagagagaaagggaaaaagatggaaagaaagaaagaaaaaaagaaaggaggaagagagagagaagagcagaaagagaaggcgaggaaagtcaaaagaagatggggaggggggcatttcacaatgggaagggagggggaagagcttaggcagctattttctgtgggaaatggccgccattcgcttgagttaattaggcccgggtgggtccttttccaaaatggctaaaaagggagctaatcatcggaattcctttaggaagaccaaaaatactttggccaaattttgttaatttcatttttcattcaaaaatgatttgtggtcttttaatagaaaaagatgataaaatgcatacagtcaattttggagtgcattaagtgcgatgcgttgtgatcatttcgcattttgtttcgacactccccccccccctttttttgccccttttgtgcaatttctttcgctgctttttttatattggcctttctttggagtgttaaggccaaaaagtaaaatggtgcaatgaaagcaaaagaagaagaagaagaaagggtttttggggagtttttttgggccatgggagagcaaagaatgaaaaaattgggtggtagggagggagaaatgatcagtttgagtcccgagggatcattaatcactttagatagacagcccgaggcaacgacgacgcttaatggccccgggggacactgatgaagttttattgggacgaaacaaaaacctgtccatttttatcatttaagttatctcttatgtttaaaaataaataaaaaaagaagaaaaaaagggggagatcgaaatgngctattgngaggacagagaaataggcaacaaaaaaatgaaagaattgaaaatggacggggagatgggtataaatgagaagaaaaaatgc

SEQ ID NO: 27238 - DNA, 1360 bp, Heterodera glycines
aaacctggttagaaaaaagggtcactcccaagccaaaatctcgggaccgtccctgttcaacataataaaaaactaattttctgacccgtgtaaagcactgccattgcgttgtctccattcaattcactcaaatcatccgcataaatgaagttgagcatcactttgaacacatgcgcatcgatgtcagtgacttctacgggacccttcgcttcaaattaaatttttttttttaaatataaaattttttgttgttttttcacaccttctccacccgctgattcattgtcagtcgcattttttgtggtgtcaaaacggaacatcgcttcaaaaacgtccgaagccgaattcagaatcgctctgtgcgcgggcacatgcttaaagaaaacaatattaaattaaaattattaaatttgtaacaatttccccttaaaactcgcctcctttccctctccttcccccaccaaaaagagaacgtccgcgtcatcgcccgagctcaacaaatgcttcatccgctccaccaaagtttcgggttttgacgacatttgacaaaaaacaaatttctgttaaatatgaattttagaaaaaaaggaatatattatccatttcatccatccgttcatttagtgaaggttaagggtgccgcggtagcagtacgcgaatcgcgcattaaaaaaagcataggaattttttatccaattttcacagattttagacgacgttagaggatttctgatctggtaatactgcagatggtccccacccctttttggaaaaaaaggttttgaaaacatgttattggagttttagggacgttgatctcgaaaatgccattcattttgaccaatttagaatgccagacaagaactcgaaagtagaaaattccaaattttgaaaattcacaacgttcgtaccaatgcatagagctctgaaattccattttaatgtattttcgcgtttgctgagaacaggagcttacacaattagtggctcgcaaatttggaagcaaaaagaaacaaaacaaaaataatagacagtaaaacataacgccacaatggatttaaaaaaaaacaaataagctgtcctgctgcgctcctgccctgtcctgaactgtaactgtgagaccgattatttaattccaagggctgtcaagtcaagtgtccttatttctctagcatttgtccttattttgttaatatttagtaaatgaaaatatctcaaattttcttaattggttttttaaagattaaattagccatttttttgctgcaaaatgaaagtggtcgcgctggtgtcgggcggcaaggacagctgcttcaacatgatgcgatgtgcggaggaagggcaggtggtctgtgtggcc

SEQ ID NO: 27239 - DNA, 1227 bp, Heterodera glycines
acagcgacaatgccatcggtcatatctgcagtggcggcggcggcggtggcatcatctgctgctgcttttgccgatgttcagccacaacaaccgttttctggtagtcggttttggcaatgggaattaattagttaatttattagactaattagcaagacggttaattaattagcgatggaaagtattactaaacttatgtagaaaaaaatctttccaatcacgtaataagccctttctccgatcagtttccggcaccaccccttcggtccctatcggcgctgcgattagcggcggcaccggcgccgcagtcgcttcgtccgcctccggtgccggcggcgcccttttgtcgtcgtcaaaaatgcttggctccgctggcggcgccgcgtcggcggtggcgtcgcgccaccgacgcatcaccacggagcggtcgctcttgccgctgtccacggacattgcaaagaaccgcgagttctaccgtacccacgacgtgcgccctccctacacatacgcctccctgatacggtaggtgattacggtgggagtcaaaaaggtttccgtaaattgcgtttggctctgatcaggatcagcagcagatttaatgaaacaatttgccgggttaaatcagaggcccctggtcgggttagacacaaagttcaactttttggaaaatgcgggatttgcgtgattttgcgggattggtccctgcgggatcccgtcccgcaataaatttgagttccaatcccgcagtgggacccgcaaaatttgaaatttcctggctctaactgtcagatcagacgaaaattcacccaaaattccccttttttaaatttttgtccataatattaaccgcttcaaccagccaattggatttccatcatttgtttgctttttgtttcaggcaggccatcaccgagtccaaagagtgtcagctgacgctcaacgaaatttaccaatggttcaccgacacttttgtgtactttcggcgcaacgcggccacgtggaaaaacgccgtacggcacaatctgtcgctgcacaaatgtaaacaaaaacgaatgaatgatgtgccatttttggggctctttgttctccccgagtgtttaatcattcccgaaattcgcttcccgaattataggaaactgtagaaattatttccccttactcgataaatttttgtcataattcttcacgcgttcattcccgacaattatgtagccccaaataaatcgt

SEQ ID NO: 27240 - DNA, 1444 bp, Heterodera glycines
gaagagagaaggtcgaaagaagggagggagaaaagggagtcggcggcaaaacaaaaagaagtaaagcggaagatcccccggggtcctgcaaaaggaaaacaaaaggaaagggaaagaccccctggggcccgtggggtctcttcggcaagtccccccccccccccgctgcttctgtccgtggtcattttcctcgttcataatttgctgattgtgagtcacctatttctttatttctcattctccgattctcgttcgtcccatcagagaatttcaaattcttcccaaattcgtttttcacttccacctaccctttcttccccctttttccatcacttcacttccgtccgtcgtttcttttccgatcaatacaaaaattcaaccgcaattgaagacaatgataatctccccaaaatccatttttaaatgtcgaatgtttgccttttggacaaatgaaaacagaaaaaacccactccaatgagaaagagacggaacgacggaagggaattgggaaaaagtaggaaaaatgggacggacaattcattcgctgattatcctttgcattttcgctggaggggaagcagaaaaataggaaaagaaaaagggacaaagagaaagggaagagaaatacagcagagaaagagacaaattatttattcaaaaggaaaaacaaacggagaaaaagtaagaaatttcataattaataaataatattaccattgatcaccagtgatcactcgtcgttctgtttcgatcattcgatatgtccccccatttcgttcgtcggtccatctcactaaatttttttttgtttgaaatgggggaggggataacattattaccaaaaaatctttggatcccaattttcgggccatgggttggcccagtcgttctcgtccaactcctcgccctgttcctccccctccgcttggggaggcggcggtggcggcgcgtgaatggctgcatagattttcattttttggaatatacaaacaaaactaactgttttgcaaatgttgaatgcgcgcatccatccaattttgaagaccccgctcaaatacgggctcatcagggaacggaggtccaattaagacaaaaaagaaaaggacgagcaacaaaacatcgattagtgagggcatttgtgcggaaaagttttgctgaattgggaggggggggggcaagataaattgacgaaattatgacaaaatgaagaaaaacggactttcaaaatgttcaaaaataaaaatgctgttttttacgattattcgttctactcgggggttgccggggccgctgatcacgaatatgacatcagaattgtcatatgacatcatctaatctatgatttttcgtcaagttttttttcattttttaaatttatagtcataaaattgttttatgaggttatcggggtcgttaatcattaatatgtcatccatttcgacca

SEQ ID NO: 27241 - DNA, 835 bp, Heterodera glycines
attagccaaaagggggggggggcacaatcaatcccgccataagaaaacaatcatttgactgcttgccgaatgatgaatgaccaataatggacaccctcccctcccctcctcctccaccccctttccttccctttttctgaccgcacctgtccaagtgcccagaatcattgctcctctttttgtgccaatggtcgtcccccgcccgggcacatccgccgcagctgtgcaacccaattagccacggggggggggtaacagaaggagtgattggacgaatgaatgattgtgctgtgttatgggtgtttggcagaatccgattacattgttagcagtgccattatccccgttaatccgttcgtcaaacattcgaattgaaaatgctttttatttattctttggcgctgggccgcccgaggcacaaataaataagcaaagccccgccctgggcattggccattcgttttgatttgcgcttttattctcatcgtctttttactattttctaattcatttatagcaaaatgcggcccatttttcggcatttcgcttcagttgcggcatttttattcgccatgcttaatcaggtgattatttaataaggcggaaaggaataattatgcctaaatgaattttattttttatgcgcttggatggttcaaatccaaatgatatttggccctttcttaaatattgccatttccgacaaaaaaccgtaacttttcttagaagaaataaattaaaacatttttggcattatttattagctaaattttttaaatgtgtttacaaattcaaaaaatgaaattatttccgctaattgcgtataatttaattt

SEQ ID NO: 27242 - DNA, 1613 bp, Heterodera glycines
tttatttattataagttaatttaacatttcaataatttaaaaaattattaatacaacaaacttattgataaaaaagcatatgaaaaagtcagattttttccctttttttttgtaagtcgcccaaattttcattttttgtgaatcgaccaaccacgaactgatctaatagctttaatagttggactttaaaaggggcggtgctagataggcaaatattcaaatatttgcaaatccctctcttgggctatttgaccccgttattggtttgtgccccttttaaatattcccttcttcgcttgctttgtccacttcctatttgtgcccctctattttctgctacgtaccagggatggcacggaattccgatttccgacatttttggggtcggaattccgatttccaaaaattttttgacccccggaattccgatttccgaaaatttttggggccccggcatgtcatccctgctacgtacctctgacaaataattgtttttatttccatttattttcgataattactattactgttcgacttatacattgtttgagcaccacaaccggctgaacatatgtatttaagagcacgttggatccaggaaaaatgtatttaaatgaaatttagatccctagtcattaaataatgcattttctgttgttgcattgatacatttcttggagtaggaaggatgtgagaaaggatccaagattaaacggcatttatatttttctattttcaaatccatttcaaaaatgaatggaaacagattaccgaagaggaaaaagatggttgctgcttcttttcccgttttggtggtacataaaatccgatcggtgtttgaccactactgttgccgatgtttgcggatgattgatccgccgataactgaatgtgaaggaaaagctaaaaactcggaattttgagtaaaaactcatgtttcggaagcaggtttttcagaaatttctattacgcgcactacctttgattttcctttcttttttcgcgcagttgtcgcactcgcttctggcgaatttatgctagaatcataaagattactttcacaatatataaatttaaagtaatttattttatttccattaaaattacatattaaattgttgctgtgtgttcaaaaattctacttgcagtgaatttccagaaaacaccttaaaacaaaaataaattaataatttaaacgcagggacggggaggctatttatgcaaaagactgagtggtcaaagaagggatggggcataacaaataaatgggacggaatgccaacataataaataaatcaaataatcaggcccatcccgaacacctcccccttaaaagagtgggttcttatcatccgggcgtatatcggtcaggcggacgccgatttcgcttggatctttcgtgctgaacaatcggctgaccggcgcgttcttcgatgatttcgtttggtggctgtggctgtcgaaccaaaagttggttcgcatggaatcgtccaattgatcccgtcctgaaaagtgacgtcgtacatcacacctttttttctgggtgatgtgcccgggtcgccatcctgcgacagtcgatgtcgggcgtagacatatcgtctaagtcgaacgat

SEQ ID NO: 27243 - DNA, 710 bp, Heterodera glycines
ttcataacaaatcgaagggttgatcaattttacaggaataaagccttaaaaatagagaaaaatcaggagaattttatgggatttatttgggttttctaacatcaatatgaaaaaagttattccagaaattctggaaattttagatttttcagaaaaaaattcctaattcccttctgaaaagtgattctggaaatgtttaatactacaaaaatccgcaattttttgctctattatataaattttatttggcatttttatcacttttttgagagatgttacaaaaataaaagtgattttgggattcgggaccaaaggggtgagcatacgatttttgagtgaaaaagttttttcgtcaaaaatcgtcaaaaaatatgtctttaggggttatttgggccgctgatcacgaatacgtgatcagatttcaattatgacatcgttaagccctcagaatccccgtgtgagtggggattctgaggcatcatttgaggggggaggagggggggggggggaaagttcgaatccgggcggtgtaacattatttttctctgcatttttacgttgcttctcctattcactttaagtacctgtattttactgttgtacctcttctgatcacttatggaccgcttttaatcacttttacacctcaactaatcacttgtacctctcctaagggcgaagggcccgtctatgccaacaaaatttaaaaa

SEQ ID NO: 27244 - DNA, 1483 bp, Heterodera glycines
  misc_feature (6)..(7): n is a, c, g, or t
ctaccnntttttggaggcaaaaatttacattattttgacaaaaaagagcgcttttaatcgaaatgggttaagtgagtctgaaaattgttaaggacgggttaactaactgtgcaatttctgagttcatcagctgaagcattcactttcattttcttttctgtcgtttttttctaaatcattttccattttcggtttctcttttctgtcattttttattttctttattttccattatttataaaacatttgcaaaaattgattttgaattcttttccttgaaaagaaaaagctaattttatagcaacaacttgtaaagcaagactcgaatttgaatagtgttgtttctttcgcttgactacaacactttaaagaataaactttaataaataaaataagtccgcaagaaacgaataaaatataataaataaaaaatagatgacagagaataaatggaaacggaagaaaagaagcaaatgacatggtccgacaacgtaccaggtgttttcgacagtgattggtttcgacagtactttttaattaatttctacataaattattgtatacatgaattagtattaatatataatttgcatatacaaaatttataattgaaggaagtaataaaaaaagatttgtataggattttttgtcaaaatttatcgttttcactttttctatataaatatctcctgattgactgtagtcaaaaatacaaaaatttacttacaaatcatgtgcgaacatctgctaactaatgtcaggtttgagtgccaaaatttaataatacttataccattagaacatttaaaaaaataaactttactgtcgaaaccaacactgtcgaaaactaacagcaccactgacaaagtttgtgtgttcggtagggctgtgcgagagtctcgattcccgactcgggaaatttctcaggtttttcgcttctcggtcttgggtttttagtctcggaaacccagaaatttttacactgttaaggatggtcattgcggggaaggggtcgccagcgaagggagaaaagaggaaaaattattgaaattttggacaagtttcttaataaagttcattaaaatcgcaaaaaaatttcccgttggcgcctatcggcgccgccaggccacaaaattcccctaagtttcaaaatgtaaagtaaaaaactagaaaatagttgtgctaactcaaaaacaagcttagtttcccggctggattttgcacatcatttcccgcactttttcagcctgaaaaagggcaagcgcgcccctaattctattttttcaaacccattcaaacctttttacatcgattcagaccgtttttaagcatttttgagtttggggcctatgatcaatattctttattagcttgcaaaatttcaaaaaattatattaggttttaaaaaagatatggcgcgctgcgccaaaatggccaggaaaagtcaattttttgaggttttttggccaataacttttttgtt

SEQ ID NO: 27245 - DNA, 839 bp, Heterodera glycines
atatttgttacttttttggatttgatttttttgatttaatttttaaataaaaattttcaatgagtgtattttttaatgagacatagttgtaattagatataaaaaaaattgacatataaaataaaagacatgtttaaattatttttaatgtgcactatgcgaaataattaattaataattttaatccttcttccttataaataatacacgtattagtaaagttattttgcagctaattaatagtaattactaattagctaacaaaaaaatgtgtgggagagaaagagagaaaagccaatcggcggatggtgaacagaaaaagcgcagcaaacccaccaagacgtcggacgacaaccaaaactctgtgtgatactctcgaaaaagatgaagcatgaggaagacggacgcataagcgaagccattctcgaccgaccaaaccggttgctcacttttgcatttgcatcggtgaaaagcaaccccgaggggtcagccccagcagcaaagttggtggagcagtcgaaaagggatggcgaggaggacgagattagatttttgaacaaccgaactcattcagaatcagtcatggtgagggggctgctggggaatttaagaggattttagatttaaatttaaaaacaattaaaaattaatttgatagatggattgaaaaattaggattttatgaaaatgatcttgattaattttatgcttttttaaaaaaacccacaatttttttcattcgttttcagcatatcattaattattaggtgaaaattagaaaattattaatagcaaatttttatgtaagaaagtaattgggtccaaagtgtcaataagaa

SEQ ID NO: 27246 - DNA, 1273 bp, Heterodera glycines
  misc_feature (976)..(976): n is a, c, g, or t
  misc_feature (987)..(987): n is a, c, g, or t
  misc_feature (996)..(996): n is a, c, g, or t
  misc_feature (998)..(998): n is a, c, g, or t
  misc_feature (1018)..(1018): n is a, c, g, or t
  misc_feature (1030)..(1030): n is a, c, g, or t
  misc_feature (1037)..(1037): n is a, c, g, or t
  misc_feature (1039)..(1039): n is a, c, g, or t
  misc_feature (1041)..(1041): n is a, c, g, or t
  misc_feature (1049)..(1049): n is a, c, g, or t
  misc_feature (1051)..(1051): n is a, c, g, or t
  misc_feature (1055)..(1055): n is a, c, g, or t
  misc_feature (1067)..(1068): n is a, c, g, or t
  misc_feature (1074)..(1074): n is a, c, g, or t
  misc_feature (1079)..(1079): n is a, c, g, or t
  misc_feature (1084)..(1084): n is a, c, g, or t
  misc_feature (1094)..(1094): n is a, c, g, or t
  misc_feature (1098)..(1099): n is a, c, g, or t
  misc_feature (1102)..(1102): n is a, c, g, or t
  misc_feature (1106)..(1106): n is a, c, g, or t
  misc_feature (1110)..(1110): n is a, c, g, or t
  misc_feature (1131)..(1131): n is a, c, g, or t
  misc_feature (1133)..(1133): n is a, c, g, or t
  misc_feature (1139)..(1139): n is a, c, g, or t
  misc_feature (1141)..(1141): n is a, c, g, or t
  misc_feature (1153)..(1153): n is a, c, g, or t
  misc_feature (1166)..(1166): n is a, c, g, or t
  misc_feature (1168)..(1168): n is a, c, g, or t
  misc_feature (1170)..(1170): n is a, c, g, or t
  misc_feature (1196)..(1196): n is a, c, g, or t
catactttcttggtattaaacaaaagctttaagtctcgagaatttgtaaatacaagaaaagagcaaatactggcattaagaaaaaaacttacaatgagaaaagacgaattttagtttttttgcattgagcccagatttaattaggtatgcgaaacttctatacttcaatagacttaaatcttaaatcttttgtttaataacaaaaaactttggcattgacgaagaaagaaaaaagttggacattgattggaagcatacactgcaattaacccatttttgtatctcaattaaatttgcatttggcatatggttgagttgcaagtgtattgttttatctttatttaaaaaaacacagttttagccatacttagtacataatattcatttcatttaaaatgaaacgttatcgtgcagtggatgttccgccaaaatttcgccgaacagcgaagggccgtaacacacgcctgggtgattccgtctacttcagcaggttttttatcagtaaatgatcaattcaaagtctcaacaagaatggcacaaaaatgtcggagcacagttttctctgtcaaatcttcaatttatcaacctttttgaccaacccgtattcttttcgctgacaagggaggggcgagaattgtaacaagaaaaacgcattgtgtcatatataaataccattgaatagagcacagagtcaatgggtagaaaacaccatcaaaaatgcatcacctaccaagaaaagtggtatcaaaaaatgggaggccttccaaagcaaagcaatacatcagctgctaatttaaaagctattctcgagttctttataatggcattttatgaatccaaccaaattaaacgtttacaaaataaaagtggtacaaaacacccacggatttggactcataaaatgtaatgcaacacaatttttggttggaaatgggcggaattaagcaacatagagtaactccatttttaacaacanatatttttcanattttttancncctacaacttattctacctnaaattctttttnatgtggntntnttccattncnctcnacttcctcatcnntttccnttttnaactnctttgccctntttnnctncttntccnccatctctacaaatcctttcntnttcacncnttttcctcctcncttcattattccntnantttatttatatgtccaatcaaagtcnacggttcaaaattcattaaacttttcggttcttagggaagcgaaaattcaaatttcgaaatttattttatgtttaaa

SEQ ID NO: 27247 - DNA, 966 bp, Heterodera glycines
agtgcatggcacacctggctgggcaccagtgtagaaagaatatggtggaaaatatgtatatcaatgagattataccatttactaatctctagaaaaattcaggcataactaaaaaagtcggggatttatttaatttcaaaattttcaatatttttaatcggtaaaaatctaaaattattcaacaaaaaattcattatcgactgtaaattttcaaattaataaaatttgattgtcatattctgcaaaaaattgtaaacataaaaaaatcttctataataaaaaaacttacaataatcaaactgaataagttattatggtattgcaaataatttaaaatgaccaaaaattattagtaaaaattgcataagatcttaataaataaaaatgagtttcaaaaataaaaaattttgcttacagaacaaagacagtgaggaaaatgttaaaaaaaaataaaattaatgcaaaatttgttttatcaacatgaactactcccggaaaaaaatgaattattaaacggtgcctaatggcacatcagtgcaacaaaaggctatttaaagtaatttttaaaaattttaaataaaaaaaaaacttagttttcctaatttttcattgaaaagatattgtgtgtattataaatttgccccactgagtgagttcatttcaaattattggcatcatcactttttaatgcctgctcatctctgctggtgatgaagaaaagaggtcatcccttttccaaaggcaaatcacaaagtctctatttaaaataatgaaaatcgtggaattaattatcattatgtataattatgggttaattatttcattatttacattaattatcattatacataattatgggttaattatttcattatttacaatctgtttttttacattattggatgtgatgatgtccatctgatttttcgtaatcagaattatttttcagactttagactattgaat

SEQ ID NO: 27248 - DNA, 1101 bp, Heterodera glycines
tttttcccacccagaaatggtctcggtttttcaacccgaaaattcccggtcccgctcagttctactttcaaaaattggattacgaaaccttatatatttataggcaaatagacatttgtttcaaaattattattaattgtgccgaagataccaatttttccttctaactactatcagttcttaaaaatttacaagattcttagcttttcatctttttttctcttagatataacaataaaaattttacaaaaaaaaaatatttttttttttgggaaaacgcaaattaccgcctttctcgttcgcatttagaacgacgataactgctagtggaggggggggggggctgccgaaaccaatttcatacaaatgtccaaattccctccgcgaaattttgaagaatttgttgtgacttgttaacagattttcatcaaaatagcccgtctccggtctctatcagaggtcatttttaattcagacttcctaggttttggaactcgacttttaactttttggggttttcgtatcccctaccttagacttccaaaacgttgtgcaaaaattcaggttccttttcgttaaaatgtgatttgtacatggcgctaaaaaccccgaattaattcagtctcggttgtactactctcagagttttgcgcagaccagattaaaataaaatgcatattgtagatgtcgaaacttgcctatcattttttttggtttttgaaccttatttattttcaatgaattcccacggaaaacgaaccaatttcaagccaaaacttttcaagctctattaattggtaatatttttagaaaaaattattgatttttccggaaattaaatttttggcctagatggacatttcaattccagcttttaactcgttagggcttgatttagcaaaaaatcgtatcttagttgggtcagctcggcgaaaacattgatggcaccgaatgataccaaactgttaattggtttgagaaaagttgatactagagtagagcgggaccgggaattttgggcaaaaccgggaccgggacttgccgggacctgagaagccgggaccgggacctcggtttttgtccgggactgggaaccgggac

SEQ ID NO: 27249 - DNA, 1847 bp, Heterodera glycines
aaaagaaaaaagcttacaacaccttcgattcccaggacgtctccgttccaagtactaagaaggcccaacgttgcttaacttgccagatcggacgggatggcgtgctttcaacgtggtatggtcgtaagcgaaagggatccaattgaaaacaattaaatagtccatttttaatgcattttttctctttggttaacttaatcaaaataaggattgttaaagaatttagaattcacttaaatgaggtaaaaataaaaaagaaaaattcgacagttttttcaaaataaaagagcaaaaatcggaattttgaattatttttttaactaatttcccaactgcaaatcggcagaggaattgaaaatgagttatataaattttgcgattcatcacaaattctcataaaagtcatatatataaagggatgtgctccgaaattaagacacttaatcggaatttgcattatccctgaaagaagaggcaaaagaactgcccgattccttaaaaaatgatccaatcaaaacttcttctaaactggtcgaagctttgatcttgctttaagagctcataagctaattgcaaatctgttgcaacaaaaaagccagagaaggggaggggacagacgcgattttggcaaatcaataaaaataatgaaatattattaaaaacatttttattaaaaagaataattattatattattacaaaaagacaacaaaaaggaaacaaaaagtgcttatagaaagaaagccattgaaaaccataaaaaagcattgacagttcaattaaacacaaagatacaaatacaattttactttggtttgttttcattaatttttccctccctttaaatttatatttttcgatcttttgtcatttcgctcatcttttcttcaaattgctcccgtaatgactttattcggctttcatttgttccaaaatgcccttccctttcttcaaattcgctttttcccttttctccatttgttttggtgcccttaattatttgcttaaaaccctcaggaatgttcatttggtcaacaatttcttcaattttttgcccaaatgttggcttctcattttccaattccttctcatttagcaatttcaattcaaacgaatttttgaataaattttccaatttattttcgtttttttcgccgtttttcgtgccgaaataaaaggcccaaatttggcacaaactgtccaaaacatcgacaattgttgcagcctttttcgagttggcaatttgaaaatttggccttaccgcggcaatttgttgcgccaattcggggtcagaaactttaatttttaaattttttaataattaaattatttttcaaatttcataccttcaatgtacacattgaacaaatgtttatacaaaattgtcaaatatttcttaaatcgttcacattctttctgccgtttttcctgctcaatttcgtcgcattgccatttatctctcatcattgacacagcgccaaaataagcgctgtatttttgtgccaaatattctacagtacctccaatatcgtacacaccattgcccctacgttgtgcgaccaattcaatgttttttagaagcttttgtgtctctaattttttacacaattgctcaaattccgttcgatctttcaaaaatgtgagaagcatgacgtcatcaagctgaattcggtcaaaaatttaaaaaaattatactaattagttcgtacataactgccaaataaaaaataatgccataaatttttgggcttttgagctttaactctcaattatttggttaacttgtaatgaaaatagacagttttttttacgataacggcagaagatattatataatatgactctaga

SEQ ID NO: 27250 - DNA, 1613 bp, Heterodera glycines
  misc_feature (6)..(7): n is a, c, g, or t
  misc_feature (19)..(20): n is a, c, g, or t
  misc_feature (26)..(27): n is a, c, g, or t
  misc_feature (41)..(42): n is a, c, g, or t
ctgcannggtcatttggcnntcgggnncgttctgtcaaaanntcgcccgtgaaaatcacaaaatgaagtttttgattggattgcccaaaccttaaatccttaaccaatgaaaatacacaaattaaaaatcggaatattctattttaatgtgataatataaaataaatttaaaattcacaaccgcgcaaacttaaagtaactaaatatgatttgaaaaataagcttttgtgattaactttttctgcagtgcgttgattgccaaccacaaaacacgttctccgcctccgctcgcgtcacaaaacgggtgaaaaaaggcaaaactgccagagaccctaaaatagaattttagaaagccgaaaaaggtgtttttaggaaaaaatggccaaaccaaataatttaaataaattttaaaaatccaacaaaatcaaaatgattaaccagcccctcaaaataaagacaattagaaataggggtattttaaatttttagattggtcactccaaataagcacaaatcttacagagaataagtacatttgcgagtcccgatttgactggttttatacattaatgcgaaattcgtgaaatttggtttttcgatagttcaaattcagttccgggaaaacattttaaaagaaaagagaacggaccgccttcggttaaagtataatcgggaaacagcgacgacaatcagaaagggaaacagagggagaaggacaaaggacagaaggaccaatggcattgattcgaatgctgtaaaattaaattattttggtaaggccaggaaaactctattccaatttagtcgtccatcacttttagtttttttagggatgaatttttgagaatttttctattaggggtttttttccatttttattgctggacacacactgtgcaaaaaaccattgcttggaaaaaggtttcctcatcgtgatctttctaaaatccagtatgcaatttggttggcaaaaaccttcaaaaataattttcattttttaatttttgatttggacaaaaaaaatacattaatgtcgtggagcggactcgaacctccactgagcaatcatgaagaatgggggatttctattttgtttattttcgagttaaaaccagtttttgggcgatttctggttgtcgcaaaatgtaaaagtattgaaatcctagcgatcaacagttcctaattgtgatacagaaaaaattgacagacgaaacaaatgagctgtttctaaatttagaaaatgcatagcattatgttttttaatagattctttacacagcgtccgggaaatgagctgctgtaccagaaaagatttgcatgtgtggctcagtggtttttgtaagatagtaaagggacaaagggtggtggttcgagtccgatgtgcaacatgaatattttcatttatttttgtccaaaataataaaaaatcacgatatttgggaattatttttgaaggtttttgccaaccaaattggataatcttggtatctttcgaaagctcttgataatgagaagctttttctaagcaaatgctaagcgatttggtgtaccagagaaaagttatgaggctttaaattttgtttttcttataacttttgaaatagagcattaac

SEQ ID NO: 27251 - DNA, 1314 bp, Heterodera glycines
  misc_feature (32)..(32): n is a, c, g, or t
  misc_feature (45)..(45): n is a, c, g, or t
  misc_feature (81)..(81): n is a, c, g, or t
  misc_feature (106)..(106): n is a, c, g, or t
  misc_feature (214)..(214): n is a, c, g, or t
  misc_feature (1256)..(1256): n is a, c, g, or t
  misc_feature (1268)..(1268): n is a, c, g, or t
aaaaaaaaaattttttgatttcgctgttttgncgctaatttcaanaatgatgaaaagtgctttttgtgttgtctgcttttntatcgccacatacagtatggacaanagtataataatagtaatcaaacagtatcacagatttttttttaatcgagataaggttattttaggggttacagggtcggagaatacgattcagatatccatttcgacncaattccgaacccctgacgaacaaaaatcgaaaattcaaattttcatattcgcatttttggtctaaaactggtttaaattttttattgaaacatagatgaataatttagtttgtttcctcacatttaaaccatttcagaccaaaaatgcgaaactctaaaaatttgaaatttcgactttttgttcgaaatcgggtccatggttaggatttgggtcgaaaggatatcagaatcggattcgccgatcctaaaaacccataaaatgactttaatctctagaaaacaatttctttttttcgaaagggggggggaaccattggcactattaccgggctctggctggttaaaagtatatacagtaatcaaattctgctagtctaattttggtcgaacacttctaaaatgaaaaatgtttttaaaatacctaaatgataattgtaagcaatttgacgcatatgaaaaaagggatacttacgtaaatttatttcagtggtataaaacaaagttggaaaatattgatcataggccccaaactcaaaaatgcttaaaaacggtcagaatcgatgtaaaaaggttcgaaatgggttggaaaaatagaattaggggcgcgcttgccctttttcaggctgaaaaagtgccggaattggagtgccaaactcagctgggactcaagtgaccgcactataaaaagcactcaaaagacattttaaataatctttctatggtaattttttttcgctgatcacgaatatgacctttattttgcaaaattccaaaccccgaacccaaattcgaacaaaaacttaaaatttttaaattaaacgaaaacatattatagggggttttgaggttgctgaacacggttatgacatccattttgaccaaattcgaaccccgaaccctaattatgagcatgttggtcctcaaaatcattaaaactattttaaactagcagtcagaaaatggtaaaagaacgtcaaatataaaagattgactttagcttattacgctaaaaaaccgccgcacactcgactacgcgcaagntaaaaggtgggnccgagactacgggcctacggaagaagtccgcgcgtgatccgcaggc

SEQ ID NO: 27252 - DNA, 1075 bp, Heterodera glycines
cattttgctcaattacacttcatgcatcgaagcaaaaatagcatattcgcttggttttatttatgaaatttatattaaattaaatattttttgctgtttcggccatttcgaattgtttagtgccaattttcttttatatttttagactgccgaaagccgttcctttggcattctgttttcccacaaaaaatattgccaaattcgactttggatggtcatcattttccttttcgttaccgttttccatccgtgccatgccccgtgggcaacaaaagtgccgaattaatttgtgtcgatggaggaaaatggcgagccatcggatgccaagaagaaggagatgagaatgaaaattatggtaaaaccgtaaaacattaataatcattaatttgttattacattagcaaaaattttaattttcgcacatttaaaaaataataatatttaaattaaaaaataattctaatcactttttttgacggaatgccttctcgcccgtgtgttgtgccccgcatcagaaatggcctcgtgctcgatttgaatcgtaagcttggcattttgcgcttccgttgcaatttcgggttggcatttcatatgttctttcttcttttagctaatttttttaaaatataatcatttttagttttgctccattggaagtacatcagtcaatttgcaaatcgacgtcaggcgaatggatcccgaagccaaaatgtgttggtaatgtgtataattgtcaatttaattccaataattatttttaattttagcgattcgttgtgccttccctccgcgcattgcgtcgccaaatttggccaatttccctccgtctgatcgtttcgtgtcggcaattctttctgcttcaatccccaataattcggacatttccttcggcactttggtggcatatgaatgtgccaatgggacggtgccgaggggaggacaaagtgtggcacaatgcgcagcgaatggccaatggacaaaggtggcaatggcatgccaaagtgagtgaatggaagaaaaaagaggcaacaacaaaaagaagaagaagaaggccaaaaacatgcctctgaacaaa

SEQ ID NO: 27253 - DNA, 1589 bp, Heterodera glycines
  misc_feature (1561)..(1561): n is a, c, g, or t
aaagttttattattaaatttatttatttttatttactataaattcactatgttattgttaaataaaaatttatttttatctcattttatttgctttggcaaattaatttttccatttaaatttaacccttttttgattagtcaattattagctgttaaatttatttctattttgattataataaatttaattgtgttttttgaactttattaattatctttttgttaaattattaattttattattatttttcgttaaattatcatcttttaaattcttattttcttttccttttttcaattcacgacaacctagcagatctttatttaattgctgttaataggatgtctatcatataatatattctgcatatttaatcatttttttcattccttttaattaaactatgtgagtttatgaacagttttaacataatttttcaagaaaattaataatttctgaaagtatttatatattttccaaattattttaaacatttatcaatcgtttattttaaatgtcccattcattttttatagtcaaaattaatcaattatttttaggcttatttttagtttttatactctgaccacgaagatcgctaaagttgtcatttttagttaaaaaatttgctaaaaattgaaaattctataataaaaggataaaataggtgaaaggttagtgtttgaaaaaatgaataattgaattgtcgtttttattgttgatggggaggggtcgcattggtcgggtcaatcgccagcaaataaattgatgaatggcacggcaaaaaaggagggcataggaaggcgaaggggcaaacggggcgtaattagagacaaaagattcgaaacaatattcataattaaggaaaacaaacctaaatgtgtatataccaaatatgggtggcgggacaatttgttgattattgggcgaatttaattagagaaaaattatatataatatttaattgtttccaataagttttttttcgttaccccctaaaaaaatatttttttggctttttttaaaaagctttcgacaaatttattgatgaaaatcatagatacaaacatagatttttgcagtattgatcccagattcttgcttacaaattagtgcctaaaattacaacagaaaagtgctttcatttttgtcgggatcatcacatttttataggggtacgacataacggaacttttaccagtccttcttcgcaatcgccatgaaagaaatgcaaaaaaatcgcgaaatatgcagaataaactgtggaaaaaagtttgtgaaaaactctttcatagttcactttaacatctgaaaaaattcatgctaaaataacttttgctgcttaaaaacagatgattccttcacggtgatttcgggacacactgaaaaatattgtaaaaaccgagaaaagtttttgtttttctgtaagagtacaaactaaaaagttgtttttccggcacaaagggagtgcatgggaaaaggaggggagaaaaggaaagcaaacaatggcctaattagggagcgaaaggtggcaggaccattaaggcgcataataaangcatggaagtgtcacggaatggcacggc

SEQ ID NO: 27254 - DNA, 1515 bp, Heterodera glycines
  misc_feature (61)..(61): n is a, c, g, or t
acatttgctttcgctgatgctcacttcggagcgtccttcagcagtgccctcaattgtgtgnacgtggacaatgtgcttgtgaaagtactcgtccattccctttcgtatacgaaacttcaaagctttcacgatccgccacttctttgagcaattgaattgggcttttagcagacgaagcaaggaaaaaatgcgttcttgggtcaagcgattcatttggatgcaatgtcaaaaggaactgatgagacaaacggacatttccctgcaattttagttaattgtaagttattttcttataaaagggaagataatttataaattaatagcaactgtccatctatacgtttgttttgacgctttgccttcggaacaggacaaaattttgccgctgaaatttcgcagagacgaagtttcaattgatgttggaaatttaaaaaaaaaattcggtggcgaaatttggggtgtacccccctttgcctttggggtttcattgctttaactttagttttttaaattctttccgggggagacgagttgctccccttttcctttggtggcctttcgtgagtgactcacctcctcaacgtcttccgtctgtccgttttctcccttccgttttttctttttcaatgccttctctccgtcggcgttttttctctttttggcccttttcacatccgcccagcccatcttcaccaacacttcacataacactgctgcacaactgatcttcgccctttgttttgaggttgcaattgcgccgtgatgaatttctccgtcgaataacgataaacaggcgtaatgtctaaacaaagtctgtaattttcttagagttgcttttatggtaacttacggtaggacatagggaagtgtgaagacatggaaatcgagttgtatttgcgatggcatctgttcattgttctgctccattgcttcggtggacttttttaattcctgcagcacaatgcatcgcttgacaaatgccattgggttgttgcccatccggcactgctccatcttcgcctttgtttcctcgctaagatcaaattggcaccaaaaagcgttctgagtgtgcagtctgaaggcggttgagcgcagtcgagcaaaaacttcactttcattagcggccgatgggagcggattaaggcgttcgaagtccttaaatgtttttttaattacctatttgccgaagttagaaatcagtgaaaacgtagaaagtttgcctttttttttttgaaagattgttcaccttccgaatggcatccaagtcgatgtcatcagagaatgacaagtgcatgttttcctgctgttgactttgttcgacattcgctgcttttgtcggaattggctttggcggaattttcctcactttccgtccggacaaattgacacattccagctaaaaacaaaacaaatgtacatttatttgttggcttaaggttggtcttcccgactcgttctttctgtcatccaaatgctcagaagtcgcaatgcgcaagcctttttgggctccttttt

SEQ ID NO: 27255 - DNA, 2087 bp, Heterodera glycines
  misc_feature (62)..(62): n is a, c, g, or t
cagcaacaaaaaacatttatcttgggaaatataaatcatcttttcagctctttaataattantgccggaggaaataaatttatgaaaaattttctctttttttctttaattcattctgtttcttttcatttcgtggtatttctgtttattccctgtttcacagatccttccttggacagcttcgtgcccctttgtcgctttttgggccttccttccacgctccccgaacttttggctggtgtccaagtggaagatctttttcaaatgtttgtccatcttcattttgctttgttttgttttcttaaacattatttgcttgtccatcctcaggtggtcaatgcatctgccgcagcagcgctttaagcagtgccacggtgatcagctgatcggcctgcaacttccgctccgattgaatgtgctcatcgatctgccggacgattactcccaactgatcaaaatgacggtcaacttcaggtgaatgttttgggaaaataaaatgcccaattcttaattttttttaattgcccagaaatttcgacccctcgagtttttcccttcgtttttttgttatctttttgaataatattgattttatcagatgccccgagatcaaagagttgactaacacagtcgcgacactttgtcttaattgcggacaaatgctttgtgagtttatctctttgattttaatttacttaatttatatttttttaggctcacaaggctactgttgccaaaaagtggtcagtccacacgaacactaatttaaaggcttatttctccatgacgattttccgattaattatcttcaaaattaatccaaaattaattctcttaattttgttaattgtctttgcaattttgtttctataggtcaatggtcgtaatgttggtgcgtgcaccgcccatctgagcaaatgtcgcgggtcgtctggcgtttttttgcggtgcgtttccgaagagcgaaatcttttgaaaataattgctttgttttcccgccgcagaattcgcgagtgccaaatcgtttgtttgcttgtgactaacggtggggagctcacccgcggctgcttcaaggcggcaccatacgttgacgagtttggcgagactgatcccggctttcggtccgtacttttacaaaagccttacaattagccctctcacaaaaatgctttccttcgcttcagtcgcggcaacccaatgcatttaaatcgtgagctttactggaggatacagcgcctttggttgtaccaagaaattgcggaggaaatcatcaaccaatacgagctcagcagcaaccgcaacatcggtaagggaattagaattagtcaatttgctaaatgaattaatgctttgggcttttgagaaaacccattatggaagaagtttaaaatttttcgcatgccttaattcattttatttctttgcttttttgcagcgttcgaatggaataatttctgaaaggcatgcatcgaatgatcaacaaaggcgtaaaactaatgagaaggatgaagtgtataatgtgattcgaatttttattatttgaatgccaatttgcaaatatttggcttgtgtgttctgttacaccctaatctgtcagggaattatcggattattctctggattaaagcttttcctcatgaaggtacactagaaaaagaattagacacctgtgtatacttaactttttaatagaataattttaaaacatctcaatttaaatgcaatcgaacaacaaggcaagggccactttaaagcataattgcatccaaaaaatgatcaatgtcttgccaatagatgaaaagcattcggctctagttcagtttatgcatccatcgacttttatacgtccaattaaatattttcattaaaacaatcctttaaacatttaattgggctccattgcagtttacccgaccataaaaaagaccaataatttgacgagtttaatgtgttataacttttttagaagtatccaaattaaacattcttggtgttattcgatagctctaagtgttctctattagcttgataaaattaaaaagggctgttttatagtctaaaagccgcaaaaaatgaataaaatggat

SEQ ID NO: 27256 - DNA, 1476 bp, Heterodera glycines
  misc_feature (784)..(784): n is a, c, g, or t
cgcgtttaatcgatcaaattcagttttgagggggtcttatttgtggctaatttgctttgcaatttgtgcccaaccacaaaaaacacctgttgctgctgttgttgttgctgcgcaactgatgccgtcccgggcgataaatatgccatgctggtggtgcggatgcttatgctgacgaggataggtaataaatacaaatggtacctacatctgtaaaagtcttatgacaacataaaataactacttactcaagccctagttaaatttttccagactacgatgaagtatttcacaatgtcactgatgcatcatcgactgcactaggaggacttttactgctccatgatgccgagacgcgaaaatcccaaaccgatcatcaattggcacgatggctcattgaattacaaaattatcaggtcaaaattgtccacgtggcgggaaaagccaacactttggctgatgcactttctcgtgccgctgaagacaagcccttgtcggagatatacaatgtggatgaactcgaggaaattatcgaatttccggtctgtctcgctttggcagcacattccagggtggtcgcggacccatttttgcacactttgaccatccgacacgaggatggaaacacttacgaagttaatttgttggaagagcaggcaggagatcctgaagccgcagcctacattgcgtttgtcagagatggggaatttccagctgatttggatgagaaagaaaaagagttatttggtggactcatttttgaatcacttcactcgtctctttttangtggtggtcatttgaattacaggaaaacaattgccaaatgcaaaaaatatttttggcccaaatgtactctgacgttttaacttgggtcaaattgtgtgtcacctgccaattgagacacaatccaacacccgcgtaccgggaagagatgctcatggtggcaggcgacacactttttgccaaagttgggctggacttggccggcccctttccagtcactcaaaaagggaataaacacattttaaatatcgtgtgttggttcaccaaatatgtgatttctgtcccggtccccgacacaaaagcacaaacaattgcccacgcttttcttaccaattgttacttaaaatacggtggttgtgttgaattaatcaccgataatgcctctgcctttacttccgaattttttaaggaattttgctccatgctttacattgacaaaaagtatgcctgtcctcattggagtcaaggcaatgcgtcaactgaacgcacttttcggacatttcacaacatcttggccaaatacatttcgaagactcagcccgacttcgatgaatttttggatgctgccaatttttgctacaacacgtcagtgcatgcttcaacgggtgagactccattttttcttatgtttgggcgtgacccaattttctgtgttgatcagatcattgatccgaaagttcgtgatccgatagcca

SEQ ID NO: 27257 - DNA, 774 bp, Heterodera glycines
actagggatgcaatttataggcactaaaaaccgccaaaataggtaggctttaggctctaaaaaatccccaaaataggcactaaaaatcctcaaatttaggggtgtaaaatgacaaaattttattcaaaaagcaaaaaatattatgccaaatcattattgagattcacattgcaaataagtaacatttcaagattttcgggcgatagacgtgagcgattgtcagtcaaaatagatttgtaaattgaaaatgatcgttcaacatcacatgaagtcaagggagcgtatttgtaaagtgaaatcagattggggggcataccgaaattgattttttgaccagaaagaatttttccaatatcgcaaattgtatcaaatcccgggtcttcaaatataaatttaaagtattaatttccaaatgcatattccttaaaacctttatttgacatgcttgacaataaattatctttgaatcagttgtgtaaacatcgttcatgtaattggaaacccattttttgaaaagaaatgcgcgggacgaaggttcttttggcatgtttaacactaaaattgaatattaatcactaaagaattctaaacaaatatttttaaattaattaagcaattccggattttattttccccaaagatttccgtttttattgcatttttgttaacaaattttgggcaaaacgccaaaataggcaaaaataggctctttcaaaattttttaggctttttaggcgctaaaaataaaagcctagaaaataggcactaataact

SEQ ID NO: 27258 - DNA, 1595 bp, Heterodera glycines
  misc_feature (15)..(15): n is a, c, g, or t
  misc_feature (1518)..(1518): n is a, c, g, or t
  misc_feature (1534)..(1535): n is a, c, g, or t
  misc_feature (1555)..(1555): n is a, c, g, or t
tgtgaatcacacaantttttggggcaaagcaaattcaagcagctaatattcgttacttgtacctttagtaaaaaaatatcactcggctccatgcacatcagctgagagtgagcgtttgttttggcggctaaactcattgtgacagatttgagaaaacgtttagcagaagaaacgttgaaagaactcctttttcttcaacaaatttgcctctttatggatttaaattcgaaatttaattgaattttattttacataaattgtttgggttacaaaatattttttcaaaaacttcggcttcggcttcgaataaaaattgggcttcgccttcggcttcggctactaagccgagctttgcccacccctgcttctcatccctatcccccccccccagcagggatgtgcgaaaatcacaaaaaaaatttttcgtatacgcgaaacgaaaaagggcattcgacacgaaaacgaaacacgaaacgaaaaaagaaattttgaaaaccgaaaacgaaacacgaaaagaaaaacaaaattttgaaaaccgaaaacgaaacgaaaaaactttggtagacaaaaacgaaaacgaaacgaaatttcgtccatccctgatccccagtagtactcccaaacaagattcatcgttttgctaccccaatatctctctgcacaaattccaccaccaacgggttactacgaatgtctattgcacctttaggcgtccattttttcttttttcttataccaacattcttggattcaaacgaaagctaaaagtttatagaattttttctttacctaaattctgggcttaaaagcaacaaacaaaaattatttctctgaatgtagttgaaaaaaagcaattggacgccaaaaggtgcaacagagcccgtacgacattatgccactacttttttcgattccgcaacattttttaattccgacattttttccgatgtttcaattgctagcaaatttggtagccaattggttcccttaaaaagaagtttttattcaaattttatgattttttagtacatattattttctgtgtacaaattattattattattaccttctgaaggtttgataaaagttcgttcatttccgttaaaccaaaaaactgcttgaaaaattcaggattttctgcgcctttacattcaaaatattcttttagcttttcatcacagttttgcaccgttagttcgctttcataaattgatctacttaaatctaaaagtacgatttaaaatgattaatgtattttggtgccatttaaaataactcaaaatccttcgaaaacaggcaattatagcctttttcgctagaacattgtagccattataggaccgaatttaaaattttatggaaatattaatggtaattgttatgaaaatttcctccttcccctggcgacggcttggaaatttacctgttctaattttggcacgcatagttttggcatttttgatgaattcatccatttttcctccatcagtgttgtcgctgcccttggccattttttcnaattgctccgccatannattttgttgttgcaatcagnttattcagtttcgcttctttttccttcaaatattcacaaa

SEQ ID NO: 27259 - DNA, 2028 bp, Heterodera glycines
acttatttcccgagccgtttagatgccctgtcgtcttgtgcttcatgggtggctgtgcgcagctcttcaggtcatagttagtttaaaattttaattttaaaattgattataatgcttttcctcctacacctcccctctgaactcacgtcttccattctaactgtatgcataatttctcctcacttctctgcgctcaatttttctaagcgtatgcgctatttatcctttccctctgaatgcacttaacattttacggtatctttttctgctcctttctctgctaaattctcctaagcggatgctctatttcttttataccctctgaacacacttaacagtttacggtatctttttctgctcctttctctgctaaatatcctcagcgtatgtgctattctcttaaaccctcccattgaacttacacaatgacttatttttctttctaatttctctgtataagcaattataaaaatcaaatatatttagattcattttaaaatggaaaaccgttccctgaagcgccctttcccattttctattgacgaaattctcggcacacctccagccaaaaaattacgtcaaggtttttggatcaaccaattgcttggtctcgtgcaacagggagagggaagcgaaacatcggcatcagaaaagttgccgactaattttgtggagaaattgggtagcagcatcgaacacaatgcaaatttcacttcaccaaagtgaagtcgcgcttcatcatcaaagacttacctgctgatgctgaagtacttctttcctgtatactcgaacactgcattgacgaggcaaagatgaacagccgagaaaagcgttgtgaatcaactcacctcggttgcttgatcagtggtccattgcttgatggaggcgacgtctttgttcctatccgtccaataacgactaacactactgacagcataatgaatttattcaccaaaattgtgcaatcgaaaaaacaaaaaggcacaacacttttgggtgaaccgtttaccgtcactgtaactacagtcgaccgcaacagtcttccgtcaaaacggcatctgaaagggggcgcaagacgacgactggcacctgttcaccatcaagtatatgagaagtgtttgatcaaggtgaagcttccatcttatttattatatcattgactgtcaatttaagatccataaccctgacgagcgcaacttttgtctcttctatgcactccaagcaacaatggtagcgaagacacgtggatggccaagtcggaagttctacgactacatgcatagtcgagcaagtcaacgtgggaaatttcatcaagacaccgaggaattgatgcggcaaatcagagctccactggacttggacgcttatgacgctgacacttatgtgccattggtcatcgatcattggaacaacgcgcagcggcagcaacagcaccgttttgcggtttccatctttggggaatccggccactacaagccgctatacaaatacggccacgacgactacgatacgctgttggctctgtactttagcaacaaccattttgatggcgtgcattttttgagtggtcttttcgctggcaagagatactgtatatcatgtgaacggccatacagtaaagcaacgatgcacacccaatcatgtaaagcgcactgcctcatgtgttcgcgagttggccccacgtttccatgttcctcggatgatgatggcttcttcaaacaatgcaacggatgcagcaaaagcttcagaaacagcagctgctatgaccaccatctgcgttccaacttctgcaaacactccaaaaagtgcaaagactgtggaatcatttggaatgtggcggataacaacagaaaagggagagacggacacgtttgtggtgaaaagttctgtcatctttgtaacaattttcacaacattgaacgcggctgtttcatacaacaaattgagaccagaaaccaaatgaagccgtaccgattcattgcttttgattgggaaaccatgcagcatttaccaactgatccgcttcat

SEQ ID NO: 27260 - DNA, 255 bp, Heterodera glycines
ctattcggtttgtgtgttgtgtggtggcgtgcagagccttcagagggatgggacggattgtatgcacagactatccccttttctctctttcttttctcgcactatctcgagaattatttgtgtctgtccttttgcctgtgtgcttatctccggaacgatctttcgtttgccaaaaaatttgggacggagaaaaggccaatggcgttaattctgctttgatctatttggaaaatgtggagaaggggaggggggggg

SEQ ID NO: 27261 - DNA, 805 bp, Heterodera glycines
atcaaagattatcgcttctcgcacaatttgagaactgcgtacggatgggagaggaagcccactaaatgccatagcatcatagaaaatgacgtctcatgcctcgacatgttcccagaattgtcaaagggttgaaaatgcgattaaagcctccgttccgactaattaccggcacaatgtgcgcaaccgggcgaacgagatttttacgagtcccattttgagtagtccgtctgataaataactgggaccactgcaaagacggtcctaggattttggcttgggcgtgggggataccgccccgggcgacaactttttttttttttgcgtcgcatttttcaaaaaaaattgctgaacaggagctccgccggcggagccgatagataccgccgaaaaaattattgcaaatatagtgcaatttgttaatagatttggtcaaaaaaatgccatttttcgattttagcattttgtggattgcgtttataatttttaaaattttttgtaaaactggtggtgtaggtcttggagggggtatcaacaagaaaaaaccgaaaatattatttttcccttaaaaatttcggggttttttttggagggcgtcccaattaacagacaaatgaaaggcaatccaatccatgccctttgggttcctgaagacaaagaaattacctttcaggccaaaatcgggcactatgttcaacgaatggaagtgcacgcatctgttctaactgttgggccaaagctcgaagttggccagctgtccccagatggaaatgattgtcggaatcgaattgagtcggtagagaattgg

SEQ ID NO: 27262 - DNA, 1097 bp, Heterodera glycines
tccctcccacttttccttcccccctttttgttttgaccttctaagatccgaccggacaatgaattcagtccattcgccttttccttccttccgttttacttctccaattcatttcacccaattttttgcgctattttcagcaaagaatggaaattaatgaaataaaagcaaatgacagacgaatggggggaaaagcgcagccgaaaattggggtcggacgtaaagcgaagcgacaaaagcacaattaatcacaacacaaaacaaatacaaaacaataaatatattaatggattggaaatgaattaatcgctctcattaaaactcttttgttggaggtaacacggcattttaaaatgggcaccaaacaatgctttaagagaagacaacgtggcacaaatgccaatgagcagagcaaaagctaaagtttggaatgggcagattatcatatgtttatttgggttttattttatgtactcacttattactgtaccgtacagtatcccttttgcccacagaatgaatttgctgaaattgaaatttacaaaagtcattccaaccattttttgatgagaaatgcaaacctttgcctttgttcgttcatttcgtgagaaaaattggaaagaacaaaatgaaaaagaaaaggcaaaatgagcgcaaccaaaggaacggtggaggagccgacgaagccgagaaaagggccaaaattgggcacagattgggcaacgaaaaggacggatgccaaaacggcagaacggacgcacagacgtgcgatgccaaactctgaaaaagtgccaaaaatgggggggggggcaatagaaaggagggacaaaaagcaaaaaaggagcaacggtttttatgccttgcggggttccgaagagctcttccgcctcttggttcagcggattgatgaccaaagtgattccaagcagagagttggcggtgatcagtgccaacaccgcctgttggacccacgcggtgcgaattgagccgaccaccgaatcggacaaagtatcgccgtaggcgaaagaggacgacaaaacgacgaaaaagttgaacagagtgatcactgaaggcggtgaaacccaaaagtgatcatc

SEQ ID NO: 27263 - DNA, 1193 bp, Heterodera glycines
  misc_feature (48)..(48): n is a, c, g, or t
  misc_feature (91)..(91): n is a, c, g, or t
gtccccccgaaccgatgcgcccagatttatgggagaccgatccctccnggaatagcttccctatagtctgtacttaaatctgcgtggattntgctccccatcaatgtttgagtaccccaaacggacactcgaaaaaatcgatttttttgtttcggggcagtccccccgaaccgatgcgcccagatttatggggagaccgaatccttccggaatagcttccctatagtctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaaaagcttccctatagcctggactttaattctgcgttggatttttgcccccataattgtttgagtaccccaaacggacacttgaaaaaatcgattttttttgttttcggggcattccccccgaaccgatgcgcccagatttatggggagaccgaatccttc

SEQ ID NO: 27264 - DNA, 1195 bp, Heterodera glycines
tgactaattaaataatttttttttttaccattcctggaatggggataatgttgatagaacagatggaaaagcctatcttttgaccggttaaagccagctgggtcactgttccatccttaaatattaaatattttaaattataaagttttaattgatttaaaattatttttgtttaatttttcggcttttaattataccaaatggagcacggaaatggtagcttccctcaaggtttggcaatttggcttcatcattgatgaacaaaattcggatgccctcttgaagaacctgtaaaacaaaaaatcaaatttaaacaaataaataatatttttttattcacaaaaattatggtcataaaaattcttttgtaattatttcggtttaaattttcgaaattttcaataaattaaaaaaaaaatcgcaccgttttctgttcgtacacataaatcaacgaaggtttggtggattcggtcaatttcagcacatattcgccagctttgtcaaccccattgatctcgtagaagtcataccacaggttggttgagtactgcttgcactcggcaacattgcgttgctcggcaagttcagtctcgacatttggtgttgctccggcagtaattgggcacaaatacacatttgctacctgtacaattttgttgtttgttttatgaacgttttatagagatatctttaaaattgttaagtagtagtggacagaagcttatacaaaatttattataaaatagtatccatccgatgggactccaacctatgccaatgccttgcggaatatttcgttaatacacttagctatggtattttagcacaattcctcaatcgtccgatgggactaacccatgcattggccctgtcgtaccttataatctaaccaaccgatgagctacagtaaccctgttttgttactatctcattagggcaaattgatcatctacttcgccagttttgtgtgcatggcggacgggggacagctccactgggggcgtcgggcgcaaaatgtctgataagttgccattaaaagattcgttttaacccccttttaggcacttttaggtcttttggtactgactgtggccaacaggtgttgcccaaagtctaatgttcctccggtctgctcacttggctgttgtttggcggttgtatattgttggggtacgttgggggggggggggggggg

SEQ ID NO: 27265 - DNA, 1411 bp, Heterodera glycines
  misc_feature (28)..(28): n is a, c, g, or t
tgtttagaaatttctgcgtgccaacacntttggtcagctcctaaatttatttcaaaacgtacgcttcttcatttgaaccatttgaattggtgaacgaacgaacgcaagaaaagctgacattaatgttggaaaatgaatcaattttcggcaacgaatgggtaatgaaacggtgcccaattggggagacggcggcggcgattcattgggaggacgacaatttgaacactgtcgaattttggcgttatgctggctttaagagggcgtcttcagcagaataagcgggacaaaacacataacaacggcaacaacaatgatcgccagaagaaatgaattaattaagaaatgatcgatcattatgtacatttaagtgatcaaatgtattttatgaagaacaattgaaatacatgtgataataggttggtatatttaaataaatagaatgtgcaaaaaatgtgaaaaaaaatttagagaatttggacaaaatagttaggtaacaagggtggagcgcgcatagaaaaaaccccggtcgcgcattcgacaatttgacatgaaaattcattcggcattcctgacttatccggcggattagactaaaacaagtgaaaatgatatttttttaacaaaattggtatcagtcgacagctcgacgatacaaaccgatctagatttttgattataacttttttcattgtcgacaaaattcaacaatctttgtatcgaaagcttttcacgattattagccttacaaaaagcacaaatatttgctagcaaatagaaaatttatgaataagaaattacaaaatttcgactttttcataattttcatgttgtaacttttttaaaaatgtctaatcacgaagcaatatcttagaagtagcttctaaacatgttaagctttcgaatgataccaagattattggatttaaatgacaaataaaaaagttatagcccaactgacgtagaccggcggttcccatcgttcgtaatatattcaaatgcgcgactgtttaggctcaaaaattatttgtttcattccgataataaaaaaatttttctaaacaaaaatggaaatgaaataaaggcaatcaaaagcagcagtcgctaaacaaaaaaagtattgtcagtcaccacacctctttgaaattgttgtgccattcattgtttggtgggctcgaataattgtggaatcgcaattgcttcggctgcccatcgtttctcgaaatgtgcaaccattttgacaatgcttgaccagcagcaacagaagtcacaagccaaagtgtcgaatggttggtgcaaacgcgttcattatacgcacaaagtctggccctgcctaaaaagtgtactccaagaacgaatatactgccgtaataatacaaaacccattattctgctaccattctaaatttattta

SEQ ID NO: 27266 - DNA, 1440 bp, Heterodera glycines
  misc_feature (668)..(668): n is a, c, g, or t
aaaaaaatggatgataaattgatagcattttaaatgacagtaaaagcgaaccattagaagaaaagaccttagatagccaaaaacgggggacagggacacctgttgggatttcgacctaaaggactaatgatcgtttagttacgtgcaaaagtgttgtagcatcatcatcaccatcttaaggtttctttttcttcatcggttttaccattttattacggctggtgatgaatttgggttcctcaaaaactttaatcgaacgaaaagtgaagtcgccataaattgtatctccatcattaatgccatatgcgtccattgttttgttatctttgtccaaaattttatccactgatttgtataattccatttttgattcttcttcaaaattgacatcccattttactttggtcgcggccttgctcttttccttcacatttttcacagtgtcgttgcccttcagctcaacatagtcagaattagagatcggataatccgtatacggatttttacggatccgtagtccgtaatccgtatttttttcggccaatacggattttttacggactacggattttacggctttttagtccgtaagtccgtaatccgtatgtgtgcctagtccgtaatcccgatcctgatccgtattttctcaaaattccgatctctagttntaagtgaagaaaatgtttcaaattcatgcaaatttttaaaatcaagctttttaatgccatgcgaatcatcatttatgcagggctcggatctgtccttatttataagatttgtccttatttggagggtccaaatcttacaaaataaaaatgtccttatttgtaagatttgtccttatttcgggctattgttcttattttgttcttatttcttaaatatattcaaaattttgaaattttatggcagaatgtcactattttatcaagaaaatataaggtttgcgcaaaatttggttattttttgacaaaaaactgttagcaaatcgcattaaaaattacaaaatttttcccggtggcgcctatcggcaccgccggaccatctccccacttgttccccaaaagtttttgaaaaaacgcaccgcaaaaaaaagtatttttaaagacaaaaaatcgccgcttggcttttaataaaaaaattggccttttttggtgaaaatctgttaacaaatcagaattaaattacaaaaaatttttccggcggcgccggaccctctcccctcgcacttcccaaaagttttttggaaaaatacgccgcaaaaaattgttaaaaatctgatttttttatcccgaatgcactaaaattttatgatttgctaatttcctccccaaaattgttaaaatcgttaatgggagaccaaaaatatactatttgataatttttgatcgaataaattataaaaataactgatttgaagcaatttttgcgaaatgttct

SEQ ID NO: 27267 - DNA, 890 bp, Heterodera glycines
  misc_feature (886)..(886): n is a, c, g, or t
taaagtccggtccctactcgcaagtgcctaatttaatctttctatagcttaaattcattttcaaattatctgattaaaatcttccgttaaaataaaaatttgctgccaaaagatctactgacggattgtccggagccgccccctctcaacctcccacccctcactttggtcttgaatctgaaatcagattccagttgtggcatcgttagtgcctcagagtcccttcggatctgtggattctgcggcatagattctgaggagctcggtaggggtcagcttcgtctggccaactccgtctcagttcaaagttcaaaaagctataacttttttcttcgtttactaaacaacaatcatatgtatcagggagtcggaaaatgcgacggctcccggacttttcgacagaaggacttttcgacagagggcttttcgacagtaaaacaaaaaataatggacttttcgacagtaaacataaaaacaaataattcttattaatatttcgttaaattttattgttttggagaaaattttacgcttttcatttaaattttaaacttaattactttttactgtcgaaaagtcacctcctgaaatttataatatttctgtcgaaatgtcctttgctgtcgaaaagtccggcgcccaatgcgacaccggtaatacgacattggaaagcacctgaataaagttatgaatctaaaaattttcatttgcatagaaagatactcatcaaaagcttttgagtgtccaacattgtaaaatttttagggcatccaattatatgcacatgcatatttttttcctggactttggtgggcctgaaacgcagcatattttatgcgcatattttgcgattttatgtgcatataattggatgctctaataattntatt

SEQ ID NO: 27268 - DNA, 1696 bp, Heterodera glycines
  misc_feature (32)..(33): n is a, c, g, or t
  misc_feature (42)..(42): n is a, c, g, or t
  misc_feature (57)..(57): n is a, c, g, or t
  misc_feature (90)..(90): n is a, c, g, or t
attagtgcatgatcaatcaatcactctttgcnnggattttcncctcgctcaccgccngcagtcccatggaccaaaaatgtcggcgacacntcacaatcagtcgccctcccacttcgaattgcgctcgcgtcgatgatgtacgtcggagtgcaattggccaattgcggaatgtgccccgaggggacggccgggtgagtgccgggcgggtaaatggccgagtaaattgggggcggcgactgttgcgctgggggcatttgctgagtgtttctgctgggatttggcaatgtctccggcagagtaacattgccttttgcggaatctgtcgcctcaatcttcacggaatctgtcgcctcagttggttgctgtctctgctgctgttggcagtgataaattctttcggcaattgccaccggcggcactgtcgcggtcggagaagtgcccgaggcgggggattgttcggcggacgacgaggagagaatggcatcctctgcgggagtgagcacgtaactcatcgggtggacgggcgccatgttcagactgatctcgtcgaattgcagctggtcctccggcgaaggagaaagcctttgcccgtcggtattggcactcattttggggcgtctgagtgattctctttaataaatggatataataagtgtttggaaagatgcaaccaaatggatttttgaagatatagaaatcgaatagacaaacttatgagtgaaggaaaagcgaaggacgaaaattggggaaaaagtgggaaaatggacggtggggggagggaaatgccaacaaatgaatttggtggcaaatgccaaccaatttttgagaggaaatgccaaccgatgaggtaggcatagtgccaacagtggattcattcactcacacccatcgcagttggccttaaactattcaaaccttttcatttgtcgtctaaatttatcctctataactttgcgaattcagtccatttttgtttaatcagcttcgccaaaagattttgcttagccaagcagaaaagattaatgtattgactaaccgaaaacggcgaaggattttggaaggccaaatcaaacaaatcggccaccgtttgttagtttttattaaggttggtgcgtcaatcgcatttaaattgaaatttgacagccttcaattagaaaaagccctttcccaacactttgcccattcaaaattaaattttaattataaataatttttagcaaatgaaaaaaaagtgatgcaaattgtgatgtttatgaggttaagagcgattggcgaccaattttgaatgttgcgcgggatgaaaagacatttgggactgacgatgaccaaattcaggcacagttttgaagcagtaacactccaaaagtttgagtgctgtcggcataagttgctttttcatttggggactgaatgtttcgaatgagtcaaaaggccaaacacagagagaaaagcacctccaaaagatgtacatgtagaagaggacggcatggtgaaggtaatagaggaggtaagtgatgaagaaggcgaactgccacaagtgggtctgctgcacgtcgaacacggcctcgtaaaggcggaaggcgtagttgggcacattcagcagcacaaaagtgctgaatagaagaacattaaataaaaggcaaatttacactgcccgggggagtgaacgccctcagggcattggaaatgctaaggg

SEQ ID NO: 27269 - DNA, 1364 bp, Heterodera glycines
  misc_feature (11)..(11): n is a, c, g, or t
acaaaattaantggtccaaagttgcacattttaggtagaaaaatgctaaattaacaatgatttgcagaattaactattggaagttatagttttatagagggaaaatgcaaaactaagcaaatcaagacaacaatgcatcattttttggatcaaaataatgtgacaacaaactgctgctcgtgtgtgttgggcatgtgtgtgtgtgtgtgtcggtaggtatgcgcacgaaagttctatcattaccacttgctttgactgcactgcgctcttcctaattcattccaccattcctcatcttcagattgagttaaagtttcatctgtattattatcatcactgttgttgctgtccatacttttcggggctctgatctctgtgtacatacgcccgagccatcgaagtgaagaattatgcagctcacctttttcatccaccagttcaagaagttcaagcggatagaaccggtcctcccctctgtctgggtgctctattgcgcagtgaacgtacgggtgatgcaaccgaattcggtgacggacgtaatagtgtgcagcaacattgacattatatggacgcggcaaacgaccataacataagccatgatgtttgatgctccctcattcgtgatgccgttcagaaaaaaggtctttcgtataccgttcctgtctcggtacattgtccgcactttacgtcctttcaatgcattaatcactatttctctgtcgttaggatgattcagtcgctcacgcagtgaaccgacacttgtagcgagcaaatgagcacaaaaagaactgacaagcatcacttcaatgagaaatgaatgtgtaaaatggttaatcaggcttatttatagtcgcttttaagtgtgaatgaaacaaagttaagctatggattttctttaaacactatgcaaacaatggtgacccaatttttaattaattgttcctaaaaatctatatgacctacataaacccgtatttaagcgcggtttgtttaataagtttcattcattctcattaattaatatggatagcagcactattgaagagcaaacaaatgtaggacatcagctgcatcagcagactatgaacttaaactgtgactgtaaacatccaattaccaataaaagatttgccgggtctgttcctactgaggcttttcattccatccaagacgaaccaacagagcagcaaccaccaccagttaaaataccagaacatttgtggaaattgaccaagggcaaattcgttctgctcttccgtctatgcaacttgtgtcaaaaccgtctctacaacagtgaagacaaaacagtgcgtaacggggaatttgttgatgtgaagttttcgctgtgccaagaatgtgttgtt

SEQ ID NO: 27270 - DNA, 729 bp, Heterodera glycines
ggaactgtatcaaattaccagcaaaaatcaacggcaaaacgaatgccatgagcgcaaaaactttggggccgactgccgaagcgcctaataaaaaatcataagtttaatttatatgcggatagacgaataattaattattatgagtaattatgtttacacggaaggtgatcaaagtgtatcggaatttgaaaagttgaatttaattgaaaatttttaattttttaaggcctggtcttgggaaagcattttaatctaaggaaccgaattctcaaattggctaatccatgttggttctgaattaaaattaaaagtgcttttcttttaaatttaaattttaaaaatggtacagaattttaagaaaatgaaaccaatttacggtgcgtgcgatattctgctctattcataacaattaaaaagtacaaattaatttgtatttttagaatattggtttcattatttgcctaattaccttgattataatatttttaggttattaaacagaagcgacacagaataaacttaagaaagttggcataattcattaaatttgatgttgtcttatcctatgcatttgaaagtgccttttcaagaaaataattgaaaagcagttcttctgttaatttattgccaagatttagtattttcagtttttggcaaaattgcacctgcaggcaatgggaatggcactgattggtcgagttcgccggttttggaatggcacttccaatc

SEQ ID NO: 27271 - DNA, 1216 bp, Heterodera glycines
accggggatctctagggccggtgcctgaagatcattcgactcagcacgtcgatgccttccaataaatatttgtaaccgtcgttatgctttttcaactggtcaaatatgcacaaatcgcactgccaatcggtatggaagccactcggtatcgtctttagtctcgggaatcttttccttatgggcttgtgaatcgtgtaagttctctgtttttcgagaaaattattaacgtctccggtcgtgatttccgggtcaatctttttggcctcaattaaaattttttgaatcccagcgaaacttgccggagattttaaattaaaataaatttttgataaaattttctctacagtcttgcccatattagtggtttgaagggtttcttctctcgtgctatcccgggtgtttttatagattttattgcctttttccttccacgtccccacatgacctttgatttatcaaccatgtcttttactgttggatccttcagtaaccgatctttgagaaattttgcaccgcgcggcgtttcatctttcttccccgcgagatacaacaaaacatctctataattactgttttcaatcggcaaattcatgttcgattggacctttccagccgccgtaattttaaataaatctttgttttcctttacgtacctaaaaagaccgtttaaaagggtcgggtgtataatagttttgatcggaatgggtgtttttaatgtgtgtgttgtttggggttccctagttaactcctcaagtgtatcagtatctgattcaggatcaggagtttgctctttaagtcttttcctaggaataattattttccgtggttcatcggtctcttgtggtttggattgagtgttgaggcctagatatggtgcaacgttcggaccgggtacatgattctcaatcaccaccttctgtggtctattttcaagtatcccctttaccgtacgtctttctttatagagccaatcatgtctcttcgccttgagttcctcgtttatgtcggggtcttgtaaattctgagaaatctttgcatctaaactcgctttttcattttggagataatcaccactattcattacactccgtagagccaaatattccgcctcgggaatcattaacattttctttgtaaatttcatgatgttattttttctaataaatgttgggctaaaacactcaggaccggtattcagacagctcccagggctata

SEQ ID NO: 27272 - DNA, 942 bp, Heterodera glycines
tttgtgacgtataaaatttctcaaaataaagagatagtcatttttttggatataagataaatgtaaaaattctctgagaaatttaaagtgggattgcgcaccgccctccctctcgcgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcccttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcccttcctatcaagctcgagagcatttgtaacgtataaaatttctcaaaataagagatagtcaatttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcccttcctatcaagctcgagagcatttgtaacgtataaaatttacgaaaataagagatagtcaatttcttggatataagataaa

SEQ ID NO: 27273 - DNA, 1309 bp, Heterodera glycines
agaggtttgatagtgaaataagtcaccagcaaaacccaaagcttatattcttttgccttatcttttctggacatttcccggaataaaaagtcaaatcaaaatttgcttaccaatcgaatgagacttctgtccaaccatcgtaatgtgtccggcgaatcattctcattagccgctctccaagaagccaaccgagccataaaaacagtgccggcgtcctgatcaaagctatacccaatcgactgtttattcgcttccatgtcggcccatgaacgacaagtggtggtcactcggactcgccgatgtccatccgaatgttggtattgggtgataaattgcagcatcgcacgtgcaccttgaggaatgccggtgccatgctaaaagaggaagaaaaaaaagattgatttaggaaaaaataaaattgtctcaaccggagcccctgtggcctagtggactaaggcgtcggtctcctaaaccggcgacgcgggttcgactcccgccaggggtaatactttttttatttattgtaaatttatcttttcattatgcggagtaactcgtttttctctgataatttcgaacctgtccagacacttcgaacgccacggcaattgtattccgaggggtaagggagcaaaatttccattgtgttgtgccaccaatgccaacttcagtgtctgaaaccatcgaatttttggcattgatcgaagaacaacagccgagaatcccttcgactttgagtccattgctaactttgacctgtagcccgaataatcatttttataaaataaaaataataacgtcacctctaaagtggcgttaaaagtcattttcaaatttccatcagcgtccttttcaaacactttttggaatgtctgtttgaaaagagtcgaatcgaaggaatcggccatcaccacgagcccatttgtactgttgtaaagcgacttcatttcgtaaagcccggtttggtcaagggcgcacgagaaaatgtcaatggcatgcccatttttcacggaccgttcagccaatgcgtcgtaaaatttgaaagcctaaaagttctcaatgagcgtttgtttccctcaccattgtagcgccaaatattaggttgaatatgtcaaatacagctcaattgacccggccaaaacaaatggatcaggtattgcaattttactattgatagatcagctgaaaaccctatgagttctcttcttctctagttcatgttgagcaacaagcatgagcaaagacaaagtgggtatatatatatgcaataatgttattatgtcccaaaatttttcatctcgaattattt

SEQ ID NO: 27274 - DNA, 962 bp, Heterodera glycines
ggcaagcgactggcgacggaggacattggaccggcaccaagacgcgatgaaaattggcgaagcacaagctggagacaattcacggggacgacattcacacgcggcgggcgaggaggaagcgctacaaagtgctacaactgtggacgaacgggcacgtggcacgtcgatgccaagaaagacggcgagatgaccggcgttgattgagaggaataagagagatagtggaaaagggggctttggcaaggaaaatgagtgtgttttgattttgggggtataggttttaaattaaaataatttcgctaatttacttaggtaattaaaaatgtcaaaatttcatgcttcataggcaaaatttgggaattgttttttcatgtgcttcggcagtaaaaatgaaaaattcctgatcagttctcgagacaaaggttgatggctgggcactttgccagtgatgcctgagtcttgaactggatcagggacgatccaatgtacggttgggagtgagtgacacgaagcataaaattttgatttaaaattggaaaaagggcatgaaaattagcaaaattatttttgaaataattttctttgcttaggcaaattttgaagcgaaaatcttggtaagagaccagggacggtctttggtaaggttggaggtgtaaggtagatccgggttttcttgtttaccggccgaagctctatgaatttcacattctcacatttatttcatttcgcatttaatttcccttttgcttattgttgcccctttcccgacgataattgatcgatcacatttcatttttcacgtgtatttaatgttcgccatttccagcgaagtatcttcagtctctctggaataaagccacttttcccagtgcgtgcatcaaaggcgggacgtgatcactgggcttgctcatcccatgggccctcccttcaggagcttcagagttccttcgcagtgttcccaa

SEQ ID NO: 27275 - DNA, 1000 bp, Heterodera glycines
  misc_feature (966)..(967): n is a, c, g, or t
cgtgtcaatgagcacagtcgcgtttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgaactattttcgtttttaaaattggatccggattttttggcttttttaaataaattgtgaaaaattcaaaacaaaaaacttttattgcgttacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatataagaaaattattttcgcttttaattatgatgtacaatgcttttaagccccgccgtgaggcggctcctttttgtgaactattttcgtttttaaaattggatccggattttttggcttttttaaataaattgtgaaaaattcaaaacaaaaaaattttattgcgctacaaatgcttttaagccccgccgtgaggcgggacagttccaaaatttgcaccacattttactgtggaaagtccaagtactttaattggacaactacgtgccaatgagcacagtcgccgttggccagttgtgaaacagaaaaatgggaatatcagatggggtgcgtcccatcctannaaatcctcttttcgtctaccatccctccctttt

SEQ ID NO: 27276 - DNA, 1393 bp, Heterodera glycines
gcggatattttccttaaaagcttgacatcatgaaaaaatatgtacaatatgcctaaatcgcgaatattcactattatacttacgaagagagcaaaatagtgatttgtagtcatcgatagtgagatccatattgtaagatatcaaagcagaaatttgttatttgatctcctttatatagaaaaatcgagcaaacaaattgttagatcattaatcagtagtatgagtagctcataaactcgtctttttcaaaaaacgagatgtgttccaatcagggatgtctgtaattacggattccggaaattacgacgttttaggatttccggattgcgggttacggatttgtgggatttttacgtaattttgatccgtagatggattgatagattatttttcaagacgatttcttgcaagattatttattataaaatgaattttttttttattattaaaagtagagtagaccgtcaccgcgaccgctccgggaatcattcttcccagtgcttgtcggtcccggttcccggtcccggattttgaaaagctcaggtcccggtcccggtcccggtagggcaaccgggaaccgggaaaaacaagcactggtaagaatgggggtctgagtgcaaaaattagtgagaaaattggagtaaaaataataattaaatatattcgataaagtagcaataccaactgtgcaaatggcctagtggctagtctccttggcttttcccttcttctttcccctagttcaatccctctacagaaattaaaatattttgaattttttttttgtatactcatggctttcctatcgacaaaatatgattgctcatagttttttttaattgacacatattttatcattttttaaagaaaatccgtacaaattgagcctagtaatctcaaaaaccagccttttttttgttgaaatttgttaacaaatcacactcaaattttcaaaattttccccggcggcgcctatcggcaccgccggacccccttcttccccaaaagttttctggaaaaagcgcgccgaaaaaagtgatatgaaaagtatgtaaatctgaatttctattaatattcgatcatttaaagtacaaaatgattgttggttgaaataattgaagaaaattagtttgaaaatttttattaatttagatagctttaacttttggattttataaaataaaaaccaaaataaaaatttaattatttaatattttcacttgaaataaattaaaatttgaatttttttgaatttttaaaaattcccggttggtcccggttccggtcccgaacaaaaatcgaggtcccggtcccggtcccgacttctcaggtcccggcaagtcccggtcccggttttgcccaaaattcccggtcccgctctactctataaaaa

SEQ ID NO: 27277 - DNA, 1226 bp, Heterodera glycines
taattagcagggattcttttttatgtaagaaaaatcgcaaaatatgtaaataaaatatgtataaaaaatgctaaaatatgtatgaaatatgtacaaaaagaaccacaatatgtactaaaatatgtaaataaaattttttaaatggtgtttttttggaaaaaaatcttcgtaaaggggtgaaataagtacaaaatgccctaaaaatgacctaaataggctttgaagcaccctttttactatctctttttttttgaaaaaaacgatttttaggggtatattttcaaaaaaaaattttaaatttttcatatgaaatttctatcacttctcaaaaatcctaaaaatatgtacaaaaaattgtgaaattttgggttttttttggggacatttaatgaaaatttccttaaaaatcctcaaaaatttcaaaatatgttcgaaaaaatgcgaaaaagtccaaaatatgtataaaaatatgtacattatatgtaatatgtagaaaaatcccgaaatatgtaaaaatatgtaaataaaagtcccaacttttgttcgcaaacacaaaaaagaaagtgtttttcctactaattaggctatggagaatccaggaaaaaaacatgtatttacataaaaaagaatccgtgtaaatcactatttatcctacgctggcatgaagaatgtcttagcagtcataaaaagaaaagaatggaacaatccgccggaaaaattccacgattcagaacaatccaaacaactatttccatccatttacgctatctccagcaaaatttctatgcccaactaaactgtgtataattaattatctggtcattaagccagccacgctaagcgttcgattgtcctgtattctgttaactgatttaagttataattaatctttgcttcgagttagtatttgatcaacgatatgagaggagggacaaaattccttcgcaaattgcgtatatcttaggattggacagtacagattttacgagatcggaaagtgaagccaaatttatgccagatatgaatggaggcgtataatcttttcgaggttatattcccgatctcattgaatccaatgaagatgggtgaagtcacagcaacagtgttccccatcgttactattccaggaaaacctgacgatacaggtgaagaacaatttttagcaatacaatataataaaattgtattaagggaattttctgaacttcctgatcgaaattcgtaca

SEQ ID NO: 27278 - DNA, 1096 bp, Heterodera glycines
  misc_feature (31)..(31): n is a, c, g, or t
cattcgtactgaaatggcaagtacatactgnaaaatggattcatgcgggaaaatttgaaatttgcttattttcaagtttgtacttgaaaattgcggcgcctattggcaccgccggctaatttcttaaaaaaaacttgcttaaactcgaaaatttgtctttttggggaaaaatctgttaacaaaaaatgaccagtggaaacaaaaaaaatattggaaaaatccaacctggcggaaaatatgaccttctgaattaaatatttaccattctttcgcattttttcgcgtacttgaattttgtgtttttatctgtgcagttaattaattgtaataagtagggatacgctttttaaatcacccctaagaaaggacctaaaaaaatttcaaaaaattcacccctaagaaatgaaaaatttctcaaaaattcatatccaaaatttatttttttgacaaaaattgtgattttaaaaaatatttagtctcaatactgatttggcttaatttgttaatttttggagaaaattttagattttacacccctaaatttgaaactttttgggacctattttgccatttttagcacttatttggggggtttttagaacctaaaaatcgtatccttattaataaacatcggattttgaaaaatctttttattataatttatgattatttttccgtgtgaatttttccaacggtgaagaaattttaacgaagctattatatttgcttggcccattaaagtattaatcgctgaaatttgctgccatttccatccctattttcgtactttacgttattttatttttactttcgtacattaaatcgaacggccgcttggtcaatttcaatgctggcaatatgtctcgcttttgacaaagactcgttcaatttgtcaattttttgttgaagttcgcgcatatatttaacgaaaatgtcttaaaagtcagactaattagttaatcacggcaattcaattttgggctccaagtacaattaagttggttttttcgtcttagtggtctgtgagttagtcaccaaaaggggggtcccaggttcaagtcctccctatgttgtgtgttaatttcaatttcttctt

SEQ ID NO: 27279 - DNA, 977 bp, Heterodera glycines
cgtctaaccatccctccctttttgtgcactatttcgtttcaacattttatcaattttttgttgtcttttgaaataaattagtgaaaaaatatacgaaaattattttcgcttttaattatgatgtacaatgcttttaagccccgccgtgaggcggctcctttttgtgaactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgaactattttcgtttttaaaattggatccggattttttggcttttttaaataaattgtgaaaaattcataacaaaaaacttttattgcgctacaaatgcttttaagccccgccgtgaggcgggacagttccaaaatttgcaccacattttactgtggaaagtccaagtaccttaattggacaactacgtgtcaatgagcacagtcaccgctggccagttgtgaaacagaaaaatgtgaatatcagatggggtgcgtcccatcctaaaaattcctcttttcgtctaaccatccctccctttttgtgcactatttcgtttcacattttatcaattttttgttgtcttttgaataaaatgtgaaaaaatata

SEQ ID NO: 27280 - DNA, 985 bp, Heterodera glycines
tttttaataaattctgggggacgagttttttgaatttactttttaattgccgttgtgctcactgttacccgacatttgcgccaatgtccaaaatcgggtttcaaacttaagttttttcaatccctaaatagcctaagcagcattaaataagcgattgaaagtgattgtgtctgataattagatagacaagtgattattgaaaaaacaatcattagttattcaaacaacaaaagtaatgggtgctcgtcacactcaccctgatcaccaaaaattatgctccgatcgtcgccgagtgtctcaatttcctcgccctcctcgtcgtccgtttcctcccatctcatgcggttgttgcctgcctccagcagcgtgtcggcattttgtgccaaaattgccgccgaaaattggctggcatttgcggcaatgtcactgttaaaatttaattggaatttaccacaaaaaaaaaagatttaaattgttgcgctttaattaatttatatggaagattggcattaataatttatggtaaaaacaaattgaaagagtatcatggaaaaaacagcaaaaagggaaaccaaataaaaattttttttaataccgatagaaaaaagatttcgcatcaaaatgatcatttttagtgcatttttatttgaattttaagccgttagttagcctataaaaattcacataaattatggtcttgatttgaggcatttgtgattattagttaacaaaaaattggaaatattaaacaaatatttataaaaaacactattttattgaaaaaattaaaattaatttgttaaaaaactgactttcccctgcattcacgctcttcgtccctgcttgcaccacgctgacgcaacaatgggtccgaaaaacggcgtgacacgccacctgcgaaaagcatgcccgtacgtgtaatttcaaaaaaaaataaagcgccttcacagcactgaagcacgaagtgtaaagcagcgctgcattg

SEQ ID NO: 27281 - DNA, 1394 bp, Heterodera glycines
  misc_feature (10)..(10): n is a, c, g, or t
aaaaccatcnaaaatgggcgttagtcaaaaaaccttcaaatgaaaatattttttcatataactttgctcaaaagcaaccaaattttaaaatcatttgtttcattcgatagtcctaagtttttttttattatcctacaaattttcaaaaagtttcgttaagtttcaaaatagttagaccaaaaatgttcaaaacttgattgttcttttttgaaacttaatgaaattctatgaaattctgcaggataatagaaaacacttagggctatcgaaagatatcaagtattttaaaatttgattcattttgggcgaagtcatgaataattttttgtcaaaaatttccaatggtttttgatcagcaccgtcaaaaccgtcgacccaacagatcatctcacttgttgaaccatgctatagacatatgttctattcgtaaaaagcatgatcaacgccttttaattgatgctatgtcgttttataaaacccatcaaaaagagggcattatatgaaaaaaaaaaccatcaaatggaaaattttaacaaaaaattattacccataattttgctcaaaaacaattaaattgtttaattcttgatataatttgattgccctaaatgtgttttctaatagcctgaaaagtttcaaaaaattctccaattttgacaaaattatggccaaaaatacccagtcaaccagcaggttttcaaacatttttggccttaattttttcgaaacttcgccagatttttttaaactttgcaggctactagaattcaattagagctatcgattgataaacaaaatttaatttgttagttttaaaaaaattttgatcagaatttttgatggcaaaaatttcaattaaaaattttaaagccctatgtgttttcctaatagcctgcaaaatttgaaaaagttggctaagtttcaaaaaagttatgagaaaaatgttttgaaaacgtgactccctgtacacttttttttgccataactttgttcaaacttgacgaaatttttgaaattttcaggcaattagaaaacatttagggctaccaaatgatatcaatcaaaaaatttatcattcagaggcccctaagtggcaaagatatgggtaaaaatttatttttgaaattttataacgccaaccccctttttgatggattgcttacaaaaacggcataacaccatagcaacaacatctaacacaacaagcgcaaagcgtaaacaccacatgataaacaagtacaatgagagtgaataaataataacatgtatggtagtaatacattttgtccttgaccgtcggatggcatatgcattcagatgagcattgtatagtagaaataacaggatgacaatgcccaacttccatagggatttacggtagcaagcactcatta

SEQ ID NO: 27282 - DNA, 624 bp, Heterodera glycines
ttttggaaggaagtcaatgatccttcaaaagtcagtgattcattttgccaattggcacattcagctcattcattcaattcattcattcattaattgattcggtcggacggaatttgaacggcaccgcccaaagacattaaacattcccacggaaaacaaaacaaaaacagcagaagcagcagcagaacggcaaaaaagtgaaggaattttatcaaaaggaaaaaggcgtcgaaataatgagaaaagacagccgacgaatgaatgagtgaaaagacatggaaaaaggaagaaagaaatcggagaaagaaaaatgggaggggggagggaggagaagagatgggatgggattaattgaaagtgagcggccaaatgggcaaaaatggaagaagcataagggaggaggggagaagcgcggggggaggaagaacggtaggacaagcaaaacagacaaaggttgcgaccaagggatgtccaaccaacgtaaagacaagcaaaagtgggggaaggggggggcgggggacaaatggggggggagggtaattacgaaggccaataatgacttagtgaagcaattaattgagcaattagtatgaaataataacaaaaaaggagcgaggaaagaaa

SEQ ID NO: 27283 - DNA, 877 bp, Heterodera glycines
gcactcttaatgatgttaacagaaagtaactaatataaaaaactgacaaaaaagcctaagtctaggcataagcctaaagcttaggcctagtctaagccattgttcgagttgcctgtgcatgagttgtcatgataccttaggtctaacaacgaactttttagttaaaaacggacaaaaaaatagttttggctaaaataccatggaaacagggacggcacggaatcccgatttccgaaaattttttgaggttcggaatgccatccccgccatggacacaaaaagtcatgggacgcgtaaaatatgttgggacgcgtaaaatgtgatgggacgcataaactgttgttgggacgcgtaaaatgtcatgggacgcgtaaaaccgactagaaccaaaagattttggtgtttacaattagtcaaaatggaagaaacaaattttaatacagaatttcacacgtaaaagtgtttgaaagaaatacaacgagaattttcggggggggggggggttaaacatgtagaattagacttttggaaaagccagtataattattagcaggaaaccctaacaagatttttgtgcctagccagggcttgggttttttggtgtttgaccaaggtctggtttcctggacaaaacctagatccaagaaaaatccaggcatgaatgaatccaggtccaagtcgtgcaataacattcatttgttgtttcgagcaatgccccaaattaggcaccttatttggtacttatgtattatctatgtgcagattttcaaaaaaaaatttctgaaaataaacttttttttaggggttttcagggtcgggaaaaccgattctggcatccattttggcccaaattcgaaccccgaacccggattcgaac

SEQ ID NO: 27284 - DNA, 1204 bp, Heterodera glycines
  misc_feature (24)..(24): n is a, c, g, or t
ttaacaattgggtgtgaatatttntgagatgcaatttttcttttcataggaaatatttaggagcacaagtatgtgcccggttagctcagtcggtagagcaccagactcttaatctggttgtcgcgggttcgagccccgcatcgggctttaatctttttatgattttttgtttcggggtttaaaattaatgtttcgttaaataatattaaattaaattattacgttatattttcttttattatcattaagaccctttttaaatataatttaaagttgttgctaatcattttttatgttgatttatttaattgtaaataaaaagttaatttaataaattaatttgctacaaatttattccgaatcctcaaaaggtaatcgaagaacgttctgagagttccccctggacatgggtcggtgcaatgttttacgcgggccaactgtacaccaccatcggatatggtattccgatcacccaaacttcgggcggtcggttggccagcattgcggtgagaacattggccattgagtatcgaggcaattgtccccgtcccccctgtccatttcagtacattatggtcggaattcctctctttctgatcattttgacggaaattggtcgccttttgtcgcgcggacttcggaagctctacaaaaaattgcacgctgcgcggaaaaagctgccggaagcatcgcgaaaaatgagcgaaccgatgcgcgtaagttggaaattttagaaattaataatttgcccttgggtaatttaatggcttaacaatgggcatacattgtcgacaattattgcccattttccccaaatgcatcaaattgctccttaggccatttaccatctgacggccgcaatggccggcaccgccgtgggctccgccgccactccgatgataaacggcgcggtgcgcggcgaacttttggtggaggaggaaatgcgacggagggaagaagagagaagagacgctcaaaaagcattggaaaagctgaagaaagaggcgcaaaaagcggcggagagaggcggcggggaaccgccgcagcaattcccaattccgtgggcattggtcattctgctgatgtggacgatgctcagcgcggcactcttttgcatttgggagaccgagtggggctacatgacctccatctacttcttctttatcgcgatcaggtcaacaacaacaataattaatgaatcaat

SEQ ID NO: 27285 - DNA, 1095 bp, Heterodera glycines
  misc_feature (59)..(59): n is a, c, g, or t
cttcatcgaactggctcttctattctcattcaatcgctccaaatttttttacagcttanctaggccctattaagcttatttccagaaaatctcgcatgaattctcatttttaaaatttttatagatttttaaatgtttggattttttttgccttaccaaaacttcatcgaacctggctctttctattttcattcaaatcaccccaattttttttacagtttaactaggcccaaataagcttatttccagaaaatctcgcatgaattctcatttttaaattttttatagatttttaaatgtttggattttttttgccttaccaaaacttcatcgaacctggctctttctattctcattcaaatcgccccaattttttttacagtttaactaggccctattaagattatttccagaaaatctcgcatgaattctcatttttaaattttttatagatttttaaatgtttggatttttttttggcttaccaaaacttcatcgaacctggctctttctattctcattcaaatcgctccaaattttttttacagcttaactaggccctattaagcttatttccagaaaatctcgcatgaattctcatttttaaattttttatagatttttaaatgtttggatttttttttggcttaccaaaacatcatcgaacctggctctttctattctcattcaaatcgtcccaaattttttttacagcttaactaggcccaaataagcttatttccagaaaatctcgcatgaattctcatttttaaattttttatagatttttaaatgtttggattttttttgccttaccaaaacttcatcgaacctggctctttctattctcattcaaatcaccccaattttttttacagtttaactaggccctattaagattatttccagaaaatctcgcatgaattctcatttttaaattttttatagatttttaaatatttggattttttttggcttaccaaaacttcatcgaacctggttctttctattctctttcaaatcgccccaaattttttttacagcttaactagaccctaattaagcttatttcctagaaaatctcgcatgaattct

SEQ ID NO: 27286 - DNA, 1334 bp, Heterodera glycines
aaaaagcgggagtcgggagcgggatccggtaaatcccgcgggagtcccgatcccgccggactctagttaaaagtaataaattttatttaaaaagtttaaacaaaataattgttatgaatttcatgtgaaaaaccctttaataattttaaaataaatgaaaaaattaaatatctgctgacaccaaatcaagagagaatgaattgcaaaggaatttaaaaatatgaaaataatcaaacttagggtgacgggcttaagattgagggtaaagtttctataaattgggataaaagggcagacagtttttcgtttttcttttattataattaatgaagatagtttaattaacaacgattataaattaaataaatcagataatttgcttaatataaaattaatttagcaattataaagagttattataacagcggaataattattttattgtaagacgcaaactaataaaaaatacaaaaaacggatgcattgttgatagtacaaactttgcagcgaaaagagagggcttcaagcaaattattaaattaaatgaaatatttttaaagaaatataaaaaaaattgtatgtagcaaaataaaaattaagaaaaactgaaaaaattagttggtttatcaaaaaatggtgaaaatcaaacaatgcgggaaatatttttatctttaaaagttatatattatatatttaattttttgggaaaattaaatccatatttttacaaaccatcattttaaatatcttgaaaaatatataaaaatatataaatctaagacaatataattaagatacaatacgaatacgaattatagaacgcattaagtcataacaacaactcgagtgggatggaacgatatttaagaatcaaattgtcattatctcaaacctaaaagtaaaattaacaatatggataaatcggataaaattaattgccacaaattatttttttttaaatactataaatctttaattaagaaatataatttaagaacttgtatttgattaaataaattgtgttcattataagaattaagataaaataaattatttaaaaaaataaaaaaatcaattttaatgagtggagcgcaattaaaagttaaaaagaaaattcgtgattgaaaaaaacgatacaactaaatcaaacatacatattccttgaaaaaaaccaataaaattctttttaacatttaaaataattcgaaaattttttgtccggttaattgaatagcaacaaagagccataacagccatgatatgtaaaaatttgaactaaggcataaaaaaatcttcatataaatatataatgtaaatttaaattaattgtcatc

SEQ ID NO: 27287 - DNA, 1362 bp, Heterodera glycines
attaataaggatgggaatttaagtcacaaaaaatctcaaaaaaatcgacttaaaaagtcatgaaaaatcgccaaaaagtcatgaaaaagtcataaaacgctaaaaagacacgaaaaatcccaaagccatgaaaaaataagcaaagagtcacataaaaatgctaaaaagcacgaaataaatcaaaaaaagtctagaaaaatcaagcaaatataattaaatcaatcctttagaagaaagtaaattaaaacaattaattttaacgaaataaaaacccgccagatttttattttatttttcagttccgtcatttgaatccgaatggtataagaaatttcagtacagtctcgaacatttacttatatatttttctgaattttattcactaaaagataaattttgccttaaaaagtgacaaaaagccatgaaaaaagtcataaaagtgcaaaaaagttataaaaatcttaaaaagtataaaaaaagtcacaaaaaatgaagttagaagcttcaaacaaggtttagaacttttaaaggcattttacgatatttagtcagcaaaaaaaagtcatttgacttaaattcccatccctacttattaagtgaattattaaaaaaaaattttacctaatgcctagagaagtaaatcgaattttgtccggcagcgcatgttcaggcatttccatagacacgtaatcaacttttaactctgaaatttgtggggtcgtttcttagggttgtatttttggtttttattgcatttttgtaaatattgtaaattttagcaaaacgaaataagttttttcaaattttttaaagtcggtttttaggggtgtattttcgtgttttttttaaaatgatctgttttttttcatttcataaactcgtttgttatttttgcaaaaaaattaatataatatttaaaaaaaaataaattttttttcaaaaaattctgataattccaattgaattttccaaaatattttctcacattttcctaaaatggcagttcattttgttttttctttttttcgacgggcggtgcacacagcttgattttttaaattggtcaatgaatacaaaaataatcaatcttgttaaaagtaaattacgatcggaatatttctgaggcgaaaaaatcccaaaatacatatgggccaaattggagaaaaatagcaaataggggaaaaaatgacaaatggcaaattcacacctgtggcgaaattttctaaatttttcagtaattttcaataatccaaaaaatgggagaatgtccatcaaaacatcaggacaaattcaactgaaattgtgaaaaaaatggggagaaacacagctttacttttttaattgatgtgaataaattgatgg

SEQ ID NO: 27288 - DNA, 1114 bp, Heterodera glycines
taatcactacacaaaatcattcgtccattccccaaccaacgacattaagcccggcttctgtcgctggcattctccagcgctatgaaatgcaacagtttcggctgagttgcgccaatttcgagtcggaatcgagctgttgctcgacctcacaacagatggagtactaaataaaactgaattaattatttttcaaaaattaaactaactttgccccgaattttcaggataattgtcgactccgagtcggactccaatctgacgcggtgtccgtgttgtcgctgtgcccaagtgaatttgatctgtgccaactgtctgaacactaatgttgtccgaattggcaaagtgcgggaggacaaacggcgtctgttgaggagcaaaagtgccatttgccatctcatccagaacgcactcgccgacgaagtgagtcccacccggggaaaggcttttctgatccggtcctgttttattgccataggtggacaaggggcggggggggggggtcaatttcgtttaatttttggcgaaaatcgaaaaaagcattgttaaagacaaaagtctatcaagttttttccgatttcataattttttttattaatttcttttgcgtttctccaatttcgtaaatttttcaaaagtatatggtagagagttaatgaaatcgccttaaaaatagcaaattcggtcacttttcgacaaaatctattaacaaagtgtgataattcggcacctccggcgcgcggcccaccccccgtcccctaaagttctttggaaaaagcgccgcaaaaaatggggtgaacctaaaaaaaggtcgtcggaaaaattttgagtgcttttttcaatttcgtagtttattcgcttagatttgagtcatcgattttccattccattccccggattgcctgaaattcttcggtctaaatgaaacatttgtaattttcagatcaaattcgagggtgaatttcaccagctcagtcgctccattgaagaaattcgggcgaaaattgcgcacaaaaaggaccaagttggacgacttagacaacgcatttcgcacacggaaagtcaaagtgagcgcaatcgacagaatgtgctccctctcgaggtcgcgttttttttg

SEQ ID NO: 27289 - DNA, 684 bp, Heterodera glycines
  misc_feature (602)..(603): n is a, c, g, or t
tttttttttttttttttttttttcacctttttttttttttttttttttttttttttttttttttttttttttttttttttttttttttttttttttttttttttttttttttttttttttttttttttttttttttttttttttttttttttttttttcttttttttttttttttttttttttttttttttttttttttttttttttttttttatctataattgttagaggtttgtgcttgtatctttttttttttttgaaaagaaagaattttttgttttatgttttttttggcccgccggcccaattatatttattgtgtttttgttttttttcttttttgttttttttttttttttttttttttttattttttttaatttttattttttaaccgttttatattttttttttttttttttttttttttcccctttttttttttttttttttttttttttttcgtttttttgtttgttttttttttttttttgtgtttttttttgtttgttttttttgttttttttgcccttatttttttttttttttttccgtgcccccctttttttttttttttttttttttttttttttttttttttnncccctcgtttttttttttttttttttcttccccggccgcacatgttttttttttttttttttttttttttttctttttttt

SEQ ID NO: 27290 - DNA, 707 bp, Heterodera glycines
gagacgcagttggccccaagacgcagttggctcagacgcattggccagacgcagttgacccataccgggggggacgggggtgagaactttctcgcccccggggacgggggcgggggtttgtttttaattagctccaaaaaatctcacaaaattttttttttttgaatgatgtgtttggctccacattcctttattcgatgtatcgcctcgattcaattcttttttggtataatttagagtccggtaaaaaaaatttccgggagcgggatcgggaatcccgtgaaaatcccgctcccgttaaaatcccgcagaaattttacgggagtcccgggcgggagcgggagtaattcgaaaatttaattaaaaactaacaaaaatatttttaatgcacaaatttgaaggaaaatccttttattaaagaaaaaatagacagaaaaatttagtaagcagaaatttgaaattaaaaaatcatatttttggtcgaaaatcagaaattttttcaaattgcttcaaataaattttttaaataatttatttgttgactccctttattaattttaacaattttttgcggcttattttggtggtgaccagggtggaagagggaggccggcggtgccgataggcgccgcagggaaaaaaaaattgaatatttaaatacactgtcagattatgtccaaaaatagccaatttttgaaaatttgagg

SEQ ID NO: 27291 - DNA, 1830 bp, Heterodera glycines
  misc_feature (26)..(27): n is a, c, g, or t
actatttatttatatataaacgaacnnaagttatattcaattttcttatcaaatcaaaaaaaatacattaaacgatttaattatttttgcttcataatacaaaattttattaacaaattaaagaaaaatacatcaaacgatataaaatttgtttatttttatttttttttaataaaggttaagttttaaaattttgtttcttaaaaatctgttgctttttaatttaatcattataaatttattatatttaatataattttttaaaattattaatactactttggtttaaaatgtttgttttatttctgtatttaataaaagacaaattttttaatgttttttattactgttaacagctaaaatttaatataattgattttgttttttaatgtatttcttttagttttgattattttgatgcataatttatccgctgcagcttatataatttcaataatttttaaaaatatttctttcaatatataatgcctaggttttatcaataaataatatcgaataaaattttaacaaataaacttccattattctgttcaagaatgtctttatttactcaaaagttcataaaataaaaagaaaattcaaaaataaacaaacaggaaaataaatatcataatcaggcaattggtaatctcgtaattatctaacaattattgttttcggtatttttaataaattatttaaaataatttaaatttcaaatgaataaaacttcaaagtcaaagaggaaaaattattggaattttaaataaattttaaaaatcccaagttttttcattttaaataaatacgacattgaacttatgggttttgagcgtgaaaattgcattaaaaattaatggtaataaaaagcattttaaaatttagaaccctttttaaagttaattcaaaattaaatgtgattctgaaatacagtactaccaaaaaagttaaaaatatgtaccaatatgtaaataaaaaattttatgatttttttttggtggttcataaatattgtattgaaaattaactttataaatttttcaataaataattaaataaattaattttaataaaagttagaatgtttcaaaagaagaaattgcacaattatttttatttcttgtatttatttatttatctaacatgataatatcacatcatttttaaaatatttttatattattattattattattataattaaaataaaattattatcatttaataaatctcatggaatgtcatagcgcttgtggataaccgtgtagaagccattccagttgttgctttaacgtggggacaaaattgggactttcattaactgtttaaaagcttttcgatggattattataataataatttatattatattacttattttgattcaaattatattttttaattaaagaatctttatttgctagggttttttttattattaaaatgcttattttgccttacatttttttattatttcttttagattgttagctcgaatttaattgtgtaaattgtaaaaaaaaaataataatactatagtaatttttcttttgttattatcatagaaagttttaaacgagtgccaacaatgaggtcaaaaaacaagaaaacaaacaagagatttttattagttatattattaattttttttttgaaaatgcttaaagattaattaagcttttgattagaatttaaagtatgataagtttcttggttttttcttaaatttgaaatttcttattcatcataaaaatatataaaacacttattatgtaattagttaattttttcattttgagattaagaaaataaatgatatttattgtcttt

SEQ ID NO: 27292 - DNA, 1179 bp, Heterodera glycines
  misc_feature (1162)..(1162): n is a, c, g, or t
ctcaacttggccctaagaaatcgctagaaaagggcaactgcagccaaatggccggttgacggaccaccgaacaacagacattcattttggtttttcagattgtgtaagcgtcaaaattctgaatgccggagcatggtcgaggagtcgagaccgttcgcacctgactttgccacgggaattggaggatttgatcccggaagttgaggacttctacaaaaagcagcactgcggacgaaagctgaattgggcccaccattggtccacggggacggtaattagcaaattaacattgaaacaaagttcacaaatgccgaaggtttcgttcaccagcaaagcgggaaggttcgacttggaagtgaccactcatcagatggccattttgttctgttggaacgacagacccaacgacaaactttcctttgcgacgattcgtctcgcgactgaattgtccgagggcgaattggcgagaagtcttttggtccgttctccgttttggctgcttttcactgctttcctttctttcagactttggtgaatttccccaaagtccgaatgcgactgatcctttgcgaaatcgcccaacaaccgttgatcccgaaaagcttcaacgactccactcttttttggcttaatcacgagttttgcctgatcaaagtaaaaaaaagtaacaattgacggacgatgcgattgatctgtgcattgtcagaatgagaagccgcaaagccggggaaagattaatctgatcggccgattgcaactgaaccaagacgcaggcattgagcaggagcacgaggagatactccaactgaggactttccgggttcaagaagcgatcgtcaagataatgaagacccgaaaaaggctgaaccaagtcagagacacgagcaaagggagggagggacaattggcacgactaatgacccaattaaggctcaattgcaaacggaattggtcgatgtgctcaggaatatgtttttgccctcccggaaactcatcaaggaacaaatcgagtggctgatcgagcagaaatttctgaagcgggacgacatggacatgaacactttcatttacgttgtttgacttcgaaagtgcgcgtgcccggaaaactgcatattttgtggcatttggtgactttgccaacaatgaattgattgattcgtanaacataatttgtcattt

SEQ ID NO: 27293 - DNA, 1562 bp, Heterodera glycines
tttttttaaggagttctctgtcttaatgtacaattttttgatcaagaaaatctcatccggcataattttatatttacgtttattatctcgagatcatctgaaaaatatgtgataattgaaaatgttttttctttgtcaattgctttttatgttgtttattatcgtttattttaatgtaacaaatcaatacaactgtaatttgtattgtcctgggaattatgcagaagggtaaagttaatcataatataaaataaaattagaaacattttttaattgtcacattagtaaaataattaattttttgctcatttctcatgaggggagggggggggggaaagggtggaggagggagagctggtcccgattttatatttttaaactttgtgaaaccatttggttggcatccacgaataaatgaaacggtacggatcaaaatcgccaatttaggcgtaaattttgtcctggacaagaatgtttgttacgagcagccacataccggtggacaaacaaaccccttttggcccttaaattgaagtaaattgagggggtggaaaatttttaaatttcgtatgaaaagacaatctcgattgggtaatgtcggaatttttgaaaaatgcatcggagtagctagccataatcaatagtctctatttagctggaaaattataaaaaattaaaaaattcggaatcttgttaaacatcaaaaccaaatgtatcaaatttatgaataatcgcacatttttctgaagcacttcaacatgtttgttgttgtacttttctgcttgtggtaagtgtttgttgtttaacggtttggaggtacaaggagtagcagtgacagagttggccatcggttgggcttccgtcgtattgcgggaaatgacaaggaagatttgaataggaaaataaaataaaatttatttttatttaaaaattaaaaaaataacatgtattaagtggtttttgatgtatatttaattaagtaaatttaaaagaaaatccgacaatccttaattcagatttaaagtttcaaaaattttgtataatttctatttttttcgcaaattagtgctaacacaaaaaactcgaagcacatagatcaatttcggaaaattaaaaagaagaagaatcaatagctcaaaaaatgaatgaaagaaatttaaatatttttacaaaaaataaattatgaatttgtggctttttgaaatacgcggaaaacataatgccaaaaatgtatacaaacaatctttagtcactcattggcaatccgtccttttttgggccagtttgaccaactccttcgtggaggcactgcggctggccggctcattcatcccgtcatctccatgggtaaaatgtcaaattgttaattttaaaaataattatagcataaaaaaggaaaataaaactttggcaaattggagtgcaattgtaccaaatacggttctcagctgcttgctgctaattaatgagttttttcaggcgtccaggccgcgtgtcgttcagtctgccagtgccaagaaccgtcactgaattgccaagtacgaaattaatagtaaaacatt

SEQ ID NO: 27294 - DNA, 494 bp, Heterodera glycines
tgaaagaaaattgagaattttcaaaaaccaataagtttcttcctgaaaacactgaccaaataattttatttctcaaaaatttagagagaacaatagaaatttcgtgaagaaaatcggcagacactcggttgatgtttttatttcaaatttgtttttgcttttaatttatcttccccttcccccttttttaccccctctttcacccttccctcctcattaccccctcttttcctcctttctctctcccgcttcttttccgacctcccctcctctcttcttgtgctctttgttattctctaatatgtaagttcgttctcacatcatccgttttggccaaatcgtccacctcgtcgtcccatatttctccgattttcttcccttactcttttctccattcctttctttttaacgagtttgacgaccgggacacgcaccaaattcgtggccttgggcccggcccctcttttccgagttggggtgggggaggggggggg

SEQ ID NO: 27295 - DNA, 2182 bp, Heterodera glycines
  misc_feature (696)..(696): n is a, c, g, or t
  misc_feature (2033)..(2033): n is a, c, g, or t
  misc_feature (2066)..(2066): n is a, c, g, or t
aaaactgcccaaatcaaaaggataataaagtaaaagatccctaaggtgcaaagaaaaaaaaattatgttttaaaataattcttggaatcagtaagattgtagcttttaaaatttgggaaaatgcctgtatggacctaaaaaatcggaatctctaaactacaattttattaatacaatctgccaagtttatttctacgtggaatattgcatgattttaattttcttactttgcaatccaaactaaaactttaaaatataaatacataacaaaaaataaattccaaagtacttaaatgaataaaaaataatcagcctagaggaaaccgctgaaatgttggtcattcaacgaaaatatagtaaactaaaaaagaaatcacaaaatacaaaaaaaatgctattgatttacgtaaatttatatttatttattgtattgatactctcgcgaaagacgaattttttaattttttttaatttttaaccagaatatttaacttggaagagaaacattttttaattttttgccagtaaaattgatcctatcactatattagttagagacgacaaatccgccgggtacggtagtgacgtcacccaagccaaaaggtattggcttggtccctaacctattgaaggccacgacagatcttcgaccccagcgcgtgatcgctgacttcagctggtagggagggagatgtntgtgtttgctaattatttgaattagcgccaaaagatgctcgttaaatcgatcatcattttgaccccttcgttctgtccatttaaacccgcccttttcccccatccgtgcatttctccctcatttcatttgttgtatttccaatattattgtgaccccgctttctcccctcgcttattatattatatttatttgtgttgaaataaatcaatatttatttcattgactgttgacggacacaacaaaattttttcactattacacaaattatttattatcaaaatttaacaaactgtctggcaaataattttgctttaatatgactatagacatataaaccataacaaaaaccccgccgtgcagattaaaatatttctttaaaaaaagtaatattaagcctagcattaaatatttaacaattttgcaaaaatttatttaaaataaaaaatgctaatcaataatcttcaatttagccaaaaatatatttttatttccttgttaatattgactgatttatttttacattatatgcaaaaaataatatgaatatggaatatgctgaaaattctcttttttatataaaatcatttatatatatatatctctttttattttatactttttatatttttgggtttacgcctctgaaaatattagttcgacttaatttcagctttaatactcctaaaatataaaaaatctatttttttttgaaagtgagtgaatttcatttattatttcattacagaagagtgaacaaaatagtagtcttgatgttgcttaaagccatgataattattgttttaatatgctatgtgattagtaatgacaaagaaaaggataaagcccatacgagcattggtaatagtaaagctcataaatctgatctatattctgataaatctaatcttcaacctgaggatgctcaaattaatcaacaacatcttaatgctaatcgagatagtaacaaattcgatcataatcataataatggaactaataccaattgtgatgctaatcaacatgaccaacatcatcatgctaatggagttgatggtgattcggatgataatcagcttgatcagctttatgcaaatcaccaactcgttcaattacatgcaaatgggaacaatgatcaccccgaaaatgacaatctttatgataacaataacagtgataagtcaaaaatagttgaccttgacgatgaatttcgggatcagttccctgagctcaccaaattgccagaattaaatggagtagagtttgttgggaatcatataaaatacaccaatcaaccaaaaagcgacacgcataaagacaaggaaaattataacagtanaagaacttatcttagagaatttaatatttattnagttttcgtaagatggacggacacagcagaatcatttgacattgaaaggaagaaatagctgattaatgctatcaatgaaaagattatcggggtttaggttttgactggatcactaa

SEQ ID NO: 27296 - DNA, 1905 bp, Heterodera glycines
tcgtttacaataaggttcatggtaatggcaccggcacagaaaaataaaatcacacaaaatggtggatcaacaactagcacattacgcaacactcgtcgaaacagtggcggcaccaagacggcgttccacgtaaatcacggccaaaagtaacacggcacagaccaaggcacggaaggcacatttcacccaagccggccaatcactaacgtcatcgcttccacccgccgatcggtcgtgcacgttcagcacggtaagcgagaggcgtcgccgaaaccaatcgttcccgttatcgttgttgttgttcatccgtttttgacgacgttcgccagccatgggttgaccagaagcaatggcatttgaggcggcggtgacagttttctaaattttaaatttacttttgatatgacgcaaaacgttttggcattttgattaagtttttgttttaattaattagcctgtatgtgagtctcgctatcgcttattcgggggtcaattttagcttttggtatgccgaatacgttttcgtgattttttgaatattttaatttgcgctgtttgggagactacaatttctcttttggcatcgcacatgggttttggcatttatacaaggattttatctaaaataattagcgctgtttgtgagccttggtttcgattttcgcgtgttattttttgtttttgtgcacttattacctgtttaagacttttttaaatgggcttccaggtattagcctaacagaaatatgtttattaatataatgtgcaccttttgaaatcttgaaatattacaaaatataattaattaattacctgtttactacttaaaaagatgcgtaacgccaaattgaagtgtgccaaaagtttatttaaattttctttaattttgtcgccaataaatttgcttttgctgattttctgcttcaattcatcaattatatggtcaacgtcaacattttccagcaattgggttactgtaatgtccaaatttgttacagtattggcttcaatatgatttccttgcaccaattgttgacacaaattcattaacaattcccgaaaattggcatcaattttcaaatcagcgatttcaatgctacataaaatgccaaccattgcattttcctcgacccatacagtagccgaattacggtcaattttaccggtgatcagcccattgtagagtatttgtgccttctccaacatttcagttgccttcatgctgatgctatttttattatcactgctttcacaatgttgatggatcaagcttatcagcaaaagtattaataaaaaagatcgcatcattattttgttgttataaatgtttaaatattattttcaggtgtataaatttttttatgtttaaaatataataaaatttctaaatccaatttattattaataaaaaaataaataaaatcaataaattcagctgcgtcatttgataaacaaagacaggggaaatggcaccaaattaataaatgtttgccaatttttcaaggaaaatgaatgcataatttttatttaaaaatatgtttgcgtaataatatgctagcgtatttcgtaaatccgtcaaaatgggacctatttcggcaaaattcataaaatttactcaaaaagacaattttttgatagagttaagtattttctataagttacaacaatagcaaataaattttaaaatttcagaataattgtcatcagatcatcagaaattcacaaaatttactttaaaagttttatttatgaaaattttatatatttttaagttgtttattaatagataattattggggcgcttttttttttatcacaacgccgagatttaaattatggtggtgaatgaatcaattcaaagcgtgggcgctgttcgctcaaaatccgtgttttctgcatccaaat

SEQ ID NO: 27297 - DNA, 1880 bp, Heterodera glycines
aaatttcaccagcagatgtgccgaattgcgctgccccatatttgtctgtatgtgcttctctgtttgtatttgttggccggcgcgtgggccttcgcgcgcattgaacacaatgcggaacgcgcggaacaggccaaaaaattggaacgcattggttggtggtggtgggctacgatattaactgatatacagtacttgctcgattatagccctgggggggggctctattgttcaacccctctcaaaaggggggctttattcgagaggggggttctaattgagcaaatacggtattccaattgggtcacaatcactttggcttaaagttgaattgtacgagcaaattgcatccgcggcgggcagagcgtgtgccgtacgcccggacgaccgctttcgcaccggcatttatgcgtcattggcgcgcatttcgcaattttttgagggcaaacagttccgcttagtgcccacgctgatgaacgacgagcaaacgtcgcctgaggagcttcagcaattgttggacgaagtgctgccgccccggtggagtccgatgtcgtccgtactgtacgcactgtccatcctcactgtaacataccgtacttacattacacaccagggatggcactgcacgaaattctgatttacgacttccgacatttttggacctcgggattccgatttccgaaaaattgttgaccctcggaaatccattttccgttttagaccaccggttacggtcctacgactccactcactccactgggtcaatggctgtccatcggatacggacttttaggaatgttttccgctgcagcagaattgatgcccattcactaccgtaaaccctttacaggcattccgcttaccgtactcgccgcggtggacatcggtcgctttctgtccgacgtggtgctcatttcgtacgacaaatttctggtgtttggcacttttaacttcacttacatatttgtttattctctcacaatgacagaggaccgccaaaagtttgttggcattttgcggggttcgctgtcggactggcaaagtgatttcgcatgttgagacgaaggcactgcagtcgctgaaccgactgcagcagaaaaagccaatgtgagcaaagcgaagggggggggggactacaaaagtgaacaaataccgtaaacgaatgccagcaaatatattacggtaattgcaaaatgatttctgtgtttgctgatagggttgcattggccatatcgaagaagaaagggcggcaaaagcacagtgacgaacacggaggagaaaatgatggaggagcggcggacaaaatacaaaaagaaaaaggcaaaacggagcccaagggtccgttttcaggaccaaagattggaccatgaccatttaatgaggtatttgtggctttatgagcaattaacgtcccctcagggaaacgtcgtttgccgctttccgtaaatgccgccattctgttgcttttctgtatgctcggcggtgtcgtttacattgcagccgcgggcagtgaccacaatttcatcgaaggcttcttcgtcactttcaatttggtggccaatcttacgatgagcggtgaatgaatgatctcgaaaataaaatgacctttttggcactttaccatttcagaaatgccaaccgatatttctcggcttatgacactgatctacatttttgtgttcgttacttttggtaatacatttttacgtttcagtaaaataatttaatttaattttgcattttttatgactcgctgttttgtcaatgtgtgccgaccttgcggccagcgaactcaaatggtgcaaaattattttcgttctggcatggcattttccttcataaaatgtttttttcgtaaagggtgttcctgaaaattcattact

SEQ ID NO: 27298 - DNA, 1381 bp, Heterodera glycines
gaagcggcagagtgagttccttcggtgcaggaaaattattaaggaagagagttcattatttatttatttttgcaaaattaattcataaatttttatcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatctaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcggttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttgtgttttcggggctgcccccccgaagcgatgcccccagatttatggagagaccgaacttttcgggaatattttctctatactgtgcactatatttgtgcggtgtatttgtgctccccataagtgtttgagcaccccacacggactcttgaaaaaatcgatttttttgttttcggggcagtccccccgaaccgatgcgcccagatatatggggagaccgaatccttcgggaatagcttccctatagcctgtactttaattctgcgttggatttttgctccccataagtgtttgagtaccccacgcggacacgcgaaaaaatcgatttttttgttttcggggcagtcccccc

SEQ ID NO: 27299 - DNA, 1224 bp, Heterodera glycines
caggattttttgggtttgaaaattaaaaaaaaattttgaatgactgtttggctatcgttttatttttattttcgaaatttcatattaaatttataccaaatatgttgtttttcaaattcaattactaactttacattatttgaataaattcgttttggttatttcaattgtcaaaagtaaaaaaattgggataggaagaataaaatagagaattaattcgtatttaaaaacctgatataaaattttttgttttaaaatatctataaggacttaaaatttatcattgattaaactttatttatcttttacttcaaattatcaatactttattcactcagatcctccccatttttataattgtatttttaatcatgttttgagtattttagtaagaaatgactaatatataggtgagttttcaaaattttattcgattatttaaatcattgttataaataaattttcaagaaatacatcaaattaatttttttcaaatattttaaaccatattcatcaatgcgatgattaaatataataatttataaatataaataaaaattatttttttgatcaattggcaatttaaaggaaatttcagtgagatatgaaaatatgaaacgtaaatgacttgtaaaaaaaacaatcaaataatttttcacaaattttgaaaccattatactgttgtataatatacaaataaacaaaaataaattttttacaaaaataaaacaccatacgcgcgatttattcagccgagtttatttccatgaatatgttaagtgtcacattacgcataatttaaacaaattattaagaaaaataaataaaatataaaaaaacaaacaaattaaattcaatgcattattaaaatcaacgggtttaaggaaagtgggctgtacatattttttaaattatgattataatatataaattaaatatatgtttaccaattaattttttcgttaacatttaatttgcattacaattatcattattaaataagtatagttttgaaatgtagaaataatttttcttttattattattcttacgtattaaaaataaaaaccttaaatattagtatcatatatatttttctgatatgatatattagattaaattttaaattaaataaaagcataactatgaatagtaaacaaaacacatttcttaagtcaagaaattaaatgataggaattttaataataaaatgatggaaatacat

SEQ ID NO: 27300 - DNA, 1380 bp, Heterodera glycines
acttttgcgcctttgcactcatccattcgaaattttcaaaacgaaaattaataaaataaaaattaacggatatttgtaaaattttaattgccaatttttttgaaataatgtacataaatgagttgcctatttgtcgcgtcggatgacaatttattatttgggaacaaatgacacaaaaattgggctcattttcatcagcaaaggaaggaagcattgtctccccatggcacagctgagcccacaattatctctacacaataataattcattttgccgttaagtctttctttgtgaattgcgaggaaaaagaaaattcgtaaatataattaattactatgagacgaagaaagaatttgaagctttaggctaggcctaggcttaggtttgcttgtgtctaggcttaggcttagtgcacacaatttttatctaaaactgctaccaaaaatttccgtctttaaagaaaaattcaaaaattttttaaattttattacagtaccggagaaaagtttatgagccgacttaaaatttttaatttttgtattatctcggaaacgaataacgatagaaattggttgattttttatttccgtttcatttttctctttttaaaagtgtcgcaccatttaatattgggatttttctgtgctcttaggattgagattaaaatttttttcttcgtgcgcataaacttttttgcggtactgtattattttttgaaatttagaaatttgcgtttcgttgtgtcaaattttttcattttttgttaatattttttgaaatttacacgcaatttccttttatcttttcttcatttttatgttcccatcactgctacatgaaaacccaatgttcaaatgacgtgtaacctacataaatatctaaatttaactagtttgtttaaatatcggatgatcctttgactaattaatccaattaacgatttatttcgcacatttcgacccctccccctcctccccatgttcatttttcctcctttttttgtcttgtttacgcattcccatattcctttatggtttcgagtgctaagataagagaatgagacaaacaacattcttgcttatataaggtacatagtatttatgttccttcgcatttggttgatggtttttgttgcataaattggagcatgggaaggtgaagctgcacttattcatccctaaatctctgacaaataaatgggttgtaaatctccaataatcacttctccgtcccttcaatctttcattgagttgttcacattcttttttattcattccctaatgtccgtccatccaatgttttataatacacaaagagaagattgcctctgtgagtgttcttctccatcgcattgtttgaccagcaagcagcaggtccact

SEQ ID NO: 27301 - DNA, 952 bp, Heterodera glycines
tttggttttctttgtcatggccttttcatttggccagccatttttgacaaaatttttgacttgaataatattttcatcgcgctcagaagcagcgactaggtccgaaaattttaatggcaattttgaaattgtttggccaaaatttgtttcaaaatccgtttcggcattgatcatggcgatgattttctcgtcttcggtctcatttcctttggcgattaggcgcgagagcgcatcggcttggccaaaatcctttgtgttgatgtattcgatcgtaaaatcgtaggccaacaggattaaagaccagcgaagaagacgattggcactgcactgcctaattccctttttgctgccaaaaatgctgacaaggggcttatggtcagtctgcaatgtgaaatgccgtccataaatcattttatggaatttttgtacggcaaaaattaacgccaagccctctttttcaatctgcgaataatttttttccgcaggggcgagtgattttgaagcatgggcaattgctttgatgtttccgtcctgaaatttgtgataaatgaccgctccgatgcccaattcggaagcgtccgctgcaacaatgatgtccatttttggatcataatgcgttagcagcaaatcggatgccaaaatttccttaatttttcggaatgcattttcgcatccttcactccaactccaatcaatttcctttttaagcaaatcgtcgagcggttttcgaatgaaccgcatgtttttgacgtattgttggtaatggtttaccataccaagaaatgatcgcagagatggaatgtcgtttggtgcaggcatttgactaattgcataaatttttgctggatccggtcggcgtccgtttttatcgataatctgtccgagatatttgatttgatcacggaaaaatttgcatttcgccaatttgacgcggaatccgtatgcctgaatt

SEQ ID NO: 27302 - DNA, 1853 bp, Heterodera glycines
ctcgtggagtcgtttttggtgctctcttggtggtggccatcttcgtttttggcgctatcccgaggatgaggccacaaaggttctgcaaataaataaaaagcccagaactctcccgaataataattgtccaggttccttgcgttcaactggacctggccagatgcgtcagtcaggtcgttgctgtgccgtcttccgccgcttcgtttcccaattcaatgcaagtggaatttttacggatcgacgagaaaacccatcagagagatggcgttaggttcgctttgggcgtttcgtttcgtcttttgctcattttttgctcattttcagtttgatgctgttcgctgccgatacgccggaggagaaggaacattggatggactgtatcaaccaatccattcgtcggtccaatgtttggagaggcgttcaaacgaaagtgctaattttgatggtgcgcattgtttgaacggaattgcctctctcattcatttatttggtggatggttcaaaaattattttattttctgattttgtcctgactttgtcgttcgcttcagacattttatattattgtttactgccctattccttgcacaaacaaaacgtaattcacgcatagaaatcccccgttcaggaacggattacttttactgattttatccatttcatttttgatttgtatgcttcgtttgaaatttcattgataacaattggtcctataacttgtattcgaatatttgatcgggagtaattatataattttctttcccatgactaattattgagtccttttgacggacaatccctcccaattcgctttccctttcattctctaaaatggtttacctctgtttacaaaataagggctcactcaatttacgcttgcttatttctactttttattccaattttagaaacaactttttcattgttttcaatttgtctcaattggcttttttggggggggtgactttcgtgggaagaataccagaataccgagccgtagtgggaagagtgagtggatttaattgtttatttggtgatggcttaaagtgtgcctgttcctttctgggacacaagcttaatatattttttaaattgtgcttccgcaaattataaaccgcaaaaaaagccgtacgagaccaaaataagctccttaaagtaaagcgatccgccgaatgatgtctgctcaatactttcaatgttttcttaccgtaatttctcatggacacccaaatccgagcgccctttgaactttgctattttcgttgttttttctgatcaatttttgtaattggttcccaattggcatttcccccccccctccagtccctttcttatgtttacggtttcgctgttttaaaaaatggagaataacgtcaaagccttcctcgtcggaagacgaacggaaatgcgaatgcatcagaaatgggcgctaatccgagcgctgttttcctttgatggctcttttcccgtcgttttcttttcacatttttagaaaaattgctcacaatgtcaacgcatgcacaatgccccagcatttaatatgcagcaaattgtttttgtgtgattaaaataatgacacaaataatgcgatgacgcgaaattgccaagacaaaaaaaagggggggggaaagaacacaatgaacttcgaggcgaataacttttggtataggcgcgtaatcattttgtaataaatgataccactagaaagcacatcaataaaaatgctataaaatgccaggtccttttttgctttttaaacttttgatcgactaaaaatattggaatgaattggagtaattagctacctaataagatgtaaggacacactaaaataaaaataaaaggcaataaag

SEQ ID NO: 27303 - DNA, 1226 bp, Heterodera glycines
gatgtgtaccaataaatagagagtgccagagaaaaacattatctttttttctctaattttttgtctccttttggcttactatctaatattttcattattagcaaaaacaacatttacttctctccatataactttttctcaatccatacaatctgcaccaaattttgtatatcgatagagaaaaaaatttggaacaaaatgtaagggtttttaagagcaaaaaaggattatctaaaaagttattcgagaaacaaaatttaaaatgctcatattttttttctaactcatcaaattgcttagcatttgcttagaaaaagcttctcatcatcaagagctttcgaaagataccaagattatccaatttggttggcaaaaaccttcaaaaataattaccaaatatcgtgattttttaatattttggacaaaaataaatgaaaatattcatgttgcacaacggactcgaaccaccaccctttgtccctttactatcttacaaaaaccactgagccacacacgcaaatcttttttggtacagcagctcagtttccggacgccgtgttaagttctagtgattttggataatttaaaattaagaaacgaatccggctaaaaaaattggttgcgttcattttaagtgttttgttcttttgcattttattagggctaaattttgtgattttagatgtttactggaccaaaaaaacatttttagaaaaaaccgagttttaagtaaaaaactaatcggttttttaaaaaaaaattttggtgcaatatttttacacatgactgtgtgttcttattttattaatatttttcttctgaatggcgttaagctacttttcgagttattagtgcctattttctaagtttttatttttaacgcctaaaaagcctaaaaaattttgaaagagcctatttttgactattttggcattttgcccatacacccctagaatcaactcaaaaattttttcaaaaatgcacccctaagaaatgaaaaattttcttaaaaatcgtctttaaaatttttttggacaatttttgaattcaaatattgattttgtagaattttttacttttttgaataagtttttgtcattttacacccctaaaaatgaggttttttagtgctattttccattagagcctacatattttggtggttttttagagcctaaagcctacctattttggcggtttttagagcctataaatattagccctaa

SEQ ID NO: 27304 - DNA, 1727 bp, Heterodera glycines
  misc_feature (47)..(47): n is a, c, g, or t
cccattatcaatttttatgtgcctttcgtctgtttgtttcccccccncccccccgactttccaccgttccgttggcattgttccgtgtttttgtcattttcggtccgtctcatttgcttttgtccgccgtattgttcgtacatctgtcgtctttcttctgcacaaacagaagatgacgacgcttcgtccgattgccaaaagaaataatcgactgacgacggcgccggttgcgagtaatgtaattcttgcgaagtgtcggcaatggcaaaaggactgaacgcagcaacgggtggctgcaaattctcatcgtcgtgtgccttggaaatagaaaatgcttcattaattgtcattaattgcgggggggggggggggggcagtggtaataatttcgcattgttttgccatcaaaaaaggacaatctttcgttgaccacctgcacaaacgtagaggctggaaatggcagtgactgattgctgttgtttgagtggagaaaaaagtgcgattcgtccgacatttcctccttgaagaggggcgggtccgcgtacatcgacgacggctgtgaaatgttcgattcgtccgcgtactcatacctaaacaatgaatgaacaaccatcagccgactctttctttggtcatcttcgactgattattgagcgaggcgtgcaaatctcttgcatttttcactctttgaacttgccttatcgtcggtgagaaataagacatcggttggccaaattactgcgcgttgttggagcaattcggacgcattaagaaaaatacaaaacaccagagaaaaataaaagggtaattgaaatatttacaaaagaaagaaaattggtagaaaattaaatgatgaaaaccaagataagatctttcgaaatctgagttcagattcgtatacaaaaccatgatgtttaatcagcacatattttcatcccaggaaaaacaaatgtttaattatttttcgacgggaccccaattctacaccattgccgtacttctttatcaatttctaagtgtgtgactccgtttatataaaagtgccaactttttgttttggctctttaccaatttattatttcccgattcgattttataaaggaaattgccagggaaaagcgtaacgggggacggggagggagggagggggaaaggatggcaaatgcgcaatttgcatatgccttggaggacacttttcttcaataaatacagtacaaatgcaaattgaggaaaacacattcttcaccaaaaaacagcgagatcgaaccgagacagagagaaaaaaggggggggggcagagaatgcgaaaatgaaacgaaagttaattaaatacaaataaaaggatgaaaatttaaaagaaagtgtcttttagcgcctttattaacaaaattcgaaagaaggcaaattcttcttcataaagtggacattcaatgcaaaagaaaggacaaaagaaaaagatggtcagaaatgggccactggtcacccccccccccccgccggtcgacccatttcggacggagccatccatccggcaggcgcccagagacaatccccgcgggcaatgtctgttgccgcgggggagtggcgattgaagtggggaaggggaggaaggacatgtgacagtgatggcgaccttcagagagtgctcgggcggaggagagtcagacggaaaaggtttcccgccaatttctgccctgaccacccccgccccgaggcgagccctcctc

SEQ ID NO: 27305 - DNA, 1105 bp, Heterodera glycines
tgcagaaaattaatggacaaatgatcaaaattaaaattatttggtcataattaagaaatgaatcgcaactttttgagccatcgcaatgtgctcgtgcgtttcttaaattcgccaaagccaagaaaattaaaaattaacacatgtatcaaattgtcaaaaggaaataattgttttattctttttgattcgatagcccaatggttactgtattattttgaaattcaaaaatattcaaaaacttctgatcaacttaatttgatcttttggtacacccaaacttatcatttttgatccttgaaaggacgtcaaggcccattgacaaaccaacgttggaagcatccatgcctcgaaaaaatttaatgtttttttgttcaacttaactgaatattccgcttacattcaagtcacgggtctcgtgtttttttgggcctcggtctcgagtctcgggaaattttcggtctcgagcattactactactagggattgtctagaacagtgttcctccgtctgaatttttttactccggaatcccggatccagatccattgaatttggctgtcccaagcaaaatcccggcattttttctcattccgaatcccgaatctaatcagctgttccccttacatcctttgatatgttcgacgccttctccggtcgaagtcgacacactgttgcaacacaattccacgagattcgaacagtgccatttcagaacactgacctgaaccgcaaattttgatttatgccataattaatgaaaaaaataaaataaattgttttgagtttgttatgacgctttaggaagcaacttttgcagccttaattattttaattgaatttcataaatatttaaaaatttctattttaatgcatttattttaaaattattattcgtttttttattttccctgcatatttttgacgtaatgtttcgaaattttttgaaacccacgtaattgttttcttcactattaaggcccaattccgccaattcaggaaatgttggcaattgatgctgatcaattttggtcgtatgtacgagtcctaatcaaatatttcatttaaattgccagaaaataaatgttaaaattcactcacggtcgta

SEQ ID NO: 27306 - DNA, 926 bp, Heterodera glycines
ggcgtcagcgttttggtgaacgcgagaatgtgtttttcaatttttggtcgcatgtatctgagttttacccatgccaataaaatgttgctgacgtaaaaaactcaaaaaaaaatttggcgctagttaccaagaggtccattttgactattgttcctaaggttggacctgttgtgacgacaaatcatttcagtatgatacttgaaccgactacacatggtgatgagacgaaccagaacaaaacggaatccaatactgaacaaaatgcaagtgataattggtcaatgacgggggcaattaaaaaaaaggaagtaattaggagttttagtaaatttaaatggcaataaatgtcggttaataagtgttaaataattttgaggtgattttgattttttcatttgtaaattgtttaaatacttctttttaattacttttaataaaaatttaggctgatctgttgagcaatgagtcagaaaagtaagttgagattcccattcgtatttttatatataaaaaaagattttcacattttatcaacaaaaatgatttattctatcagtccaatgtaaactaatactttttaagcctggcaaaattcatctattgataaattcattagaaatatataaatcagaatattttaaaagcttcaattttaaaattaaatcttttcaattttttctctcaaattaatcttatttcaaaatcaaatctctttagaatggcaccaacaaatgccaccgctggtgtgccatcatcgtccaccgcttcatcctcagcccatgccaccgccgctgctgaagtggaggcggaaacacagctccttttggccgccgcgttggcgcgtgcgcgtgggaaacaaatcgcaaaacacccgccgccgaaagcggaggcacaggcgacgacactcggcgaatatgtgcatgaac

SEQ ID NO: 27307 - DNA, 1049 bp, Heterodera glycines
  misc_feature (43)..(43): n is a, c, g, or t
aaattgactatctcttttctgctcacagtaataggaattccanccgcattctcagaataattacgccgatactaattgctctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgtgaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgtgaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgtgaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgtgaaagatttggaaaaattggctatctctttttctgcttcacagtaaataggaattccaactgc

SEQ ID NO: 27308 - DNA, 1579 bp, Heterodera glycines
  misc_feature (29)..(29): n is a, c, g, or t
tttgcatttatttatctagttgtgcccantcccctctcgctcgtggagacatttaccaatcactcgctcgcccctttctcgtcactaatttttgtccgccaaaaaatttgagggggtttaattatccaagtttgaacccaacttgcaataaacaattttcgattttgtgtcggcaattttggacgggtgggaaaatagaaatggcgaggcacccgcggggcgattggagtgttgttatcttcggcccatttgctttggcatttcggcgcgtcaaactgaagtggactccttttcgcaggagtgcctattcagcgctctgctagcatcggagtgatcgcactgatcagaacgggagcccagtcctgattcggaactcccaagcgcagtgatttggacagaaggtcagcacgccagcagaggtgttgacaaaagggttcagactttgagaggtcaaactcgggagcaccgatctctccccaagtttggtcgatggtgatgtaatcactcgtgggccctaactttgtttgcctcctaaccccctccatgtccaccctcttgcgaaagacggcagcagagtagtgctctccgagagtctcggtctcgagtttgtaagtctcagtctcgactttcgagacttttttacacccctaatgattggcttttttaaaatttaaaattaaggtaattttggcaactttctgcttcatttactcattcatatgcatggtctagtgggttgtgctcttggatgttttcttttttgttgtgttggatcagttccccttcaagtagttattttttcttctaatttttaaaaatatacctttttcgatgggaattcgatcacaaatttaacgattaaaattagggttgttcccctgcatgtttcggggagttacgaaagtcgtaaattgcacttgaaatattttggtctcgagtttgggttcctctaagcaggaagccttcagatttagcctaaattgttcagcagcaaataattttgcatgttttttcgttttttattttgtagcctaagacaaaaggaatagattagtcgttaattttaaaataactgcaaactacgatgtctattgacaatattccttatactttccgattcggccatatttatggatatcattgttgctgctagcttttatctctgatgtcctcataaataaattagagatccatattgacaaaaaattatcttataaatgattgtcacggttggaagtaaacacttgagtcataataacaatggctgagttcctgtaaaaatacaaaatataattaaatttattataacccagctttggaataaataaaggaattttttgcttcgtgttgaacgcgcctttgggttcctataagcaggaagccttcagatttagccagaattgttcagcagcgaataattttgcatgttttttcgttttttattttgtagcctaagacaaaaggaatagattagtcgttaattttaaaataactgcaaactacgatgtctattgacaatattccttatactttccgattcggccatatttatggatatcattgttgctgctaactttta

SEQ ID NO: 27309 - DNA, 1708 bp, Heterodera glycines
  misc_feature (1684)..(1684): n is a, c, g, or t
tagaaattccaaatgaatctcataaaattctcctaatttctttctatttttcaaactacattccactaaatttgatcaaaaacgaagatagttatgaattttcgaaatttgactggattttccggggctcaaatttagacgatttttcaaaaatttgtaaccaccttccaaaaagtctgaaaacaaaaataaagtatatattcgagttcagcaccttaaattaggccataaaaatgcattttggctaatttaggagcaaaaaaatttttcatgaaatgcaaaaccatggggtcccccctttggttttgagtttcaaaatcacaattaattttataactttttttaaattcaagataaaaacatgagataaagcacattagattggacttaaaattctctacaaaaaagctcttagacgattttttgataaaatcaactcctgacgagttattgcgccagaactgaaattgaggcctagcaaccaaaaattttctatttccaaaaaaaattttaaaaatttttctgaaaatgacaccaatcgatagagcatgaaaaacggttgcttgaaagtggtctccgttttccccggaaaaatctgtaaaaaataataaaattaaaaaacggaaaattttcgagggggcctagctcgaaaatttctgaaaatttcagaaatccaaaaacatggttggatagagctcgtcgagctgtacaaaaaagccgcttacaccgacctcctccgatcaaaccccggcgagttattcagccggcgctgaaatggcccaaaaaagtatgcaatttttagccagtttttcggaaaaactgacaagaccttggggtccggtcaagaaacaaaaaaaatccaaaaaagtccaacttaaaatcctatcgaggccgatttttcaattaggcctttaaaaaatttttgaatcccaaaaacggcaaaaaaaatttttaaaaagtgacttttctgggtcccaaattccaaaatcacttttatttctataacttttttcaaaaaagtgataaaaagctaaaataaaatttataaaatagagcaaaaaattacggattttttgagtatattatttttataaaatactttttcagaagggagttaggaatttttttctgaaaaatcgaatttttccagaaattctggaataacttttttatttttgcagatagaaattccaaataaatctcataaaattctcctaattttttgctatttttcaaactttattccactaaatttgaccaaaaacgaagacagttatgaattttcgaaatttcactggattttccggggctcaaattttgacgatttttcaaaaaattttaaacaccttccaaaaagtctgaaacgcaaaataaagtgtatatacgtattcagcacctcaaattatgccataaaaatgcattttggctaatttaggagcaaaaaaatttttcatgaaatgcaaaaccatggggtcccccctatggttttgagtttcaaaatcacaattaattttataactttttttaaactcatggtaaaaacatgagataaagcacattagattgggcttttaattctctacaaaaatgctcttgcatgactttttgctaaaatcaactcctgacaagttattgcgccagaactgaaattgaggcctaccaaccaaaaattttctatttccanaaaaaatttttaaaaatttttctg

SEQ ID NO: 27310 - DNA, 830 bp, Heterodera glycines
ccccccccgacattttccctcattatttcccattctcaccgttttcatttccccccccccctcctctccctctccccctattaatgtgattaataatgagtccctttttgccctgtggccttccgccaaaagctctttgtttgcttttccttctgaggctttatttgtatttatagcactaacattcttctcattccttggctttgtcctccgttttttttgtctccaaacactgaaataaaagaaaaacccaaacctaaattcccatgggaaaatattcattaaaaacaattatcaaattgaagtttaatgtaatttatgggcttatgtcttaatgtctgtttagactgtgcttttcccctttgctttatcttcttctgctttttccaattttgatgcttttccgtttgtttttccttttctttttcgtcctttcactctccggccaacacagagaaacagaaagaaatgtgccatatgacaggtcgtaaatttagacggattgccggtttggcggttgtaagcgatcggagacgggttttttgaaacttttaagaaaatgtgctcccaaattgaaaaagttttgagttttataggaggattttttgtaaattttaaaaatcagaaatatttaaataatcacaaatttcatccattatatcccttatcaattgatatgaattgtcagtttcactcatcggaagaagcccccgcagccgcgtcattcccagcaaattccgtcccaattggccacggaatttgtgccttcgaatggttcgacaaacgcattggaggaggagcagaacataatccaacgattgctgcacagc

SEQ ID NO: 27311 - DNA, 548 bp, Heterodera glycines
aaaattgcatttgatcactgatttgaattatgatcgatcggtcattcttaattaattcatttcttcttcttctgcggctgatcactgattttgttgttttgtccgtcactcatttggcccttttgtgatgcattgtccggcttcctcttccacttctgctggtggcggagacaatggccttaattaggcgcaattttaattatttaaacaaaaacaaatgcttttttaattgctcacccaatgcaattattggcactaaaaagccaaaagtacacattgttacaattgttgtcccaattttcatctttcttctgctgttgcttaaccgccgtggtctccccaattttgcatcgtttcattatccaacttttgtcaaattcatttgctttggcgaatgtctgcttttcctttgtccattcgttcaccaattcaaatggcaccatttgtattgacggcgcactaacagaaaaatgaatttcggaagtgacgtaagaaacggcatagctcacggagaaaatgctatacaatctgattgtataacaacaatc

SEQ ID NO: 27312 - DNA, 1301 bp, Heterodera glycines
cccctcggcacatattggcgacggctcgttgtagcacgactcgccgcacgcgccgatgatgccggtgaagcggcagaacatgtggtcgctggagtcagaatacagctccttttccttggccagcactttgtccaggtattctaaagatcaaaccaatcaattaattcaaattattaattaggtaatgatatgtaataattaaataattaccttgtgcctccttcggctcgtccttgaccttcacatattcgccattgtacaattcgcacaccttcttcctgctctcctccttcaactgcttgccgtacaagtctttcaggaggagaatctgaatttgatttgtattaataagctgggattttattcaaattggtcttgcgttattcaaaattcaaatgtttttcgaatcccatgccattaaataccctttgtcttcaatcatccttttcaagcagtacatgcttgtcatttctgaattcgaactctttaacatttctattctgtgctcaccatgtacgtgttcttgttggcgtagatgaagttgcccgagccgatggtgacgtacttgttgatcttgcgaagctcttcgtcctcctcctcctcttcctcctttgcaccgtacttgtctttaccgtatcccttctcctcctccttggcgcgcattttgcacacggcgccgtgcggtgcccagtactcctccggcttctcgcacaccacgtccatccacagcacatccacgccgcttttgtccagcgccgtctccagcgacagatattccttcactttgcgcggccattggccaaggaaaacgcagttttcgttctctttgttgtagccggccccgcctgcgttgtccatcgtcaacggccgtttgtacgcgccccactcggtcgggctcaagtagtccaccggctttccatccgtccaacttgccttaattagcgagtgactcattagtcattgcttggatcattaatgcttgtgcttctcctcggcttacatcctccagcttcttttcgctccatttcagcttcaggccaaaccaaaagaaggcgcggcccggctgtttgcagttgaattccattttgttcgcctccctaaggacgagcacttaaattggcaaaatattaaaagaattggcgttccgtcctctccccgcttttcttactgttcacaaattcgcgctccgtttcgctgtgcactgacgcgagttcggcaccttcagtcttgcacattttgttagcgtctgaccatggcaggctatgtccgggtttgtgaatgcctgaaaatggcaaaagaaa

SEQ ID NO: 27313 - DNA, 942 bp, Heterodera glycines
taattttgtgacgtgtcatccctcccccttattcatttgtttatttaagcactccttccttgcccacattgttccttctcccattcattttgctattttacattttgtactgcatttgacctccgacataaattgtgttttattattttattgtgtgtccaaaacagagacacaacattggcgcagtcagcagccgtgcttcacccattcgaagacacaccgaactgcaacccaacctcaacaaaaccaatagtcccaagacgggtgaggtccgctaaatttagcggttaaatttgacaaaaaccaatagaccctaggcgggtgaggttccgcaagacgcggttttcttaaatttcgacatccaatagtccctaggcgggtgaggagccactctgcgtggttaattgctgatcatcggacgagtcaaagccaatggaggccacccaactgcagcaagtgcttgacgcagtttttgcacgatttgccggaaatgcggcacctgcaaacacggcctcatcctcactggcacacgcgactctggccagctccttggacaaccggatcaccaaattccactacgattcggaatgcggcaacacatttgaccggtggtttaagcgatttggagtgctcatcgaagaggacggaaaggaactcccgaacagaccaaagttcggcttcttcttggcaaattgggggacgacgaatacaacaaatacagagacatcattagcccgtcccaaccggaccaggttaaatggggcgaatcgctgacaaagctcaaggatttgttcgccgaaacccgctcacttttcgtccgccgcttcgaatgctttcaaattcgacaaaagccgagccaagacatcacatccttggtggcacacatcaacgccgcttgtgaaaatgccgacctcagcttgacaaggtcacgctcaaggcaaa

SEQ ID NO: 27314 - DNA, 1314 bp, Heterodera glycines
ggatgcgcttgtcgtagccggagaaaagataatcgagcagaagggagtcgctaggggcagcggatgaagaagagaaagaagaagaagccgaagagggagaggaagaggaagagaatggcattggcaaatgggggacggaggaagagaagggcgagagagagttcatgggcaaagagtaagagggagggagggaagagacggcacggcgaaggacggagacaaatggacgaaaacggacgaaatgccaaaaccaacagaatgaaaccaaaacaaaaaaaattttgtttgtcagcggaaattgaggaaaagcaaaaattaaaaaggaaaagcaatcaaagcagaaaaaggcaaataaaacaacggacgaacggaatcggtgaagcaaaaagggaaattaataataatggccaaggcaaaagcaaaaggcaaaatttgggaaaggaataaattggcaaaagggaggacaaaaaacattcaatcatttggaaattcaaattgacgaaagggttaaataaacaaagctttgtcggacatcattttaacagcaaaagcgacggatgggaggacaaagagagaaacatttggcaaatgaaaagggggaaaggggagaagggaattcacttaggaagaatggatgttcttccggaaatgccctcacttttgggccattggcattttctgagggcgaataaaataagtgccaataaaaagggagaaaagcaaaacgaaaagcgccaattgatgccgttttgccgcacgttttgtgccgtgccgttttttcccgctgtgtgttcgcaaatcggcgcccttttcctttttccattgtccgctctttttggcctacttttttttttaattttccattttttattcatttaaaaatctctctccaaaagtacaaagcacataatttttctttttgccttttgttacgccaaccatcagaagagagtgtccggtctgttcttgatgtgctgttggagttgcggaagtgaaaacaccgctaaaaaagcacagaaaataaacaaagtaaacaatggcactttctatgcccgattaatgaaattgttgccccaattaaaaatgccattcaccgcggcagtggtgcaaaacgcgggggaatcggtcgaggatgtcgaatcggccaaatgtaagtgccaagtcggcaaaactcgccacgtaaaagtccacccaggtgagtttgtcgcccaccaaataccctcaaacgaatgaaacattcattccatccttggcaattgtttaaatttaaatgcctgtgttattggcctccaattgccgctcaaacattggccc

SEQ ID NO: 27315 - DNA, 1303 bp, Heterodera glycines
  misc_feature (13)..(13): n is a, c, g, or t
  misc_feature (40)..(40): n is a, c, g, or t
atttcgaccattntacatgctcgggaattcgttggaaatntagtcaggatgtataatgctcggaataagaaccgtgattccagcaacattccggcccgaaattctccaactgatacattcggcacatccagggattgtccgaatgaaatccttggcacgacaaaaagtttggtgctaggattggacaaagcgattgaagaaattcgaaaatctttccggccatgccaaattaatgcttctgaggaacgaaaagttccattgcatccatgggaagaacccgaacggccttggcagcgactacacgtcgatttttgtggtcctttttggggatttatgtggtttgtaatggtcgacgccaaaacaaaatggccttggtcattaaaatgaaaaccacgaacacaatacgacaatttctgaaatgcgtcggatttttgccacacatggactccctgagcaaattgtctctgacaatggcccacagttcacgtcgggtgaatggcacgaatactgcaattcgcgaggcattgagcataccttgaccccttcgtaccatccgatgagtaatggagaagccgaaaggtttgttcaaactttcaaacacatgatgcagcgtcaaaaagacggaggagtgccatgtgatgaggctttgcaccaggttttgggactttacagagtgacacctcatccagcgacaaatgcatcgccagctgaaaagctattcggtagaaaattgcgtaccatgcttgatttggcacgtccaaccgatgagaacgccgatcagaataagccaaaactcagtccgacatacagagatcgaatcaaaagaaattttgatcggggaactcgagatcgaacttttgaaattggtcaaaaggtttttgtaaggaattaccgagacgggcctaaatggttccgtggtctgatcattacgaaaaacggggtaatttatctcgttcggactttgagaggcgtttggaagcggcacgcttatcagcttaagccggatctgacggtcgaagatcagccggacaacgaatccgtggacagcgactcggacgccgatgatcaacaacaggaggctgaagatgaacagaataatggcccagctcctcccgaccttcgacgatcacagcggaccaagaagaaaccgcagatcttcgacccaagcagcggatccttgataaggagggagggatgtgatgtattcatccccttgttcatttatcgattattttttgctgtcccttgacctctgcccctccccctctcatttgttatttaagtcttcctttctcccccttcc

SEQ ID NO: 27316 - DNA, 948 bp, Heterodera glycines
tgaaaaacgccggtgtccgccaatagaaattgttcctcctctatttcagttcgcttgtaaatacgataggtatttggaatttccaactgctccaaattgagaggttcggtccgcggtgcattttcatcacggcgtaatcgtttgattacctaaaaaacaaaaaaataacaaaattgtttttggatataaacccactttttttgtggcgcttttgctcggaaaagctgctagcacaggtgtgcatgtgttttgcagcacttgagcacgaatagtcgcaggtgcctcgcacgtctcagcagcacgtcgcttgagtccagttacaagtcgctgacattccacatgcgcagcattcatgtcgcacgaatgaactccgaccaacttctgcacaacgttatttaaatccgtgtgcaaacggcctgaattttaaaagatttgcaaaattcaaaataatatattaacatacccttgcatttgtctgacgggccatgaaactcacatcgccaaaatttcttaagtccatctgtgctcaattggtcgaaaacatagagtgcgccgtcatgttctaacttaactttgtttcgttttgttttaattttttgctgctggtccatattatataatttaaatagccttaatttagtttataaactcattaaattataaaataaaaactcgttagaaaaaagagtgaaacaaattttggtaaaatataatgtgagttatgaattctcttttatatgcaaccacgcgaaaacggccacgcgaaaacgtaccccacgcgaaaacggccacgcgaaaacggccctcacgcgaaaacggccacgcgaaaacggccacgcgaaaatggccacgcgaaaatggccacgcgaaaacggccacgcgaaaacgtcctggcccggcaataaaacatgaaaatccacttaaacaatattttattggcgtaagaac

SEQ ID NO: 27317 - DNA, 1344 bp, Heterodera glycines
ttccaaaattatgaaacgaaaaatgaacttcatattctctgttcagcacatcaaaataccccagaaaaatatttttcacccccattttcaacccaaaaaaaaattctgaaaatttctaggaggcctagctcgaaaatttttgaaattttccgggcatatagcacaccgttcgatagagcttaaaattctttacaaaaatgttctaagacgatttttggctaaacccaacccctgacgagttatgggcccgggactcaaatgtcccgctgaggccaaaaattttttctatttccgggaaaaaatcgaaatttttccgaaaaaaataccagtcgatagagctcgaaaaactatgttttggaagtggtcttcgttttcccgggaaaattcgttaaaaaatcctaaaattcaaaaacccgaaaaccgttttttaggcctaactcgaaaaattttgaaaattttcgaaatttttaaatttcagaaaatcgagcttcccaaactctacaataagtctgctgggcacctttccctcagatcaaaccccgactcggtattcgcctggtactgaagtgtactttttgagcacgcttcagttgccattttctgcaggccagggggtggctctattaaaaaaataaaaaataccagcatgtagaggacactttggcggggtgccctcgcagcgggcattttttgattcgagttttagaaaaaaagttacgggccttcaaacgcaagcaaaagtgagaaattagccgccgggactcagttggccaccggagcggaaaacctatagttttcccagatgcgcctcaaaaagttgtaagacccttccactactttcagggcgctcccggccttcggccgggagattttgtttttgaagacgaactgcaacgtttctctatagtaatataaactagcgggtgcgtgaaccgtcggatctggtacagggataaagcgcttcgcgctttgggagcttcgctacctagattagctctggttgtggagatttggaatttttaaaaaattatctgggacttttaggccgcttcgcggcctcgaacgggcgctttgcgcccgttttttaaattttgttgggcttatacgggcgcttcgcgcccgtttcttaaatttgttgggctattaaggcagcttcgaggcctcagacgggcgcttcgcgaaaaagcgcttcgcgctttgggagcttcgctacctagattagctctggttatggaaattggaatttttaaaaaattatctgggacttttaggccgctttgcggcctcgaacggacgctcgcgccatttttaaattttgttgggcttatacgggcgcttcgcgct

SEQ ID NO: 27318 - DNA, 1279 bp, Heterodera glycines
  misc_feature (130)..(130): n is a, c, g, or t
  misc_feature (1260)..(1260): n is a, c, g, or t
gtcgccaagtgtcagtttggtcgttgcagtttcagttagaacgtgaggggcaaacgctccctctctgttgtccaagtaagcaatttgacatggtcgtcgtcccgtcaatcgatcctggacaagttgttgnaaggaaatattaaaaaatgacactccgcaaataaaacgaaaagccccgaacaaaacctttattttgactggagctgtatttagtatttcctcagttttttgactgtcactaaaataagtttcattattttcacccttataaaggccaggctttgcctcagaaaaggcaacggcctttccctgccacttttctctttgagttgtctcggcgtttgctcctctttcctccgtaagcgtattccaagttgctcctcagttaaggcttttccaaagggcaacgaatagacgaggaacaaaagatacttctcggaaaaataatattttgccaaaactttcaatttttgcgctgccaagaaataaacacttcctgtgttattgtaaagcattgcgttgtcagaaaccagacaaatgtcagatttgaattgatccaaattcaagtacatattattatctattttgtcatggattgttgaaaatgacatcggataatcaacgattgaatgatatccaggcgcttccaacctgaagttaaggcttatatgagttaagatcaggtaaacacaccgagtcaaaaaacgagacatgtgtcaataaagagagagtgcagagaaaaaaacatctctctttttggcgtactatttctttatctgtgttaatagagaaaaacggaatttacatttctatgtttagtttttttgtcctatgttaaatgcgcttcaaattttgcatagcgacagagaaaaaaattctgcatcgttttctctgtttgtttttatagcttaaatgttgttctaaaaagttattcaaaaaataaaatttcgaagcatcatatcttttttctaactcatcaaattgcttagcatttgcttagaaaaagcttctcctcatcaagagctttcgaatgatactaagattgtccaatttggttgggaaaaagcttcaaaaataattcccaaatatcgtcattttttaatattttggacaaaaataaataaaaatattcgtgttgcacaacggactcgaaccaccaccctttgtccctttactatcttacaaaaaccatttcgccacatatgcatttactttttgaactaggggctcaaaattgactcggtgtgtaaaaaacacaanaaaaaacataataataact

SEQ ID NO: 27319 - DNA, 1013 bp, Heterodera glycines
  misc_feature (53)..(53): n is a, c, g, or t
atttcgattttgaattaattaatttttattaaaattttacaattgaaattatntttttcaaaaagttccatttatccccccgggggataaatggagacggggcgataattagagataattcagtatgcctcctaaatagtcagcttgtttttctttttcgtgtccaatttgaacttggtcttcgtatttgacccattacgcatgagcaaagggcgtctcaggccaacgtcccatataccaaattttcatacgtgggtccaagtttttctctggccactttatatattttttgcttttcacatcattgctttttcaaaaaaaaacttgttaatgaggcatagagggataagcgctgcctggaaaattcattgaaattttagtgcaatttgtcgataaattatttgactggaacattactgttttgggcaaaaccccaggcctggctggatccacgcataatcagttccacgttgatctcttatatagtaatttgctgattcagtatcttcgctgggaaacacaacatgcacaagttcgaagttgctcagatcgccaatttgtgtcccgagacggcggaggaggcaaaagcactgatcccgaggtgccattatttcgactttttttcaatttttcacataattttttttgtttaaatttagcctcgaaaacaaaatggaggacgaagaattggacgaacttttgaaggaattgcacgcgaagaaaacattccaataattttttttgtataatttctctatcttatcattttccctatttttttgttgcgtaaaagtttttagtttttcaaacttttgcaatttttttaatcaaataattgaatcataagttagttgagttgccattttaggagagtttcccgcaattgaggagggacccaaactttcgttccttaaaaatttatgataagccttcgattaaacatttctttccagtgaatctgggtaaaagaagtgctgatcacgaatatggcactcatttcggtctgtatcttt

SEQ ID NO: 27320 - DNA, 1998 bp, Heterodera glycines
gctttctgatctgatcagcagtggtcgatcacttccctcactaagaaccaacgatagaagtttcttctccaaagcattcctgtaagtgttttacttgggtatattacatatactgtagaatagatatcccctacaaattaataatgtttttttagtcgacccaacaaaattttgcttcaatttggcaccgtaccactgccaattaggctgagaaagcattggcaaaaatttggcttcgttcatgccagaaaatatgacagaaattgtaatttttaaattaaaatagatttataatttttcaatttatttaggctttttctctcctgttcagtgcatgttgttattcagagacggctccaagctgaaggacagtcatttgtttcggcacttcagccaaccgaacccattttcactttttattttctcgcacattctgaagccagaacaatcatataagccaagaaataggccactcagaaatcagaattatcttttcgattttgcccaataattcttttaaaaaggatagattttcacagataaattttatttgtaatttatttgtacagcttcgattttcattgtatgaataaaaattatcaataaattttgttaaaatattcaaaatgcatttttttgtagtttttttggaaattttgaggctttttgtgatttatagagaaaagcagcctcgttactgtcaaaatattgttaacaaattacattaaaaattccaaaatgttcacaggcgatgcctacggcatcataagcagactaatattttttagtttctcaaaagtaagaaaaaagtttaataaatttgttgaattaatctgtcagcaaatcaattcgggatgtcaaaaatatgtacaaaaagtggtcaatatattttgaagtttccagaaaaaatactaagctgagtaagggcaatttttcaaacccatattgcgccaaaagtctttctttcccaaatgggctaaatttagattcatgctctaaaatatacccacaaaaattattagaaactagcccgagagtttcttgtacaatttagtttttaaaattttcctgataaaaatttccattttggagtttctaatgggacggacgcccaaaagaactgtgacggaactgacccgtttcgtaagaattgacccccaaaaaattcagaaaaatattcttaaatcgactttaaaattttcaaaaaaaaacacccctaataaataaaaaattttctcagaaattcatctcgaaaatttatttattttttctgacaagaatttttgattttaaaagcataaaagaaaaataaataaaataaaaaaacggaggtgcgaaattttttgtagttttgcgaatttttagcatttaaaaaaaaaggtttaaaggcctgtcttacaattttatgattgacttggcgaatgtgaaaaaatgatattttagcaattttttctcacaaaagataaagaaatcactgtagtgatcacttatcacaaatttgataaatttctgaacacatttttacttctagcacttttaaaggtaatttgtagtgaattttgttctcttatagatgattcgaatgatttttcatggcaaaattttccaaattaacgtgtttttctgaatttttcaccacctaaaaacttcaatgtatttgggtgacattcattttatccgcctaaagtaaactattaatgggatgtgttcgtgatgctgtcagtttgattcatttgatcaaatgttagaaacgatctaagcctaatgggacttaatttctccggaaattcctgtaaaactcagcacagtctgtcaataagatttatttctgtaattaaaatgaacattgtgtgaaaaaatatttgtttttgttgttatttaatttatttcaccgttgtaagtttgatcaaatcaaattgggcataaattgccagtccaaaaaatgacaaccattcaaaggctaatcactagagaatagaattatagggaaatccataa

SEQ ID NO: 27321 - DNA, 925 bp, Heterodera glycines
aaatttcaacttttagacctcaattttcgcgtttcggcccaaaaaacgaattgggtcaaaaacgaattggccaaaaaacaaatcgtccgtcgtcctttttttattgtcgtccgttgtataaaaaaaactcccaagtttgccaatttaaaaaaaatcgcatttaaaaaaaagaaaagttcgaaaaaatggtgaaaatatttattaaaatgcgaaaataatgacgaaaacataaatttttcatgtttttgggggtgtaatttttagaaatttccaaagtatttcgtttttttttgtcgtatttttttgtgaaaagttgccaaaatggccgaattatggaggacgagaaatgcacgaaaaacacatttttagttcggaaattcttcgttttaacgccattattcatcactagggctgccaaaagtatgcaaatgcatatttttttcctggcttctccatgctctaaatagtacgaaaaacactttcttttttgtgtttgcgtataaaaatcgggacttttatttgcatattttgggcctttatgcatattttgcatattttggcttgttttacattttcatgcatattttgccattttttgtgcatattttccgattttttgcatattttgccatttttcttcaaatattttccgattttttgcatattttgccatttttcttcaaatattttccgactttttgcatattttgccatttttcgtaaaatattttccgttttgaatatcccttaagtaaattttggcagacaatacgatgagctttagtgccgaaaatcttgagaaattattgattttcaattgcaaaaaaaaccgatacaatttatgaggaataaaaatattttattggattgcacccctaattgtctagattttttgtgcatatttggtgcatatttttgcgatttt

SEQ ID NO: 27322 - DNA, 1267 bp, Heterodera glycines
  misc_feature (19)..(19): n is a, c, g, or t
  misc_feature (40)..(40): n is a, c, g, or t
atggataataatgatgaanagtggtgaggaacaactactnttatatatttttttcctatttttgcacgatcttactaatcatatcatttcaagttattagcacctaccgtattttctctaattattccccaatctccattaatcccccaatctccgtttatcgcccagtctccaccaccattcatttctgataaaatcggattttaaaaaaaaacttttttttttgctccaatacttttgagtgtggctgtattttgggattttttgccactaaaagttctcaccctactgatcactctgacaagctgatgaaaattcattcgaaaaactagagaccgataaaaaaaattttcagggaacagtaaacggggctgtcaccgagaaagcggaaccgcaaaagggacctttttcgcgttaccataaaatttcgtcattttttttacccgaattccgccgggaaatggaaaaaatttttgaacaaataaataaataaatctgaccgttgaagttaaaaaaatattactcttttgttagattatagttaggttctttatgttcgataattataggtttatatcattctatggaagaaaagccaacagaatcatcagaagaagaaaagccaacagaatcataatccaataactttattctctaaatcttttatttctgatctgtaacgagtacacttttctatttcattctttatgctattttttaactcatttttacaaccttctaagattgcattatcagcttttaaaaagatttgtttttaaaaaagaatatacgaaatgaggatattatagcagatgcttttgatcttgtttgtaatggagaggagattgttagtctcaatacagagttggatttttgttccagtcaattatgaaatccaggttcaggcttttcaaaatgacaatctctacattttgactagcagggatgtttccgaggtccttctaaaaatgtcggtgaaatgggggggggggggggggggggggcgaggggggaaaaattacatacatcatactttttcgggatatttttaggcctgaatggttgcccaaaaaatataggtcaagcatgaaatgacaaattcataaggtaggccctgtcagatcacttttcgacacagatctcaattcttcaaaacccactttctctcatcactgacattgacattaaaaaaaaaaagcggaatttatgaattgactcaaaattcgggcacaaatccatgttgatctttccaacaaaaaaaaacatt

SEQ ID NO: 27323 - DNA, 1468 bp, Heterodera glycines
ggctttcaacagatggactttgtccagcattggtcgtctcactttctttccaaattctctcctcaagtgtacagatgagctcccgtcccgctttgtttgtgccctcagcgcgatttaattgagtcgttactccttgaaaaatccgatgcgcaaataatattgggtcagaatagtaaaaaataccattatgttgtctcatcgtgacattaaacgcagatggccgatttaataggaattgggaaggtaaacaacggtataatcaacggcttttgtgtgtttaaggtcgatcgatgagcttttgttttggtatcgtctggacagatagaaaaatcaccggagaacaatgatttgttggtaagagaaaagtaaagttgaaagaatgagacgattaataatgaggctagcgacatttgccagtcatgactcaccatcacataaagcaaatgttcttatcacgcaaactttaaaatttgtaaagattttttgtaaatttagtcacaatcatccaacagcaacatttatcggggtgaaaagatgaaagccgagaaaatgcaataattggggaaagttgagtgaagatcaaaattacgaatgaatgggggaggggcgatttgttattcagttcttagatttcggtaatatttagcaatttaattatcatcacattcaattcgtgtgacttaaatgaaaattgtgtgcgatgcgatcaatgattgctccgattgatgaaggatagaaaaaagaaaaggttggggaggaaaaagaaacatttggaaatgtcacaatgagtaatttgaatggaggaaatgacaatttatgcaatggaatgtgtgtggtgttgaacaacaattgctgaaggaattgtggaagtcagtcagcagcaagtccttccttcgcttttctccaaaagtacgccgcgactcaatgggaggagaagcggcggagggtccaaagggaactccgactcccccccccccccgccagcactctttgttctcccgtcattcatcccaacacattctttaatggtcgtgcgcagtttcggtctgtcagtcagtccccgcccgaccaaatgcagcgattacccacgacacgcttcgtcttttcgacttcacctcgttcacttatgcatacagcgatgctttttgagcaaagtcagtctttggctgcattttttggaaaattctttagtcatttgaacgaaaatgacaaaagaataaatttaacacaagagtacagcagacgaacccaaaagaacggtgaattaaaagcgtgggggaagagcaacattttgcaagggacaaacaatctccatttaaaggacacacgaaaattacttgaggtactgttcttatcgggaaacaatcatcagtgatcgacatgaccaacagggaatcctactgtcgattgcttctggtcaaactccttcccccaactgaccgtgaagcatcgacatccccctcgacca

SEQ ID NO: 27324 - DNA, 1268 bp, Heterodera glycines
atttttctcgtctcggaccaaccctggtccccaatttaacttttttgttctgggctcaaaatcaaggtccgggggttttcgagtgctgattacgaatctggactcgggtttgcctaattattccgaacctcggacccgaattccatttataattcaggcataagtaaaataagagcattttatgattttaaataccaattctaaatcggcccttcaaaatggcattaaaattctccaaccgttcaattttaccaatgcattttcgtttccggcctttgcgtcaaatgaataaaaaataataaagtcatcgagccgtccacaaattgcttttaattgttctgctgaaatttaattaaaatatttggaagaatgcgctaaaatacaaaaagaatgtttttcagtaatactgcttatggtatagggcccttttgcaaaaaaaaaatttaattttttaagtcactgaaaatatgtttctaaaaatttttggggtcgttgaaaacgaaaatctgacattcattttgaccaatttcggatcccggacacgaattcaaaaaaaaatccgattttttcaaaatttacagttgtgttagaatcaaatttgtcgggtttatttaagaacaaaattgagaattttgaaaattttagatttttgttcaaattcgggcccgggattcgaaattggtcaaaatgaatgtcagattttcgtgttcagcaaccccgaaaacctttagaaacatattttcagtgacttttaaaaagttatatttttccaaaagaggggccctaccagggatggcatttcgaggcccaaaaaattttcggaaatcggaattccggtggtcaaaatttttttggaaatcggaattccgaggcccaaaaaattttcggaagtcggaaatcggaattccgaccccaaaaacgtcggaaatcggaattccgtgccatccctgggccctaccatcggcagaatatttgtgcccgcagtttaaataacggcaaaatgatgacccaaaaggggaggagaaaaaatcttatttataaaaatatcattccttttttaaaattaggcaaaatgatgtcctacataaatgatggtgaaatgagaaaaaagaaataaataaaggcaaaaaagtttttacgaaaattatgcaaaagtggcaccgccgggaaagttttgaatttggcagcaaaaatagaaataaaaatggacttttgaaaaggctttactaaatacttacataatttaaaataaatttggtgtgaaattt

SEQ ID NO: 27325 - DNA, 948 bp, Heterodera glycines
ttccgtcgccggacgtcgcaaactccgcacgcatgagagctttattaggtgaacaaaaacacatggccaatcaaagggaaaaggcataaatggaccaggaaaacaatagctgacaatgagttaaacagagctaattttcatttatttgatttgtgtattgttttttgaaaataattgcaattctaacaaaattatttcattttttactctttctttagttggctgtcactctcacacatggaatcagctcgtacattggcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttcgtctattgttaattgcaagcgttccttctccgtcgcgaatttgagcaattcgaatttctaatctaatttgaacaaaaaatcattaatcggaaattcaaatttcttcacttttacactagcgccaaagattttctgatgaatgaccgtattccctccatttccaatttgtttattgtttgtgatttgtttaaacatgcaatcaatatttaaaattaatgcatatttttacagattcatttcattttacatgcattttcagcgatatgaaattttctctgttactcgcaaaaggccaattccatttaaaccgtaagcaaattccgtttcgacttaattttgtttaaaagggtcaaaaatttagcccacaagtggttcagaggcatgtggcagaagggctattcgtggccatcaattttccagcgaaaattggttcgttgtccatggagagcagaattaaagataaacaaaacgggcggtttgcgataaagttaaaactgatcattgttggatta

SEQ ID NO: 27326 - DNA, 1812 bp, Heterodera glycines
aaaattggctcaatattgcaaaacttggtcattttttggacaaaatctgttaacaaatcgcattaaaaagtcggtcgattgttttgggtttttgcttaattcggtcggttggtttcggtttaaaaccgaaaccgaaaaaaagctaaaaactcaaaaatttctcggtcggttttttcggtcaaaaaacgaaaaaaagctgacctgtccgatctctagtttttatggcatatttgagggatttttaatgcatatttggcattttttagtgaataaacttcaaaccctaattataatacataaagcaaatcgccagctctgtgatcgaaagtcgatttggcgtaaagattgaaaaagccattttcccattagccaaactcaaatttcagtgtttatccactggggatggaaagggataagccggcagtattttttagtcattttttaaacaaatcatttctgctgtaaaagtccaaacaattacataaatgtattcaaacgaaagaagcaacaaataaataatgagatgcaattatccgatcacttctattcctatgatcgatcatttcctaataattccttcactttttcttctgctgtccgctgggcccggcactcattttctggcgactttttgccttcattttgcccgcctttggcggagacaatggcctgaattaagggcaattaaaattgattattatagcaaaaactaatgccacacaccaaattcataagggcagcggacggtcgggcaatggaaatccctcagatttgccgtgaacaaaaaatttcggtttcggcattccgatgtccttgcaaattgtgattgttctccacaatgtcagttcgtttttgacatcgaaatgtttgtccactaaaatgtcgaaacgaggcgaaaaaagtgccaatttgaggccgagttgaggacagtcaaaatgaggaaaaatatccatccaaatatccgtacaaatccaactgaaaattcgggaaaattaatatattaaaaatttgagatttcaaatttaccgtcggttcatttttacggcaattagcacaatttgccgtttccaaatgattacacaaagagcagaataattccgcgaaacgaaaattgaaaaaccaaaaatttttaaagtcataaaaacggaattaaaatttttaaataatttacgaaaaatttgaattgccaggaggagcaattactaaatgaatgaataaaaatgaatcatttttcatataaaataacctttttcctcctcctccatttcattaattcgtttataattttcctccggttattttattgccgtaatgtcttcgagaattccgtacgtttacatcgtatcacatttcttttactccaaaatttggccagggttgccaagatgaaaattttcaatgaatttcataactttatttgagaatttaccccagtgtgcccattaaaacttcaaaatgaaattaaaattccacatttggctttcctggccttggcactttctttgctttcccattccattcattattctttcgtttttcagttggtagttgtgtctcttctgctgttggttggctgtggcaccattctttggttcttttgggtaaatgtcaaaaaacgacgacgccaaaacaaaaaagaaatgtaaaaaaatccgaaaattttgaaaaaatcaaaaaattcccttttttcagctttatctccgccgattgttggcttgaagtgttcgctttacttccgccttctcagcttggcctcggaatcgctctgatcagtcgccgcgtggacgaacatttaaaaacgcgcaaatggat

SEQ ID NO: 27327 - DNA, 1945 bp, Heterodera glycines
  misc_feature (59)..(59): n is a, c, g, or t
  misc_feature (65)..(65): n is a, c, g, or t
aaacggcggtagcgccgcttgccctggcgatgtagtgtgtaagtacgtggggtagctanataatnttgcacatttgttcgattaatgtttggttgacttttccgcgcctcttcagaagcgcaacgctcgtgaatgagacaggcgaacttaggtccttgtataagaactcaagcaaacgaatttttttcaaatccgtaatgatgccttaaacttcagtgcggcgtttttataaattcctttgccggattggccttcgggaaataaatgcctactcaagagtggattttgccttgccctttcaacaaattcttgaatgcagttggctctttgttttggctacgcttgtctttgttgagcagatgactaacaatatcatctacaatgctggttataaatggccgcccacccgctctcaagacctgtccttccgcagatacacccagagattgggcatttttataaattaaatttaagatttccgtttgtgtgggttgtcgtttatttgagttcgacgaccgtggggcttgatcgtcgtcatcatcttcgagttctgcaacagtttcttttcgtgcacgcccaaccttgagatggcgacgcgtagccacaacaatcggtctttttatgttgacaggttttagcacggcgtcaaccacatcactcaaattttctaattttacacctacgggacgttcagcctcgtctcttgtaagtttgttgagacgcttaatttcctgctcatatttgactgccctttcctcttcatttatacggtcatcattttttatttgtttaattctggtacggaccaacccaattggtgttccgtcagatggtggcggtgcagccaaactttgatagatctcttcggggacgagcagataacgctttgtatgctgcatttttcttggttttaactttttttaaaaactatttatatttttcaatgacatccgcaataagtggagggcaattgcgcaatgagacctacaatggctgatagaccgtatccatgctgtagcaaaactttctttgcagatcgagagcagcgtgtgcgcgtgagatgacgaagcacctgtgcatgctttttgagcattttcaaatgccgaggatccaatggaactcggccctttaaaatgtttagacaaatttcgaccaggcataatatttggtcatcggacgcctctcgaataacaatttttgccttcttgacattacaaatgttctgcaaaaatggagtatttttcgaaattagctgtgatactctcattttggtaggtaagcaattttattttgatcatatatatatgagttctcagtcggattgtttccgggctttccgggtgcatgtcaaccaaaaggtagccaaaattttttacgcatgcgtcacgataggcttccataaagtaggcggtccttgacgggaagaggtgtgtggctattgtgcgaatctgaagggcgtccgctggatttctcattaacaccaaataatgtgagtttgtgcgagagacgcgcaactctttgttaaacaggtgtgggtcaccaaaattacgctcactccccaattgtgtgagccgcgtgtgaagagcgcgtccaaatactgctgactcatccccaccaccaaatcatccaatattaacaagaggttttgttttttggcgcaatcgcgtacctgttccgcagatggacgccactgtgtacagtgactggcacattgccagccaattttaccagtgcgttgcaaattcaaaatattagtgttcaactctccgtacccataaataacgcgctcaattgggttagagatcattttctgcaaattctgtagcatacgcattacacactccgacttccagacacaatcattgtgaatggatgacgaaattgcaagttcacgtgattaatgtttggaaattaatccattttttcttatattataaatgcgttg

SEQ ID NO: 27328 - DNA, 1950 bp, Heterodera glycines
tatttaaaattaataaaatcaattttttttttttgcatactgttgaaagcttaatagcatatgaaaatacaaactagctgtatgacacgtaattattagattttttagagtttttgcaacatatttttaaattttttttgaattaaaaataaatgaaaatattttgactatttttgaagaagaattaagaaaaaatgtggaaaaaaattaaatagtttgaaaagggaatcgaacatgagaatatgcgcacataggaacagcaacaattagagatatggtaattttttattttgagcacctaaaacctaaaaaaattttgaaaaaaattattcaaatattttgatctggggtttatttattggctcggattagttattttagtggtaacactcaacgaaatcagatttaaaatcgctaaataaaaggcattgtgttcctcacttttgagagtaaaaatataaataaatacaagttagtttcataaatttacaagtccatattttgtattatttatggatatttagatattataaaataaggacaaatggggaagctatttttaaagatttaaaaaaaaataataagacaaagcactgattgaatccaaaaatggtaaatttaaatggcaagaataattattaatttttttatcattttccttaaattaacgcctcctcctcctcttgtccaatgttcggcttcattcccttcaaattcagtgatgaaagctagccaaattctgcatttgcaacgtgaacggcgtgtggtggaattcctgcgattggttcagcaacatttggccaatgcctgcggcacccccattttggtgctggtgcgcgatgtatttggcgttgctgttgaattcctgtttaaagaaggaaaaaaagataaatttattttggcagaattacatatttaacgattggatttttttgatggaaaatgaaaaaaataaaccaaaaattcaaacagtttcagaaagagctaaaaaaattttctggaaaaaatggttttagagggtcagcaattgcccttctcattaataaataatgaaataaaaaataacatggaatttgttttaaagttaaaaaaataattattttacgcagctataatattttaatagaaaaacctcagaaaatcatagaaaagtatacgaaaaattattcgaaaatttaataaatgtttttacacaagtttaaatatacataaaaaatagcaataaacaaaaagttttaaatttgttgactaaaaaatccgattttctaaaattttatttcaagcttagcattgtttgcattattcccttactgttagcccataaccattttccgtgccacaaccaccgccactggtagcaccgcactgctgcacattggcaccattcccagtgccatccacagacaatttgttgacttttgtcatcacatcattcacaagggatgaatgcggtggcaacagttgccgaagacgaacacacaacagaaaaaggtgggccaactgagaaattaaattgaattataacaaaaaaaatttttaattgaaaattcaaattttgaaatttcataaatatatttataaaaaaaattaatattttattgcttttaatttttaattgtttaaaagggaaaaaatatgaaaataaaataaaaaatattctttttttaggaaaaaagaaaaattgaattattttgataggtatattttttaatatttattcagaaaaattgagtatgcaattaaaaaatattctttggtaaatagaaaggtattaaaaatttgttttttaaatattgttttattaattttttattttcgtataataaatttaaaaaattcttttacctaccagaacaaaaaatatcagatacaatgcgacggcaataagcaaaggcacaatgcgttcgcgatgatcgaacaattgtttatttctttaaaaagtggaaaatt

SEQ ID NO: 27329 - DNA, 860 bp, Heterodera glycines
  misc_feature (804)..(804): n is a, c, g, or t
agaaagaaccaggttcgatgaagttttggtaagccaaaaaaaatccaaacatttaaaaatctataaaaaatttaaaaatgagaattcatgcgagattttctgaagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctattaaaaaaataaaatagtgaagttttaaaaattaataaaaatttttaaattaagagttactggtgttagcatcatagcggtgcttttccttgtctttttgatgcccttgcaaaatctggtgcgcttctgatcagtttatataaaaaaagttaagcctaaactttttggcatgtttaaaaaggaattaaaaattttaaaaatatttattcatctccctttttgataatataagagtcagagtgccttattncacttgtaaataaattttggtgcgtttcagagcagtttctgtaaaaatacttatga

SEQ ID NO: 27330 - DNA, 718 bp, Heterodera glycines
aaaaatatttttggcaaaaaaagggtatttttggaaggccagttattaattccttccggctatcaaagtcactattaaatcccgggaatgggcccccacttttgtttttttttggagcgctgaataaaaccctaatagtgtgtttgaaaacgcccgaaaaatagtttttgacaaaaaatggctatctttgaaagtcacgattaaatccctaccgggaattggtcaccaacttttgtcttctgttgtagcgctgaataaagcactaatagtgtgtttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttcttgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggtcaccaacttttgtcttttgttgtagcgctgaataaagcactaatagtgtgtttgaaaacgcacgaaaaatagttattgacaaaaaatggctatctctgaaag

SEQ ID NO: 27331 - DNA, 1096 bp, Heterodera glycines
acaacttgtgctggttggtttggctggggaattgcacccacccacgtctgagaggcctaaagccccttcaatagtgtcgcccatgccctcgcggcttggtcaacccaatgcatgaaagccttcccttcaggcttaaagtctctgtaattttgctcttcatcttgaagagcttgtcccttcactctcaggaaaatggcttcccattttccgttgtatttctccaaaagagaaattgttttgcatagattttgtctctctgcgattagatctgcacggacactttggtccgccagctctttgcccaagttttcttgggctgtctcaatgtacatcttgagacgcaccaccattggtgcaatggagatgcgcaagagctcactcattgctcttacgcttgatgaaaacacaataaacccctttgggttgtgtgtttgatccaagcgctcaggccgcgctttggattggtttggttggagggtaggcttacgactggaagccgacccctaaggggctccaattttatgggcaaaaggccacaaaaatttgcacttcccggcagaaggggaagcagactctcccggcagaagggggagtcttttaagcaaagcgaatttctgtccaaaagacagaaactcacagagtccaaagggacaaatgaaagggaggaaattcctctcctttactgaagggacaatttgaaaggaggaaaatgcttctcctttccttttgaaagccttttctttgacccaacgtgggtcaatggcttaatgatctgtatgaaagggctcctgagcgtcccttttacagatagagaaaagactaagactctttcttaatctttattcaaatatttacaattacaatttaatgcaaattgctttgaacagaaaactgtcccggctggacttactcaaaaagtgatcagagtgaagaaaaatgtaataatgggcccgggcttttataccccccccaacccatggggggggggttccaggaacgtgaaaaaatgtgcacaaacaaatgaaaaaaaacccattaaaaatgatgactcaataaaaaaaaatgaaaaaaagaaaaaaagctgagtcttaaaaaa

SEQ ID NO: 27332 - DNA, 634 bp, Heterodera glycines
  misc_feature (579)..(579): n is a, c, g, or t
ttcccttggcggatccattaaactttctctcacccctccccctccctatttttccgtgttattcgctcgttttatgcgatcgcgaccatctccaaccgtccacaattgcgaacattgttcattttcttgtcaacgatttacaacgaatgcagcgcatgacggacattctcacggatttgtgagagataattagccaattagtcgtgttaattggcaccttaagccaagtcgactggatggaatacaaccaattgacatgggcagtgatgtttttcatcgtcgaggagtgccattctttgccgataagcgaagggacaattgtgatgccaacactgtcttttttgtttgccggatttaccaatccctttttgacgacatttcaggactttttcctgcacattgtctccgattccttcgtggacccgcgcactccaagttggcaaaaggaagttctcaccgttggcattgagtcaaaaaagaccatttctgattgattttcgttgaaaaaaatgaccaaatttattgctgtgattatacagaataatttatttgtatcgccgcattgatcaatgcaatttnaacgaatgttgttgtgttaattgacaataaacaaatatgaatttttttggaatca

SEQ ID NO: 27333 - DNA, 1905 bp, Heterodera glycines
cctggcaatttgtgccatggcataagaaaagggccctacagaggagaagggcaccgaaaagaacagaagggggaggcccaatggcacattggagcaaaaaggaaaattattaatggtaaaaaaacgattggacattttgaggatcatttttgcctctcattttccattttaaaaactgatttatttaatcaaacaaaaatgctagtcaaatgaatgactgactttggggcggtgtttttaaatcgccgaaaattctgcaaaaattatgcaaattgaatcaacttggtccctttacttttactttcaattgccccatgctttttgctcttccgtccgtccgtccctaattttcgtttcatttgcccaccctttctcggcacagagtgccaatgaatgaccctccctccctttgagtgaccgaatgtttcagtgcgaaataagtgacgacggaatggacaacggatgaaaaggaacaaaaagccggcaaaagcatcggcagaacggacggagaacaaaggcacggcacggagaagggcaaactgtacgcggagaatgggggagccgattctgctgatggttgtggtagtcgtactgctccaatccatcgccaaggccaacgccattcaattgctgtggaccgaatcggactcagcctcgggtgaatacgcagggaacggcacccgggggaagggacaacgaacacttgggcaaggggggacccccgggggatgggcgaggcggctaaaagtaaacagagggtcaattggatccaaaagctattaaatggatgcctttacagaggaacgcgtgccggacccaccagcgaatgtaagactgacttattttataatttaaattcacttaaaaatcgacgaaggtacgcgttgaacagctgacgtcgaactcagccacaattcggtgacaaatggggggggggaaagaatggcattggcattttgaaaaccaaccaacaaaaggtgggaccctccgcgcaacgttgacaaagtggtggtcaggggatacacactttcgtgagagcaatcggcggattgaaatagcgatttaaccacaacatcccccgaaaaggtacggggccgactcaaccgaagcacgacgcattgtgctggagggcgcagaaacgacggaatacgcgctgaacggactaagtgaaaagagggacaaatccccccgaggggggatgccatgggatatcagagaaatgatggcaaatgatcagaaatatggacccgatcaaattgaataccctggcttggtcatactgaaattggagttttcgaaatattcaagcgccgaaaatgaaatgccaaagacggaaatgggacctctgaattacccaattgaacattgtcactgagccttttacttgatgagagtactcgagattgttcttggctccaaagcatattcctccaggactttttttagtaacattttaattacgtaattacccaccggcagggcccaatacgacttacgccgtttcactgaccgcgtacaacgaagcggagggcgaagattcgggtagcctaccatttgtcagaattcgatcgacccgttgtttatttgtctgaacttgtcacatttgccaagtccgcgtacttttgctggtccgaacgccgcctttgctcgcccgcgatacgcccgaaacggaagacggaacggaagcattgcgaccgcgcgacttgcgcattgagcgaacgccgcaaaaagacgcggcactgctcagatgggaagagccgacggatggaaaaggacagcgaccgctttattacgtaattaggtgggaaaaagccatgggaaaaacgcgccgaaagagtcgccgaattcggcactttttccctcaattgtgccgcggccaaatttccctcgtcattcgttcagtta

SEQ ID NO: 27334 - DNA, 1214 bp, Heterodera glycines
  misc_feature (32)..(32): n is a, c, g, or t
  misc_feature (100)..(100): n is a, c, g, or t
  misc_feature (115)..(115): n is a, c, g, or t
  misc_feature (1156)..(1156): n is a, c, g, or t
taagtactacggactaaaaatacggaaaatcngtagtccgtaaaaatccgtatccagaaaaatacggatccgtatacgtatcagtattttttaaattttntgataaaaattggtntaataaatacaaatcttgaatattaaagctagaggaaaatttattatcaattataagcaacaaaattcaagataacaaaaaaacggaaaatccgtagtacgtaaaaatacgtatcggccgaaaaaattacgtattacggactacggatccgtaaaagtacgtatacggatccggtccgtatccgatctctaatagtaactatatttttaaaatatattattcacatttaattcatttaatcaaaatcaaaaattttttgcaaataaattaatttaatttaaaaatgctaatttattttcaattgtatttaagttcattaatttaaatgttatataattaatgattattaatttataaaaattttgaaaatatgccaacaaaatattcgtaaatttcaatttttattatatatttttttatttaaataaatattttgattaaattaaaatttacataaaagctaaaataaaattaaattctaaagacaattttaatttattttaaaataacagttaaaagtgaattattttggtctaatatgtaagcaattattatataaattgaaaatatgccaacaaaatattcgtattttaaattatttttaatttgatttttttaaatttacctcaattaaatttgttttaaaatgaattgaaattatgaaattatttgataaattaacattataatatattaattaatataaatcatatattttttaaaataaaattcgaaatttatgcttaattaaatccattttatataaattatttaatttttttcaggttttgcttcgccatcgcgtcaacaacagcatcgaccgcattgacacggccattgtgcatgtgctggtggccgcgccaagctcacagcccgcgcgttttccgcacgcatttggggtccgtcgcgtgccgatgccgtcgtcgcgctctcccgccacagcagtgccaagaagtgtgctcaccattttgctgccgacggcacacgaccgtaagtgatcactgatcatttttcgtgtgcacctcaatcggcatcgggcgngagtttgatcaggagaatccttctagatgatcggacgtcccactaatagtactgctcg

SEQ ID NO: 27335 - DNA, 1778 bp, Heterodera glycines
  misc_feature (38)..(38): n is a, c, g, or t
  misc_feature (104)..(104): n is a, c, g, or t
  misc_feature (1751)..(1751): n is a, c, g, or t
atgctttgagcgggttatctgaccatcgcttcatcttntcattccgtggcactttccgcaatcggactctctctccccatattcgccttgtctcttgggccccncaattggaagtgctttcccatccgaagaccaaagtctttttgacccattccggactgaagaggttccaattttggctcttttgcctacgcattgtttttcagtatcaaagaatcgctgtgttctggcactccgatgctaacaatgccaatgttcgcggagcaagcacataatgccaagatgttgttggagtttggcattggcattgggctaagcaaagtgagtcatcggaattagacattaatgccggaataaatcataaccattgcagtctcttagttttcgattgacgcgcaaacggtgtttgacggactgagtgaggtcagtgccgcgaatgtccgtccttcggtcgttcgattggcttctcctcctcccttttgcttcatcttttcccccctttttcagcttttacataaaccaaaatatgcccagagggcgcttaaacttcgtcatattttcttggaccgtccaatgaatgctttggatgaagcgaattttcgcctctcgcagattatcagacgaagcgacggatcgaaagggaaaggcgaaaaacggagagaattcgttgggagaaaagggacagagaaaggggcgatggaaagctttcatttggattggactttcattctgttggcagtgatcactttcttattccttgacaaatgatcagctgaattcaaagtgcgaagaacacatttaaagggacggagcaattcgaattgaaaattgggaatcagttcaatgcccacacattggcacattgacaccagtgccattcgagacggactcggaaatatctttcgggttttttcaatcttcccgctcataaaaaacatctctcgaactttttcctttttttctgatggaatattcaaaataactagagaccgacttttgagacatatgcctttttttctgcgcactagtttcgatatagtaagcataaataacgcattttccacttggtttgaggcttctccgttgacttttattatgcctttttttgcctttttcgggattttcgtgccttaactgccttttttgacattttgccgttttggtgcctttttggggtttttttctgaaaaattccattaaaaatgcaataaaatcgggaaaatacaccccaaagaaatgaattgaaacaaaattacagaaaatacatccctaagaattgaaaattttttctcaaaaattgattaccaaaatttaattaaaaattttccttattcgaaaaacattataaatatttaataatcatttaaatgactaaaattaagttatttcgttaagtttacgtgttttactccctgaaaatccttaataaaaaatttttaatgccttttttcatgcttttttcgcgatttttggtgcctttttagtcggtccctaaaaataacttaaaaaatattttacactttgttttagcttgcctttttatttgacgttaactttttatttttttacatataattttttgttttttatgttattttcataaggcaaaatttgtatttcagcgaaagaattgccgaaaaacaaacggtcgatcggtaaacaaattaagaaaacccgggaattgaaaacattgctgaaaaatattttgaaaagcaaaaaaaaatgcaaaatcttgactgaatttttggtanaacaaaatttgacacatttctccttga

SEQ ID NO: 27336 - DNA, 1193 bp, Heterodera glycines
  misc_feature (1181)..(1182): n is a, c, g, or t
aatttttggaaatcctgaaaaaaaaatccaaagatttcaggtcaatatgttttgtacatattgtttggcagccctaataattaaatcttcaaatattcttttggaaatgtttttagtcgcttagccatttggtattaaagcggatttttgttcctacgaaaaaaacaaaacaaaaaaattaaaaataagaggctgcattaaaatttcatttttgaggcaattaaaaaaaggcaaaatgtggaaaatttatgtttaatttaagattcaaaaaaatgccgataaatttccggcaaacgggatttcgatagaaaaaattattagagaataattatccacttaccgtttctgcatcaccaaaacccgaccttcgagtcgcaccttagaaacagagatttcgaatcaaaaattactaaatttaaaaagcaaaattggcaaagaaaacaagacgagaaattttgcttatgaaaataagatccaaaaagagcagaagagggttaattaaccccaagacaaaacgaaaatgaaatattttttcgtataaaatctgaaagattaacatatactgatttttaagatttatcttgaataaaatgttcgaattaaaaattcataaatttttacatattttttgacttttagcacccatatttattttcagaaaattcaagcctaaaaaagcccgtttttcagcagattattactgactgattgctttattatacaaaaaattatttttattaccatttattatttttattgatcaattcaattatagcatatccattttatgccaattttcttatgctattgcacgtttttctttataatccattccatacacaggtcaaataattcaatggcgtaataccattaattaatggcaacgtttaagaagaagcaaagaaagaaattgaaaaataggtacaacaccaaaaagaaatcgctgacccacaaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtggggatgccaaagaaatnntgggtgaaatt

SEQ ID NO: 27337 - DNA, 951 bp, Heterodera glycines
ctttcgcgtgagcattttcctttttatttcttattgcattttctccgctttcatcctctgttcgttgcttcaaaatgcaaaaaaaaacccctaaattttgggttgaaattgggagtggtcgtcctactgcttcgaaacgaaaatttttatgtttggtgcaatttttttaaacggactgctttttagagaattgcacctcccccccccccccccccacgacgccacagaattattaatacagttacaattacaattaattttgtttcaaaattaaaaaaaaaaatcttcaaattcccgccaccaaaatagaatttggggtctcaaaatgacaaaagatctgctgacgaactaatttatgtttaattttacactttattttgcctctttttgtcagtttccgtacgcatacccaccaaatgggccgtgtggtgtccgcttttgtgaagaaaaagacggacggccaatggcaccgaattggcaaacggaatccccaatggccacaactgtttcagccacgggaagagccgggtgcacacaaagatttcgcaaagattggttaaaaaacgggcaaattttcaggcaaattggtgatcgaaaagggcgattttatggcgggcacttgtcgttacgattcaagcgacaaaaaggaaattgtgccgatgggaagcatgggaatgaacgaagtgagtggagatagagaaataagacataggaaggggaggaggaaattggcacccggggggatggatttccaaatttaataaagcattttttacaagatttaaaaaaattacttaccggtattatttaatttaaatggtttatttttttttgtttttgaccctttagatgtgcgacttctacatgatgttctattgggacgccgcttcgactggaccctttcccctacggcggaggctgtttcggcgaccggaaccctgcgggcatgaa

SEQ ID NO: 27338 - DNA, 714 bp, Heterodera glycines
tgaaatgcgtcttcttgtgccttaacaaattgtccctcctgttgaatcttaaaccattccaattctttgcttttcctttcttttcccacgctcacttttttggacaaaaagggcatttgtgcggcttttccccgctgtgaatgaatcggtgcttcttcagcagaaatttgttgcgaaaccgtttgaagcagttgggccaattgcacagcagcggcttttcctcccctgcgattggtccgtccgatcagtgccattccctttgacttgcgcccccccccccgccactgctgctcaccttccttgtcatttccattgcccatttgggccagcgatccctccgaaagcgtgggactgtcggccattgtctgtcctccaaattcgacatccgtccgcttcctttcttccccctcctcctgcctttctccggacggtgttttgtttccgaaagtgtccccttcgtcttcttcttcgtcctcctcttcctcctcctccaacatcggtccgtccctttaacaatttctttcattttgcattccaagagtgtcccccatttgatcactttttgcgtctccaatcactcagtccgtccctttccctcttgccatgatcacccccccccccttcttccctttcttcgtcagcagttcgattccccccctccccacctccaaataactctcttttccccctttttgcccgtccatcccatccatc

SEQ ID NO: 27339 - DNA, 1845 bp, Heterodera glycines
gatcaaaaaagtcatttgcactcttttgatcagatcactccttcatggtgatctggcacaccaaaaaacagtgaaaatcgggaaaattttctaaaaaattcctagggggctgtgaaattttttgggaattttaagcaggcccaatggaaagagcagaaaattttctaccgatttgctttttgaatggtgggactgacttacacccgctgaggtatagacatttcaattacggtgttgatcatttctactgtaaatgcagtactttttgtggacaccaaaatcccacacctcatcgggtataatcttagccccactaaacatcggacgatcttcttcaagtttggtatcattttaaagcccattaaaaatgcttaattctcacccaaaaaataaggtgtttctataatttatttaaatataatatttcgcaataatccttttaaaaatatgttatcgtcgtagatcgttcatttcttggccgtgtacatctcggccccacgtcttgccagcaggtccgcctggtcattgccataatcgcccgaatgacccgcaactttctcgaatttgacgtcaatagttcccttcgtcagattgtccagacgttcgagcaagtccctattttgcacatccgttccattgatggttttccatccattggttcgccatttgggcagccatttagtcatctattttaaccacgtcataaacgttcaattggcatggcatttgcaccgattggatcagaagagcagagtcagttcggatcaccagacgccgaatgtttcgcgcggttgccttttccaacgcagaaattacggctaaatattcggcacgattatttgtggctgggccattgaccggagctgagacattgtcggggtgtccatcagaccaaaaaacgccgaagccagccttaaatagtacaaaggatttagtgaaaatgacaaaactaagtattcctattcacataaatcactaattgatgtcgaaaattctcatcgctttacttttgcaccgacaaatccattccgactacaagcgccgtccgtatagacaacagtcgtaaatccatcgtccacggaaaccaagttggatgctgccaatgagttcgatgcctcaaccccaaacattgccgtattacgtgtcaaacgtctctcagcaaaggtcgtagcagccgattttacaatcattgtacgaacggggggccctttcttcgaaatcactttgccgccagaattcagagtttctaaaataatatttacagacaaaactattgagtgaattggctcaaatgcattttgcgagcccaaccaattaaggaagcccattccctacacccattctttggcatggccacaaattaaacttctgttttgtgcttgatcacaaatatttcgaattcgggaccacaattctttacattgcccatcacttaccacgatgcttcccaatgaagtcattagcctgctccaaagttggaaacttcttaaactttgcccccgaaaacccattgatgctgtcattacacttttgccaggtgttgaatacgccgacagcccttccccgcgcgacagcataaaacgaggcttgacgcatgacccaattaaacagtagagttgaacaatgtacaaattaaaagtagttgaaaacaagacaaagaaaacataaacaatactttttttgataaatttatcaaaacaaatgaatcgcatcaggcaataaaatgagtgttcatatttggagagggaaattgatttaattcaccatacaatcaaaattcattgcttttcgttttgctttgaaaatgacaaatccctaaatctaaaaaaaaatctcggagaaaca

SEQ ID NO: 27340 - DNA, 1011 bp, Heterodera glycines
ttagtcaataaaccattgcaacatcaaaaaatagtcattctatacagatacgaaaataagtgaaacctataaatttttccacaaaaattttgaatttttttttcgaaaaggggaggttaccaccggcggcggtagtattacataccaagttgaatctcgtgttttcgctgtaagccaagctttccaatcttggaaaaattgaagaataccgccaattttgattttgtaaacagaatcgttcaaagctaaaaattcaaaaaatattgttcctttcgattcctctagggtaaaattgcaagctaagcagtgttaagtgttaaatttaaaaactaattcttaaagtcgcaaagcatcacgctaatggcgagcatgcgatgacgaagcaagtagtggggtgcccgagcgagcggcgccccaattactggccgccgtagtcgagtgtgcggtgtcttggccaaaatgctaagtaacgtcaacggttttctgatgattcggagtaactgggaaacgccaatttttaatgttcagagtgactggtaaacgacaattttaattgaacgatttttcaaaaaaatttacccaatcaaaagtgccatattgagaaaagcataattgtcattaaatgattcggtggaaaaaatttcgtggggcattttcttggtcttcaacgtctgtccgcccgatcagttgccaccagcttcgcccgcctcaccaccagcctcctgctcatcgccagccgtgtcggatgtccaaagcgtcaagttgtcacgcaacagttgcatgatcagagtggagtccttgtacgagtcctcgttgagcgtgtccagctcagcaatcgcatcatcgaacgcctgacaaaaaatgaaaaacgtaacgaaatattcttttttttggggggaattattaatattcccaataatttgaacaaatacgttgtacctaacatgaaccaatgaccccaaaatcacccgatccaacaaataaaggttttaattaaacccattgattttt

SEQ ID NO: 27341 - DNA, 1433 bp, Heterodera glycines
  misc_feature (1400)..(1400): n is a, c, g, or t
cagcaggtgaatgaagaaataaataattgaatgggtaaccctaaggaaagcaaaggaatccaattccttttttgtccctcaaaagcacattttcattatgttgcctaatttaagccagcctaaccaaatgccaatgccaacgcattgtccctcttcaccgtcctcacattttgccgaattggaatcggacagagacagcgaattgccaatcagcagcagaaatgatcggaacaataacgacacccaaactgaacagcattatcagcgcgtgttaaggatggccaatttgcgggcagcactgatcgacgaaccgatggatttgggcggcgacgaatgcccacgttcggacgaagagttccccacgggtggcgatggagcgcccgcttccgccgctccgtttcccgcttttggctccgtttcggccgcttcttctgctatcccctattttcaccctttttcatccgctcttccgcttcattcgtccgatttgatcacaaggcttctttcactccccgcgttcaattctttgttcgccgttccgtgccaaacgacgacgacccaaaaaacggtgccaacaaacggaataatgaataatgtcaccgaattttgctgctctcatccgtccccaattgccaataaattgccgaaaatggcacatctctcagcgccgtacccattgcattgcgcgatgagcacgccaaatttacatgcaccgaccacgcgaatgtgtgaaaatcagcagaaaatgggaggagaaaattttgacgggacgacagaaaaggtcaaatgggagacggaaataagaaacttttattaatttatcaattttttaaatttgcaatttcctattatttagccaacatttcccttcccaaattcgcattccttccaaactcttccgaagagttcatccgcctcttccaattcgccttcctccttttccaacatttgtcctccgtctttggcctcattttgtgtgccgaattatgaagcggacaaaaaggtggccgaagctttgcttacttcgccacaggcattcgcactttcgggccttcttagtccggaaatgctcggttcgtattttgggcattttatgtttggcacaaatttttacagaaaatgcccaactttgggaccaatggctgtgccaattggccacttcgctgagtgcgcagcaatggcaaatgttttggcgtcattacgccatgcttttcgggctcaaggccttgccaccgcatttgctttcattcttcaataattcttcgctgagtcacttcacagacaaagtgccggcggagaaagtctctttgaacgaaccgccggtaagccaaacaattcaatctgatcactggctaatttaattttttatttttttagacaaatttgatgctaccgcgcantatgatgccatggccaatgcttcatctgctgtc

SEQ ID NO: 27342 - DNA, 1007 bp, Heterodera glycines
tcgatagtattaccgaatgcattaatcgcatgacaattaagggtcattaacgaaaaaggggcgctaattaagggtcattagcggaaaaggggcgctaattaagggtcatcagcggaaggcacattaatttgtgcacctttttgctcctccgcttcttccatcgtttggggtgcactcggcgcctaaaccattaataatgcaaatgaaatgcatgttcaaataaccattttcatttacaaaacccgcctctgattcgtcaatgtctttctgttcatgcatttcggctgctactgcttcagccatagcgaaaataaacaaattcaattggaaaataaaaggagagagaatttgacagggaattcaattaacgatttgctaattgaaacggatgtttttaattttataatttggtaatactgacttttactggtcccataaaaaaagaataaaaaggctgtttttctacggttcttctttccacccgggggttatcggggccgctgatcacgaatatgacatccatttcgaccaattctaaacccggacccgaattcgaacagaaaatcgaaagttcaaattttcgaaatttggatttgtgtttggaaaatggtttaaatgcacggaaacaaacctaaagccatcattcctgtaataaaaagtcatgtaagcatctttttatttcctttttttatgggaccagcaaaagtcagtactaccttataattttgtgtttactgaatggcggggcttaaaatgaacgtttaaatgaaaataaacataagggaccagcagagaaagctcagcaaaagttgtttaccacattttcctctcttttcaaaacactcatcgaccgattctcacaaatataaaactgagaaagcaaagggaaaaacaacgaagaacgcggagaagggatttcaaaaataaacaatgtattctttgcgaaaaatttaatgaattaaacacaaagagaattacacagtaatcaatttacgacggaacgacag

SEQ ID NO: 27343 - DNA, 1431 bp, Heterodera glycines
aaaaaaagcctttcaaaaataatccccctggggaaagggagggggaaacatgtttcaaaatttttcatttttttttagttttattttcctcaaaacgggttcagaattcaataaaaataccattcccgggtgaaaaaaatgggttttgacaagttttttgggggaaaaaagcctttacaaaatattccccttggggaagggaagtggaaaacatgattcaaaatttttcaattttttctagtctaatctactcaaaccggttcagaattcaataaaaaataacattcacggtgcgaaaaatggggtttgaaaagtttatttggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttatagtctcatctactcaaaacggttcagaattcaataaaaataacattcacggtgcggaaaaatggcgttttgacaagtttattggggaaaaaaagattttaaaaaaaaaacccctgggagaagggaggggaaaaatgatttcaaaattttcatttttttctagtctaatctactcaaaagggttaaaaattcaaaaaaaaaaacattcccggggggaaaaaggggtttgaaaagtttttgggaaaaaaaaatttaaaaaaaaaaccccccgggaaaagggggggggaaaaaaatatttaaaatttttttttttttttttattctttatcccaaaacacggggaaaaataataaaaaaaaaaaaaatttcccgggggggaaaaaaggggggg

SEQ ID NO: 27344 - DNA, 1094 bp, Heterodera glycines
  misc_feature (16)..(16): n is a, c, g, or t
  misc_feature (141)..(141): n is a, c, g, or t
tgacgttcagggtacncctgagatacgccgaatttattatagttcagcggtttcgcacaaaggcaattgggcggtccaattaattatcggtatgtttggcgttcatttggtctcaatttgttgtttaatttgataatgctntaatatcaatttcatcattaaaattaattgctacaaattcattttagcatttgtttgggttgctaatctgttgtttgtgcttcatctcttctgctgatttgcggatgggtgaagatgaattaatgcgtttataaagaaagatttaattaatcccttaattaattaattgctaattcatataatacaattttgtcttccctcagattaaagtattcttttttattattattattaaaggtgatgaactcatacaaataacggatttattttgttaaaactgctgtatatttataaacaaaatgtaagccattaatcagttggtttgaaactgactagagcattgagaaagacaccgaatgagagagaaaatattttttgacagggtttgtactaaattctgaaccaaaaattttgtgatttatttttctctccctggcttttcttaactttttgcactatttcttatcatattgcacttggaaatgcagaaaaaaaaattggctttttgtggccatttaattctgcgtcgtaagtgtcgcttagattgtgaacgcaaatgtcatcaccatgcgacccaaccaatagtaattgccagggctgcaaaaaatatgcatgaaaagtggccaaaatatgcgcataaatatgcaaataaagtcgtaaaatatgcaccaaatatggacaaaaaaaacttgaaaattaggggtgcaaatccaataaaaaatttttattcctcataaattttgtcagttgtttttgcaattgcaaatcaaaaatttgtcaagattttcggcaatgaagctcacttttgacccactcgcgcatccatttaaatttggatttaattttatgcataattaaaaaattcttcctaaaagatatttaaatcgaaatatttgatgaaaaatggcaaaatatgcaaaaaatctgaaatatgtacaaaaaatggcaaaatt

SEQ ID NO: 27345 - DNA, 896 bp, Heterodera glycines
tgttgtgcgtctaaatagcttttagctcctcctttgttttcttgggaccagatcagacagaagatgaatgatagatgatttaaagataaagtttaaaagcttgccactagcaaaaatttggcaaaaaccgaatccacacttagctttgctcagtcaaaatactgagaaactcttcgggctacgacagatggggaataacttgtttgttatgggttatgtgagggggccgtcagagtcgcttttttggtgaattcacggttaagcgcaaaaatgcacgggcgtcgccagttgttgtgttttgctaacacacaaacaagataaatttattaaatgaataaacaataaaattagaatcacaaaataataataaaataacgacggagtcaaattagaaagtccgaaaaataaacaccgaaatgtaaaataacacaaatgcgaagaatgagtcgatgggagaggacccatccacaaataactaatcaataaaagtattcgtgtcgaaacttaataatattaaatatcaacacatccaacaagtgtgacttggatgtccaggagtggactgattcgttcttgtctccttgttcggccctttttggtccattttccgggcggttttttgggcgagatgaaattggcctggtgacgggcctggcgcacaactttgtcgatttcgggtactggaatgcctgaaaataaagcagttattataaaaataagaaattaggaagtaatcgaccgggtcggaagagatggctgaggttccgcgctatttccttagcacgttttgtgcggcttcgtcttgacaaatcgtccaatgaactgaccctcttgagtttgcccttgttttccactgctggtcgctttttgagcaggttcacctcttcagttttctt

SEQ ID NO: 27346 - DNA, 1618 bp, Heterodera glycines
actcacagccgtttatctccaataacagtgaacgtgccgccgtgcactgcggcatctttcttggcacaggcaaagccgcgcaatgaaaaggtggcatccgccgattgggagaagcaacgggcgaagagcaggacgaagacgaacactgacaaaacagaagaagcagacgaaggccacggatgaagaggaaatgaataagccatacgaagaagttggcaattcaagaaaataaaagtggcgaatggtgagaatgtgtgggtcaatacgcgcttttataccaactccgtacgacaatgacaaagaaacaaagacaatggcgctgcccgtcaaaatgtcgttgcgtcgaaatgtcgccgcgttgaaatgtcgccgcgtcataatgtcgccgcgtcataatgtcgccgtgtcataatgtcgccgcgtcgaaatgtcgccgcgtcataatgtcgcccaagctaaaaagagtcaaaatgtcgccaggccgaaaaatagtgaaaaagtcgaaaaattacatttttaaggcttcacaacacatattcagtaacgatttatcagaatagcacaaacaaataacaaaaataataaaattagcaggaaaaaggaatatttcaaaaagtgaataaaagggtaaaaattgggattgaacaattaagcgacatccatgcttgaatcttccatgttttcgtagtccttcaattttcctgcgtatccttcgacctgcagaccaagagccgtcatagcatcatgaatttcggcatcattgtcgtatttggcgtccgctaaaattctcatgatgactgcgtcctgcagcacgtagcgtttgtgtcgtttgtgtatgaagttcccggctgacctcgctgcgtcgacctgtcggtcgatgcttccgctgacttcagaaatgaaatcggaaagggctgggtgatgacaaagacctttctaaaattgttttatttgtgggttttataagtaataaatacagagaaatgaaggtgagttgcttctagtccattgttggtccttgcgagggcggaagccgcatgtgagtgcacgttccaaaatggaattggaaatagttcgcgacggacgacgggttcttcccaagggcgggcttaaaaatttttaaaagaataattttgtaagttttgctgtgcctggctgcaatatcgtcgttgacgatggactcaatgagtactgcaccaacggcgaggtctgttccactgttgacggccatgatagtgttgagggggcgggcgagttgatgccaaattgcacaggctgccctccgccagaagccgtgtcggtttgattcggggttcggctttcacgcgctcgagtattttttgccgtcgaatttccgcctaaattcttctttgtctaatgaattcgcacagtgcacctccatcggtcgtttttttcgtgagtgtaccgaaagcctttgacaacttttcataattctctaacaaatttcccaccttcagaccaaagacaaatgcctcccttttgagtttttccgagttcgaagttgatgaggtcgcgttcttcttcgaaatcgtcgtcgtacccatcattttcggcgttttgttcacgttgctcagaattcccttcgttttcgctgtca

SEQ ID NO: 27347 - DNA, 1108 bp, Heterodera glycines
ttttgggttgattttcgcaaaaaatgagtaaatcttagctttataatgtttttttcatctaaaatgattttaataccacatttagccatttttgaagatttactttatgtttaacaaatttgaagaaattttgagaaattacaccctcaattggaaaattttatgtgcatattttcactttttatgtgcatatttcacgatttttggtgcatattttatgcgcatattttacgattttatgtgcatataattccgaaccctagtgataataacagtgctaaaaatatgcaattttaattgaaatccctcaaaactcagaggatcacctttttcatgctaatttttatattcaaatcacctgttcataagtttgaccaatttttgcacttttatccgctagaaacagagctaatctatctatatatgcttatgctcaagactcgaattctcatgatgattttaaattaacctcttttcaaatgcataataattcccatgaaatcgacagttttttaattagctcattaattaattaacttcagcttcgaatgatatcattagcattggtagaggcaaattatgttcttcaactcactgtttttttgcctctaattgattggttaattacaataatgatgccctcgggcaatatttaccaatttatttactctttttgatgttcccaatcaattccaagtcaattagtgtgtgcagtaatttcacttttgctggtgccctccgcccattaacattattattttatgtacgtatttttttttttcattttgatttattttctttttttatttacaataaaatacagtgtgttctgctggtgttctctccctcccccccaccaattcagcaaaatttgattcaaattaattcaatttttggcgttgtgtagcgtagcgtaaattgcgcgcccttttggaataaaattttaaattctttttatcatttgagtgattaaatgttttttattagcctgaaaattttaaaaagtgcttaggtaactagatggtagagctctgtccatggactgggtgaaagcttagtttggtgcttggtcgtttcgtaaaatccgccattttagcgattttttcga

SEQ ID NO: 27348 - DNA, 1841 bp, Heterodera glycines
  misc_feature (21)..(21): n is a, c, g, or t
  misc_feature (39)..(39): n is a, c, g, or t
  misc_feature (88)..(88): n is a, c, g, or t
  misc_feature (118)..(118): n is a, c, g, or t
tcttttaaagtagatttttcngctgaaaatgagtaaatntaagctttatctttgttttttcttctaaaatggtttttaataccatatntagccatttttgaaacttttactttatatntaaggaattaaagaaattttggtaaataaactctaaatttggaaaaatttatgtccatatttttgcattttatgttcatattttgcgatttttggtcaatattttatggccatattctgcgattttatatccatataattataagccctagtaataaatgtttctttgatgcggataaaaattttaaataaaagtttcgcgatcaaaattttatatttttaaggtagtccatttaacctcgtatccgaacgtgccgtggaacgcttcgacctcgaaggactagtgaaccgaaacaatatttaccggttaagcggcgtcggggggacgcccgtgactacatgcgggaggtcattttattattaattttgtgaaatatatttatagttattttttttatcttaaaaatgccttttaattaatttaaaaaaagaactccgctttaaggtgtttaccctccgcagtcccacccctgaccctatttcgtcattaaaatccgactttaatgataaatagggagtccaattatatggaaatccatatttttttcctggactgttgagggcctgaaacgcacgaaaaacatgtttttagcttggtttgaagcttctaggaaggatttctatatccatattttccatatttttccatatttcgcgatttaggtccatatttccatatttgtccatattttggcattttgtccatattttatgtccatattttggcatctttctaaaaaacctctattagaacggcccccagcagctaaattagcctttttgagcccaaaacccgaaacagttttcaaaaaatcattttttcgccaaaatttctcgagaatattgaataaatttaaattttcttaaaaattaataaatttatgtcaaaaataagcaaaaaagcgaaaatttcgcttttgttgttgattttgcgctaaaaaaattaataaattttagcttttatgtttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgaaatttcaaccaataaatttgaagaaattttgcactcaattttgaaaaatgtatgtccatattttgacatttttgccatttatttccatattttgagatttttgccattttatgtccatattttgcgatttttggtccatattttatggccatatttcgcgattttatatccatatttttggactccctattgataacattgtatggaaggaaattttataattttattaaacatgaaaatacgaaaaacaactaataataaaatatttggaaaattgaaattgaaaaggagcttttaaggtaagttaatcgccacattaatgaggggggtgtggtgtgtgatagggcgggaccctattgtccctctaactatcacagaaggggacgggacgaaatctcgccgccggaatctcgccgagacaaaatctcgccgccgaaatctcgccgccggaatctcgccgagacaaaatctcgccgccaaaatctcgccggctgaaatctcgccggccgaaatctcgccgcagaaatctcaaaaaaaaaaaattcaaacatagaaatttctcaaggaaaaaaaaaagaaaattcagttataagaaaattccaaaaaaagcta

SEQ ID NO: 27349 - DNA, 1502 bp, Heterodera glycines
tctaataaccagggctgcaaaaaatatgcacgaaaaatgaccaaaatatgcacataaatatgcaaataaaattgccaaatatgcacaaaaatcgcaaaatatgcacaaaaaaaaaacttgaaaattagggatgcaaaataatattaaaaattttattctcataaatttattcggtttttttttgcaaattcaaatcaaaaatttctcaatattttcggcagtgaagctcactgttgacccactcgcgcatccattcagatttggatttaattttaagtataatcaaaattttttcctaagagatattcaaatcggaaaatatttgccgaaaaatggcaaaatttgcaaaaaaaaaaatctgaaaatatgcacaaaaatggcaaaatatgcaaaaaaaaatctgaaaatatgtacaaaaaatggcaaaataaaaaaatatatgcattgcatgttttttgcagccctgctaataacttaaattttagaaatttttaaaatccatctgtctttagaaatgttgccatgatttttgtacttgccattgttgtgatgaaacttgtcgttggtggcatgaagactgttgctaattaggcaactaattatgctgtttcaagagcattttatcaatagtgattgaaccactatgtatatgcataatgaggcgaaaaaagaaatttaaacatttttcctgtgacattattaattatgaactaattacaggcataaatttgttgcaaaatttttgttttttttcattggcataaattttttgggtaaaattttttttgcaataaaaatgaacaaataaccacgaaatgtggaataaaagtcgggtcttgcctgggaaaaagcgcttcgggagcttcgctacctagaaaatctattgggttgttaagcaatttaattgaacaaaaaattagggcaattaggagtgaataattaattaacagacggcgctttgcttcggccgcttcgccccgttttaaattttgtaggactcattaggaagaggtacaaccgtggtttaaaattaaatagttaagaaaatagttttattaaaattatgattaaaaattgaatgcattaataatttttaaaattttaaaataaattactctttttattaattaaaaagaaactttgaagtttataataattgaatatttatttaaattaaaacgaaattcttttttttttttttttgataaattcaaattaaaaaaatacatgaattaattaaatatttttaactttttttttttgtacattttaccatcggcccaaaaattggtgctgagttgtttcttaaattctgccactatgggcctttttcaaacccacaaaggcaggacatttgataaattcgccaagggataataaaacaaaaaaatgtaatttatataaacatttttgctggttttttgatttgaacattttttaattttcagcttttaaagtttttgtaaaataaataatgatactttttttcatatttttagatt

SEQ ID NO: 27350 - DNA, 1152 bp, Heterodera glycines
  misc_feature (1001)..(1001): n is a, c, g, or t
  misc_feature (1052)..(1053): n is a, c, g, or t
  misc_feature (1108)..(1109): n is a, c, g, or t
tttaaaacgcttccaaacggcctatttgggcaaattctgagaatagttaaacgaatgattcgggacaaaatattagataacattattatatttaattaaataattattgtccttattttttcttactgtttgttgacattaatgtcgttattttggaaaatgtctcacagtttggtgaatgaattgttatgggttcaattccgtctttctgctgtattattttccctcacttttctccgccactattttaatgttaataaataaaaattaagaataatttactttatttaaaataaattttaagaaatatattcgattaaaggtaagattgatttagtcagtgataatatgatattttatacaaaattaattttaattattttataaattaaatgataaaatcaccggaaactgattcaaaattgactccaaataataaaatatttgaaaatagcacgccacaaaaaaaagaactatgaagagcaaaaaaattctggatatattttttaaataaattttcaaagtaaaaaatatttattaaaattatatttttttttgcctaagttctaagaatttaggtcttttttgaggaaaatgctgcttcttagcctggccaggcacctggtaaaaataagtccgagatcaattttaaataatatttgaaaattatgtgaaaattgagaaattattgttgctccttacgattctttcaccatttagcagttttctgccctatttaggagtattttctttgttttaatcctggttttcataaacattttcttcttaaaaaattttaacaattttcagaaaaaaattctaatgtctcaatttaactttgctgaaatgaagaaaaaatatatataaaataatttatgtttaaactttttgttgtgccggccgagggcaaacaataattaccaaatttattgaagacaaaataaataaataacaaagaaagcaaagggggaatatcgattggggatgaagcaacaaattanatgaagtgaaatacaagtgaaagaatgggtcaaagggcggactatttatgnngaggaaagtggagagagacaacgggggcgaggacacatacaaataaataattggnngcggctacatgattcccatcccctacatctccccccttaaaaa

SEQ ID NO: 27351 - DNA, 1060 bp, Heterodera glycines
gtgcatatttgagcattttttccacaaacctctattaaaacggccgcctctattaaagcgccctttcggtttctaatgaccgaaaaattttcaaaaatattttttgagtattttctaataaaaaatttaaaaatttctgccaaaaataagtcagaaaatagaaaattctccctttttacccaattttcttcaaataaattaattttacttttattttgtatttttggttttaaaatgattattcatacgatatttagctatttcagagatttttatgcttaaatttaacaaatttgaagagatttgtaaaattttgccctcaatttggaaaaatttatctacatatttttcactttttatgtgtatattttgccatttttggtgcatatttcatgcgcatattttaagattttatatgcatataattcccaaccctagttattgatttcgaaaatggttcatgtgcaaaaattataatttaagtaaataataatttaaaaaattatatgataattttgtcaaaagatttatcactttcactttttcaatacaagacgtcccctgctagactgtgttcaaaaaatacaaaaaatttcatagaaaagattctcgaatcgcgtgggaaaatcctgctggagacttggggggattaatagagagattgggcgataattagagaaaaatggtaccacttatttcctcccatattaagcaaatttttcagaggtaattagcgccaaaaaaaaaattttacggtgtttatttttttataacaatttttttcagaacagtggctaacacatctaggagtgttagcaattggcttgcgaaagaaaaggaggcaattgaatccgctaaccagcagcaggatgaaagtagcgaaactgaaactgatgaacaaagtcatgaacacgcaaacaccacgtcaaatagggcagcgcagcgtgcacgcagcatgcaacgccaaacgcaaaatgctgcagcacgacaaccaagtcgcgcacagcggcaatccgctgatgaacggcatggaagcagttcacgtgaatctaatataaat

SEQ ID NO: 27352 - DNA, 1432 bp, Heterodera glycines
atacatacccagggtatcgaaatcataagcataaaaatttcatgggacgcataaaaccgaccaaaccaaaaagaaatcaatgtaataagtcagtgataaatgaatggtctgataacccccaaagttttaatgataaatttattttttattaaactttgtctaggttgaaattatcagacggaatgacgacgctggaaacaatgaatggtggttggttaggaagagaagccaacacagacactgtactgatcagcagcaaggatacgtcccagcaaattatttgtcatgcctgaaaactccattaaacacacgcgtttgatcgtacttatccatttcaacaggatttgatttatgtactttgttcgcactattttctgcactttatagcattcataaattctcattttcttatcttgtaaatttgatacaacatattgtaagggttatcctttcgaagagttacataataaacattaaggattcgtttgtttggcataatccgaaaataaaagtcattaatttactcttatgtggctctttggcttaacagaacattcagcacaatgacagattccgtgttaggtcaaaaagaatgtttgttaaacagtgtcaattcggagggtcgggtgagcggtcgcatcggatgcctttctcttcttggccaggctgacgttgccgttcttcttcagcccattcagcaattgttccttcacatgattatactcaacgacacaagttcggcacaacgctctgtacaattcttgacctccgatcatttctaactaaaatggtcgggtcacccccaacgcatccatagacccaactcatccataacactgcgagtcatcgtcgtggcatttttttgattgtgcggtctgcttcgtggcaattttatgcatggatgagttgggtatggataagttgggtttaccccaaaatggtcttacatgaaaatgcaaaattatggttgttcagcatggattaataatgcatcattaacatgttacagtatgacatgctaaaatgtctgcgtacggtaagtcagaaagctacggtaccaatttaaaaaggaggaaattaattaaataattccctcaacactttattcagttgaatcagttagtggtgtcaaaatgctttcccaccttcgtgcattccgacattcgaaatgtgaatgaggcggactgtccacagcggcaaactgcgcttagtttctcaattttctcagccaaaggaatgagcatcgccacattttggaagggctggtaaaatcaaaaggtaagaaatgatgcttttatacacagcggcccaattttgggctctcagtgcaaataggtttattatttatttagtaatcagaacgccaaaactttgcaaaacttaaaattttccggggattttcccttgcaaaagcacaagagccgatctcgag

SEQ ID NO: 27353 - DNA, 1443 bp, Heterodera glycines
aaacaaaataaactagtttgtgccattagttctaaaaaatcccgccgatttaccgaactttttattggacaaaattattaggaaaatatcaattcatcaaattaaagcatttttatttttaattttagtttttttttaaagattattttcttttttattctttgtaaaaatatacaagtaaaaatgcaattatacataattatgaatataatattaaaatatctcaattgcgctattaattctaaatttctgtcttaaatgaagtattaattattcactaatttttacgaattaactatgctaaatcttctatgtatttttatttttaatacaaaaattcttttttttttgttttttaaacattttgtgtaaagtcgtcattttcatttattttttcagtacgcgtggcttagaccttcggaggagaagcaaaagatacataataaacgatcagaaattataaaattattgatatttgaaagtatctccttgctgtaataatttgatatttggatatttttataattttttcaattaattttttaaattgtatttaattattaattgtttatttaacagatagtaattttttattcactaatcatccgcataagtcgaatataattattcttatgatcgaaaaaatcagtattttgtttttccaaagagaaaattttaaaatttaagaataataattttcttccatttttccttcttaatttgaaatttaatatttattataatttaataaatttcttcaaaggttttatggcaacgataacttgatttattttggtaggacctcatgccaaagtattttgaggcaaaatttcaagctattctgataacctctgaaccataaaaattgaagaatttataatttttttgtatttgttgtgccttgcacttgaccaaagaataaatatttatttattccaattttggtgaagacacaattaaataaagatgagaaatgggggcaggagtatcgattgagggagatgggcacatacaacaaataaatgagggaatgaacggatggtcaaagggacgggggtatttatggaggaggcaacagagagagagagagtgggaggggaagagatagaaaggaattaaataataattaagcgggacaaatcagtacccttcccaacatctccccccttaaaaaaaaagtctgtcctcatccatcggtccgttgatcagtgatcagtccgctcaactcggagaatagcgttgaggaggacgtcgattgcgttgcgggcgatcgacacggacatggcctcgttcagcatttgcttcgtccgtctcttgtgcaggtgccgcttgttgatcagctggcagagctgcttcgttgggaccatccggtggtgccaacggaagaccaaaagcgtcgttgaaaaatgtcaacgcttcgttgccatggtcatcatcatccgt

SEQ ID NO: 27354 - DNA, 839 bp, Heterodera glycines
agtttgagataaatatttggtggtaatttttctgtgctccccccctgtgcggcccaatccgaccgtagtcccgtctcgatcgcccccggcccctttgtgctctccctgcaacttgtcaaagtcctgcacccaagtgcaggcaattgtcggactccaccgcgcccacacccgcacacaaacaaggagttacgacaagtggcgacctgggcagggacaaccaagcaacgacaagcagcaacaagtgcgcgacaagccgcggcggtgcactcaacggaaaaggtgtggtgaatttggaaaaaatcactcggtgttccaagttttcgctctccgtggcaaaacttggacacaacaaggaggggggaagcaaaagtgggagttcggggaaatactgatcggtctccgtgccatcagtatttcctaggtcaaattactgcttggtctccgtgccagcagtaattggtcaaattactggtcggtctccgtgccgccagtaatcggtaatattactgatcggtctccgtgccatcagtaataggggcaattactggttggtctccgtgccgccagtaatcaagcaaagtactgctcgctctccgtggcaacagtaccggtccttgccaagcaaaggaaggaccgttggcgtgaactgctcgctctccgtggcagcagttactccaacccgacgcggacaagtcaaacggtcggaacaacacaagtgtactgcttgatctccgtgtcagcagtacaaccagagcagccaatcaatcagcaagcaacaagcaacaagcgaaggcaaagcacaacaagcaacaaggcaaagcacagcaagcatcaagcaa

SEQ ID NO: 27355 - DNA, 1506 bp, Heterodera glycines
ctgtcagaaccacttgcgaaaaatgtgacacgtgagttttgacggactaagaatgaatcagcgattatttggtgacggattcagcggagccgcaatgtccgcagggcgacgcgtacaaagactaccagggaaattacttcacatgttcggtgagttgggcaaagggtcgaactgtaacagaacgctgaagttgcagaacacgggcaatggcaacacgtgccctgtcaattacgaatgttatttcgacggttacgtgtggggatgctgcccgacaaaaggtccgctcgttggaaatgcttttccaattaaatttctctttctctgtcttttcattttttctctctctggttttttttaatttttcctccgcttttctttccctttcggcttttcctttggcttttccttcgcttttccttccctttcggcttttccttttcttttcctttggcttttccttcgcttttccttccctttcggcttttccttcgcttttccttccctttcggcttttccttttcttttcctttggcttttccttcgcttttccttccctttcggcttttccttcgcttttccttccctttcggcttttccttttcttttcctttggcttttccttcgcttttggcttttccttcgcttttccttccctttcggcttttccttccgcttttccttcgcttttccttcccttttggcttttccttccgcttttccttcccttttggcttttccttttcttttactttggcttttcttcgcttttcttttccttttcttttcctttggcttttccttcgcttttccttcccttttggcttttccttttcttttgctttggcttttcttcgcttttcttttccttttcttttcctttggcttttccttcgcttttccttcccttttggcttttccttttcttttactttggcttttcttcgcttttcttttccttttcttttcctttggcttttccttcgcttttccttcccctttggcttttccttttcttttactttgacttttcttcgcttttcttttccttttcttttccttttcttttactttggcttttcttcgcttttcttttccttttcttttcctttggcttttccttcgcttttccttcccttttggcttttccttttcttttactttggcttttcttcgcttttcttttccttttcttttcctttggcttttccttcgcttttccttccctttcggcttttccttccgcttttccttcgcttttccttcccctttggcttttccttttcttttgctttgacttttcttcgcttttcttttccttttcttttccttttcttttactttggcttttcttcgcttttcttttccttttcttttcctttggcttttccttcgcttttccttcccttttggcttttccttttcttttactttggcttttcttcgcttttcttttccttttcttttcctttggcttttccttcgcttttccttccctttcggcttttc

SEQ ID NO: 27356 - DNA, 1159 bp, Heterodera glycines
tcattgtcagcattcactgatcggtgttcggcttttgctggcgattgattcttttttttttatttatttccttttcatttgacttttacggggcctttgtttttttaatttcgtttttctctttcctcatttgtttttctgtaaatttctttttcccttctccgatttttatgattcgctgtcgaccaaaaaatttattattcacttttcacttctttttttttgttgttttatttgtgatggaaaaaaagacaaattgaaaagttatttattgaaagcataaatatttaagaaagtgttaattaacttaggtttataaggcgaattaattgatcaattcaatcgatagccttcgatcgcttttttctctgtcacccgttttctctcattttctttgctcgcctcatcacacaatccctcactgctgttcgtctcgccatgggcttaattccaattgggggatggaagcgcatggcacggcattttgcccgtcttcgacgagaaaggcgctgggattaatggcgcgaaaatcttcgccggtggcacaaataaccgatgaaaaagtgatttgacgaagcgaggcgatttgatcaggcgaatacatcaatggattcaaatagaaaaaactgaacggaaaagagccaattaaaaggggtaattagagagggggggggcaataggcaattaagggggagggcgggcaaaggtgacaaatggccgaccgatcagcgtcacgagtccgtctgaactgttctccgataatgcaggagaatgtagggccgagcagtgagccgtccaccggctcctccatcaaaccgccaacgtacaaatcgatgtcctaatttggcaattagtagtaattggcttttcgtcgctttctcttttcccttttagtgttccctccccaattctcacgtcaactttgccgttgtacaaaatcgacacgcgtttctttgcttcgactccctttgcctctgcaattcgtttcttttgtttttgttgtcatttcccccccccccccccccgtcgacctggccaatcctgaaaagactttagccgtgccatcccacaaatttggcggtagtctttgcaaggtcgaatgccctggtctcttccccgctgaatgttccaagaccccatatcggaaacatcgaacagt

SEQ ID NO: 27357 - DNA, 1068 bp, Heterodera glycines
tgacaaattattaaaatttctcaattcgctaatacctacaaacggctttgtaggtaaataatcatttaaaatgaaaaaaatgctaaattttattgataggagaaaatcaagtaaaacctaaaacgtcaatttttttttacttatttttggcataaatttaccaatatgcagggaggctttaataaaggggtgagactttaatagaggactttttcgaaaaaatgcaaaaaaaaattttttaggaaataaatctaggtacataaagttttcagactgtttccagtctatgaaaaaatatgcgcaattacataccaataccctagtaatcactaattactaataataatttttgcgcctgttgcgcttttttctgcctaaaaatgcaatttctttaatgaacagtatgtcatacctaacttatttttttaagttaaataattaaaatattttatcttttttatagcaattttacttccatttggttagcaaaactaattataagacgcaaacaaaaaatgccagtgaaaatcgaaacactcaaagcgggagatggtaagaatccacaaataataggaaaacaatccgatggtccgtttccaaatcacagaagcgacttacccagcggttggtcgaaaggtcgtttgtcattacgtactgactttggaaaatggccagaaaattgacagctctcgcgaccgcggaaaaccattcgaattcactgtaatttctatgattattattctaacgaatcttattttaagattgggaagggcgaagtgatcaaaggatgggacgaaggcgtggccaaagttgtcattttcacatttcaattaaaattttcttttccgcagatgtcagtcggtcagcgggcgaagctgaccatcagcccggacatgggctacggagccaaaggaatccccggaacggtaagggggccgatcccatctcatttacaaaaaagcaacaattacagatcccagggaattcgacgctcatccttcgacgggggaattgatagccgaaaaataatgggaagaaatgacaggggatgagggggaaggaccgact

SEQ ID NO: 27358 - DNA, 1335 bp, Heterodera glycines
  misc_feature (104)..(104): n is a, c, g, or t
  misc_feature (131)..(131): n is a, c, g, or t
  misc_feature (146)..(146): n is a, c, g, or t
  misc_feature (156)..(156): n is a, c, g, or t
  misc_feature (160)..(160): n is a, c, g, or t
  misc_feature (172)..(172): n is a, c, g, or t
  misc_feature (174)..(174): n is a, c, g, or t
  misc_feature (176)..(176): n is a, c, g, or t
  misc_feature (183)..(183): n is a, c, g, or t
  misc_feature (204)..(204): n is a, c, g, or t
  misc_feature (206)..(206): n is a, c, g, or t
  misc_feature (214)..(214): n is a, c, g, or t
  misc_feature (216)..(217): n is a, c, g, or t
  misc_feature (221)..(221): n is a, c, g, or t
  misc_feature (223)..(223): n is a, c, g, or t
  misc_feature (229)..(229): n is a, c, g, or t
  misc_feature (243)..(243): n is a, c, g, or t
  misc_feature (247)..(247): n is a, c, g, or t
  misc_feature (276)..(276): n is a, c, g, or t
  misc_feature (280)..(280): n is a, c, g, or t
ggggatcctagagcaggaagacagtaaattggaaaagctaaagctcccaccccgggatgaagaatatttactctcggacgtgaactctttgtgaaatttgggantttgataaaaaaaataattgttttttnagatttttaaaatgngaaaatttgngttngattttgattgntngntgtgatntggttggagaaggaatggttntntagagagngnnattntngatgtngtgaaatagggagnaggnaaaagtttggtgtaaaatatttaaaaaanaaangaaaaatttaaaattcacaggttgacttcctcctgactttccaccctacccaaaaactctttaaaaaataaataaacaatttaaaaaaaaaattatataaaaaaaatatgtaagagagagtctgtctccttcttaagccaaacaaaagaaaggcaattaaaaaattattaaaaatttaatttaaatatctatccgattctccatagtttttcataaatgaattcgctgggcttggaatttgtattttatccaaatatgtcgtcaaaaatggcaaaatggagaaattcaactcttaatacaatagctaacaatatcactacctggacgaaacgatcgagatatgatttgcaaataataattgtaaaatttttgatttatcttttaattatttgaacaaaattaaatttcatcttcgttatcaattatttaaaatcctatgcagtttccttgttttttttaatttgattaaataagttttatatttttcatttttttgcttggcctttttttgaaaaatatgatcacaaagacgccgtccggtcttgaaatttagtggtttatgtaatatttttgaaatcaaaaagaaaaaaaacaaacaatttttcaataaaatttattcatttttataaattattgtacccaccaccactaatttaaatttgtttatattttatgcaacccgtacttcggcacaggcaaaatgcgtgccgcgtcgtttcataaaattgcgtaggcaagaaaattgaaaaaagtcacaaatattgttcaaatatgagttggattcgttttcagacattccacagcaggcaaaattttgtccccccatttctcctcttgtaaatttgaactaaggtggggggtggaaggggcgggggggggggaattactgataatttagaaatctctttgggcggcaccgcgccgagaaacgggcagttgagcaagtcaatttgaagcggatcatcaacggtgtgtgtgtgccccgctgctcctccctacgccccccacctcattttgaatgtgtatctcctatttgccgctgaggcactttttta

SEQ ID NO: 27359 - DNA, 1061 bp, Heterodera glycines
ccccccccctcccatcgctcgagacaaatggaagatcgagaccgatcgatcagcagggcacagggacaacgtggccccccaattatatatagcatagtgtcagccccttaggggcgtaggggtggcggatggacccagcagcagggagtaagcagagcacagtcactttattgctccgctgctgattaagtggttgattaggggtggtgtacccacctcatttccgtcccatttcggcgaggggagggggtcaattctgtcttggattcaagatgttttatttgtgccaaaactaagaatggtgtgccatttgaaggctttaaatgaaaagttaagagattaaaaaaatgtaaaaaaaaagttatttcttgaaaattaaaaaaaaagtggtattctttgcaatttttcgtaagctaatacatagaccttgttaagagtgatacataatttagtagaattctatcaactaagaaaaaagttagagtgaaatatatttggccagacggaattggccagatggaaagttgctttttggatccggaaaataggaattggatggagcctaagtaaagcaaagatttttggaccggctaaccccagttcaattcaagcacataagcacataggtaaattattggtgccagtttaatttttgggcgctgtcagttactaatttgctgtcccaaaccccgataattttaaaaacatttttttaaattttaaaaacaatatctcatattataataaattttcatttaggatgaatcaaattgatagcaatagcttatactctaagcaaaaacatgattaaaatgattttttatgaatgaagaagaacggatgaggatgaaccgggggatgggaaagcggatggatgtaaaaggcagacagctgaagtaaaaaaaaaagctatactcccgccggtctctgttaaaaattttattcataattattcctaataatttttttaatttgaacatattaatctttgcctatttcgcgattttttgtgcctaaaagaggcagccttaatgatttggcatccaatggttttaatattt

SEQ ID NO: 27360 - DNA, 905 bp, Heterodera glycines
tgaggccgcgaagcggccgaatgtcccccaaaaaattaaaaaacgggcgcgaagcgcccgtcctgaggccgcgaagaattgctaaattacatcactttctagcgacgcggcgaagccgcgtccctgagcgcgaagcgctttccccacggcaccagaactcaactgaatacaacaaagccaactgtgcacctagtttatatatatatagaataaagttgggtttcgtagaaaaaattataagtccccgtagtttgcccggaggctcttgaaagtgcggcattgcttaagcaactttttgaggcgcatctgggaaaaataaggatttttcggtccggcggccagttgagcgccagcggcgctgaaacggcccgaaaatttttttgtccgtctttggtggcctgtaactttgcgggaagaagcgggagcgtaaaatgcttggtgggaggattttaagttggaatgtttgggaaaacttggcgcttatttggcggggctatctacaaaagcctggcctgcagaaattggcgactttttaaatccatttttggcgttttacgtttttcgggaataactcgctgggggttaagcggagcgggttggcgccgcttgagcattcgtgtagtttttaaagctgcatccgatggcgttttcagattttgaaaattctcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaatttttccgggaatagaaaaattttccggaattgagctccccattcccgtcaaggctataactcgtcaggcgttgatttaacgaaaatt

SEQ ID NO: 27361 - DNA, 1403 bp, Heterodera glycines
aagcatttgcagcggaggggcgggccggtggcgcgggagtgtccatgacagcagcggcagcagcagcaaacactgtccatccagcaacaccaaacgcgctgaacgacggcggcggtgctgacacgagggcaatgtgcaggtaaacggaatgaatcattcattgtcaagcgccttctcacaatcaggccaagggccatacgatgaacgattgagacgtgggggggggtgtctcaataccgaatttttcatacgacgacccaattttctccggcataaaaaagcatttttaaaggcaaaaaaagttgtcggtctacatggctgaacaccttcgcaaaattgttgctgaccccctttccccaccttttttttcatgtatgacatggacattaacctagtttactgcgtctaaatttttctgtttccaccatgttaaggcgaaaggatttagattttttaacttcatctgatatattccgcttttcactcggcttacatttagattcgcgaaatccgcgtccacaaggccattttggcggcccggtcacccgtttttgccgcgatgctgcagcacgtggacaccagcgagtccaaaacggtgtgtgttttgtgtggtgtgttgatcgaagtgtcaatttaacattttttcttttcagtttggggcattttctcgtctttttttaatttttaaaaacgatattttcccagggtgtgctcgagataaaagacgtggagtacggggtggtcaaggagatgctgaacttcatttactgcggcaaaagttcctcagcggagctcaacgaaattgcgtccgatttgctgattgcggccgacaaatacaggtgggaggggagaagggattatcatcaagaaaacatagacaaaaaaaagtgccaagatttgaatcgagaaaaattgccatttgaattttgttatccctgtacagattggaggagctgaaaacgcactgtgaacattgcctcatccaggcgatcaacttcgataatgcgtgccaactgctgatcattgccgacatgtgagaagggcaaatacttgggaatcagtgccaaatataaaaactaactgaaatatttctcaattcctcccattttatcgttagttttgctatttttatgacggcttttacggggcaccttcattccctcgctcttccctcccctccttaattccgaaaaattcttttaatattacgtatttgatgagttaactgagattagaagtggaaaaagttttaaaaattaagtcatttctgttttcttttacaattagtgttttataatggcatcaagttagaatcaactttgaatttggcatgcaaatcgtctaactgcttctgctttgcttcgtcgacacgacggcgaagttgggcttccgaccaaagctta

SEQ ID NO: 27362 - DNA, 1749 bp, Heterodera glycines
gcaggtcggacagaaaagctaaggttacacattctcgagccaaggccatactgtcttccccctctctctccgctctctctccccactctctctctctctctctctccctctctccctctctctgtcagtctcccactctctctctcctctcgaacattgttaatgagtggattattattaattactcgtgaatcaactcgccccatcctctaacagtaatattatcattaattagtcgtcatcaatcaactcgttccctcttgtcatcattgatcaatctaccaattgattatatcatatcattaattagttgtcaattaactcgccacctcctgcaacagttgaacctgcaagggtcgtcttcaccatcatcatcattgcctaatgagccaataagtgcccaattagtgcagcaacagcaacaatcaaagggcaacccgctgatcattttggccaatcgcagtgtggtcactgttgcagttgcgttggcccaattgctgttgctttttgcccaaatttatctgctcaactgtttggacgaggacaattttcagcagaaacggggaaaattggtgggtcagcagaaaaacaaaatttctttcattaaaattttaaaagacttcaaaaaatttttcaaattttattttatttgaaaagtttggagttccgtggtcagtctcgagtttttcaaaataaatattggtggaaagtttaaccttgagttttttcgaaaaacactttccggtctttggcgaagctcttggcctctggttccgaggagctcaatctcgagaccaacccacagtacttgaatctcaagcaaaatttctgcgtataatacaataaaaaaaattaaggaaaaacaaatacatttgaaaatttatttcggtttcttcacaaattttgtaaaatttccaaaatgttttcccggtggcacttgccggcaccgctggacggtttaatcgcgttaaattttaacaattttaattaaaaaatagtcatttttgtcgtaaaatttgctaaaaatgttcctgtttttctcccatgacacttaaatttttagaaaattacattttaaaaaaaatttggtgccgaggaacaaaaaaattcttcaattaaaaatttttgttttgttccatttgctcagtttctcgaactgtttgtgctgatcttgagctgcttgagctggctgatcgtttttctgttatctcttcgcactgaatttgactgggaacacatgtggctgtgcaccaacttcaggccaaaactgctcagtgtggtcatcatcatccaggtggtgcacgtaattaattaattaaatggatttttcgtgaattctataggagcaactcgtcctctccccccgtatcgttttctgcacaaaaatttgatttttttttttcaaacatagaaaattttcaaggaaaattcttacaaatatgtttataagaaattaaagaatttttttgttgaaatagattttttatgaaattttatgatggttatttaaaaaaaaaatttccaaaatttgtttttcttgaaatttgcttttcaaaatccacaattttacacatttttaatttgaatgaatcttgaacttatggctaatacaacacgcgaaatgtatagtatagtcatactgtagataataatggtaccaataaaaataatacccccccccccccgtaaaatgataacaatggcattaaaagagctttttgcagactgtttcggccgtgctcattctga

SEQ ID NO: 27363 - DNA, 1552 bp, Heterodera glycines
gttagttgcttgggaaaaaccgggacaaaaatcccggaaaaggtgataggcttttcacagatttttggtctcccagtaaagcatgttacatatgatgcatgaattagcaaataattaatttcaacgaagaggacatcatttaccatgtgtgccatactgtaatttggtggcgacatatcgtcatcgggcgtgtgacttgctgaaatattatatgtggtttgaataacgggcgacagaaatgggagacgcatttcaattcagtttgtatgtctatggcaaaatgatttttgagtcaccatttgatcgtgcttgacagagtcatgcaacacaaaattcttttcaatatccagaagatgacctataatatgatatcaaattatttcctttcgcgatctcgagcccaaattgaaactaagagtgaagaagacaaagtatgtctctgtatggaaacatgacttattaagaatcaaaagggggcacccacttgttttgcaaaaattttttgtgataaaaaagcatgataatttgttatccggggttttaaaggtcgctaatcacgaatctgacatgtattttgactaatttctaatccctaacgcgaactcgaataaaaatcgaaatttttaattttttaaattatgattttttgttcaaatttagattaggaaatcggaattggtcaaaataattgaaagattcgtgatcggggaccccaaaaaccccagagaatacatttttatgactatcacaaaaaaattttcaaaacaaaagggtccccccttttgaaaaaattttcaaaaactcacttttacactagcgccgaattttttcaaaaattttaagtttcgacgcagccaattttgaaatgtaatataaactttttttctttgtcagttaaagttaacaaatcaggcatcatttgaaagctctatgggtgccctatatttatatgtcaaaatagaaatgaatgatttgaaaattaaaaagttatggcacgcggcgccgaaaaagccaagaaaaagtctatttttgaggttatgtttattcataaaattaaaaagtcatcagaagggcgaaaaccatttactctgacgactgttcagataaaagtgttgtagagtattttttgaaatttcgcaggctaatagagaatcttaagagctatcgaatataagttttatttgaatttttctcacaatgatttgaatggtggtgctaggacaaagtccgaatagggcaagtaattaaatttaatttaaaaaaatatttaaatgataaataatgatttaattaattaatagggatggtatttcaaaaaaatgattcacgtaaatatatatatatttttattcttaattaaaaattttaaaaaaatggatttattaaaaaaactataataatttcatttaaaatcaaaaactataacctaaattaaataagtttttatgtgttttacttcctaaaagtatagcccggtaaaatttttgaatcttgtagagagtagaaacaacaaatatattttacacaaaaatgtttcattcggtaagcaaaa

SEQ ID NO: 27364 - DNA, 1186 bp, Heterodera glycines
aaactatttgctaagtttttttgaaaatttttcaaaccctacccggaattttcataaaatttcaaaaaaaattttctaaaattttttccttcaaaaatttctaagttagaattttttttatttcatttggcggttttttgagtaacgccatagcaccgatgaaactgatgtgattgacggcaataaccaaacaatattacctaatctgcctgaacttgattcaagaatacagactatgtcagtttgaaaattccatgcaaaattcccgagacccggccagggtgtgattcccagggttaggtatactgcattttaagcgtccaatttttcaaatcaccgaattgctccccctttttgtttttaccatttttttgaatattttttgtttaatgtacaataaatcttgctctctacaatggtaattaattaaattttttgaaaaaagcgcgccgcaaaaaaaagtttttgaaaagcaaaaaaaagaaaaaaaggtcgtcgatttacatggctttacccccttcgtagaattaggcgccgaccccccccccccccccttatttaacgtgtgattcaaattgtatgtaaatgtatgtcacttatcgtgttcaagcacgccagaaaatccccgagtacaacttagaatcatttttatgggaccagtaaaaaacgtgaacgttttttagccctcttggtttagaaaaatttaatccttttggtttacccctttttagcgcaattctgtctgttatccgtcaggatttgttttggactgtttttggcacttttttactttagcggacccggtgaaaaaaaagctcacgcgataccttcaattctttatttttttttaaataaaaatgatccaaaacaaattatgtgtccatggtcagcgaccctgatggaaacgtacaaatataagacatttgaattttgttgaaaatattacagtccccccccccctccctttatttattttttttcatcgtgtcacctaaaatgtaaattgctcaaaaattcataaatttgataaaaattccggcacttttcggttttatgaccccccccccccagtcatttctatggtaatttgtgaaatttccctttagcaaaattttttaatggcaccgcccgtcaaaaaagaaaagaaaaagttttcttccgacaacatccggctcatttgtgaaaa

SEQ ID NO: 27365 - DNA, 1087 bp, Heterodera glycines
aggcaaaagtcaaaaaaaaggcgaaatattccaaatttaatttagaaaattaataatggaaaaagagacttttaaattgttcgatggaatgaaaaaaaacgaatttggacggggaagagaagcgaattggcattgttccgctaattgtgcaggtgcttttcaaagtgcgcttcatccaaagccaccaatttcagtttttccccaatttgcccttttttccgcgattcgaccggagagaatttttcggcacaatttcagagaattgtcagcccggcaagtgtttcgttcccttttattgttccaatttccttgctctaattggagttcgctcacttttaggttctcccgtccttctccccaacagttcggcccccctcctcccgtcgctttccaatcgttttcccctcaaaagtgccaaatttcggcttctttctcccttcgagtcgcattttatgatcgatgctcattccggcttaattcgttgcgtggcaccaattgacgcggaaaaggcgagcttcgtcaatgctaatcattaactttatctctgcccattaattgcctttttcccgttcagttttccgcttggcactttttcatcttggcacaacaatcgcttccttctgtcgcttctccttccgccctttctccgtcttcaatttccgttgttcccccaatttttactcaaccatcgcttgtgcttatcaaaatcatcaacaacaatgacaatgcgccggcctttgaacggtcgttttatgaagtggaagttggcgaaaacgcaccgaacggcacaaaaattttgaaggcatttattaaaaatagaaataaatatatttgtttttggcatttttagctatttgccgaagatgctgacagaggacagtttggacgcgtctcttattcactggaggaaatcgaattggtcggcaataaaagtgacaaaagcgaacaaccttcgacggatttttcggatttgtccgcccattttttgttggatgaaaatgacggatggctttcaattggcgccccgttggattttgaacgcatcggaagaggcattcttctcccattctatggcagatcacttttt

SEQ ID NO: 27366 - DNA, 2138 bp, Heterodera glycines
  misc_feature (860)..(860): n is a, c, g, or t
ctttttattgatattttgatttttcattaatcttttatcctcccactcatataattatgaattacttgcatgattgaatatgttatctagctattttttggtatattattgtctttgttattattcttattctatttatttaatttttattatgtaaattgtcgtataattttggaattttctttctatatgctttcttgatgaaaggaatagcaattcgtattagccgaatgaaaagtttcaaagatattttgacaatttattttttatcctagccattaaggttttaattaaagagcggtaaaaaaaattattccggaacgggaacgggaaaacgaaaatgaacggggcgggattcccgaacaggattcccgcctttttcccgttcccgtaaaaatcccgtcaattttaacgggaatcccgctgggaacgggaaaaaatttttttcaaaaaaatattgattttttctaaaattttgatttactattttttagtgatatatttttaacaatttaaaaaaattatttctatataaatgattaaatattgcttttattaatgacaaaaaatttaaaatttaatttctggaattgatttgttttaaaaataagccggtaacaatattttcgaggcaccggcaaaaactggtaatttcctgagttctaaaattcctagaaaattttttatagagcaataattttcgttaaaattgtctattttttttaattccaaaatattcttatagaatttttttgtgttttaacttattgacaaaactttttttgattaaatcgtttttttgaggcgcatctttgccaaaatcttttggggaacattggggggggggggcggcggtgccngataggcgccgcccgggggttaaaatttgaaattttaatgaaatttgttagtagattttgtccaaaacatgtccaatcattggttagtttatggctctatggctgttttaaaaataaataaaaataatttcaatcttattaattaaatttcaactaaaataattcaaaggaaaataaaaactaacaataccaatggggaattgaacccaagtgacaaataataaaagaccaaagtgttaaccactcggctacacacatatgttcactcgttgatttaaatcaatttatttatttaattttcccaccaatatccttcaaaatttttcacttagacccccattcttaccattgttttggaaataaattcacgatctttgatttatttaaaaattattaattaatttcttttaatattacatgattattggcttttaccttattcatcttaaataaaacttttatttgctttttaatttcttacctaaatgaatgtgatttagctatttttctttgtttttttcattttttatgcatgtcgtgattaaaagatttttaatgtttaatttgcgttttataatgcaaaaacataagcatttgtttttcgcattgttttttttatttattttatgtttattattccaattatgcttacttaaacttttaaactttagaaattaaaagatattcgcgttgtaccacaaaacaatggggtttttcacatgcctttgccgatcatgttggcctcgtataacataaaacattgaataaataatatttttcctctttaaccatgttatttataatttttaattgtagcaatacttgatttgtatattatatatgaaaaaattagtattattttatataggaggtataattatatttgtaagttttaattgttatgtttttttcttgtatcaattagtattttttggtaatttataaaaaaaaatttatttatgtatctcctattatgtatcacgcttttcttgttgttaataaatttattttaaattttaaagtataatattttgttgatgtgtttcgtttcagagagtgagaagagagacacaaattttttgcacaaaaatacttttgtcatcaaaatttgcaattttacaatatcgcctgttttttatttagcaatattttcagctgtattttagtcaaattgaaaatttcaaaaaaatatattttttcaagatgcacattgccaaattttgtctaactgttttgaacgaagtgcttcatctccctcagcctgcttgagatgaggag

SEQ ID NO: 27367 - DNA, 1502 bp, Heterodera glycines
aaaaaatgtgtcgcagtcagcaggattcgaaccctgcgcgggcaaagcccaaattgatttcgagtcaatctccttaaccactcggacatgactgcactagcgaacttgacctttttttagaaattataaaataaataaaggcatgttttaggtatggcgcgagacaattacgcgcaccgaaacccaaatttatccgatttggacgttccggacaaaaaatgatacctttcagcagaagtttttcaacagaaactgtaattttactaaataattttctttgaggattaaatgcaaaattaagcagtacggcgacgaagggatcaaccaattggacgcgttggttgatgcggtcgataagctgtatcaatcatcgccagaaattagggcattcaaaactgcgccaaaaagggcacaaaagttcatacgattcggctgatgagagagaatttgacgaggaaaagcggacaatctcagaaaaagttaccagcagacgatctcacaatcccttctcttttctgaacaaataaaataagttttattcgttaattcgaacatttgacaatttaatgtgaattatggcaattagagaaattgtccaaaagagaaagagaggcgagcaaagggcgagcgattgggcagggaaaaagcgccggaagggatcgcccgcggggatgaaaggctaaaagggaagggaaggggagaaaacggacggagggacggaccacggcaaaaagacacagggaaaagtacagcgaaagtgcgcagacgacgaacagacaaaagcgaacgacggaaaggcgaagggacgacgccattgggcagaaggaaagcgaagaaaggtgagaaaagcgaacaaatccgaatagagaggcaattaaccgacaaatgagcatagtcaacgaacactcaatcatctcaatttatacacgagagaaagaaacaaaaagcgaaatggaaaagcgattttcgaaattgagtcatttgtttgtgcttcaaagggaagggacgctccgccgccattcggtggcctctcatcgtttgcctccgtttgtgccgctttccccacaaattcatcgacttaatgggattcgttcgttctgaccgcagatcagctgaaagtgccctccgaaatcattctttgcctctccgatggttcgccccctttccgtctctttccctttgtgcgtcattttcgccactttttcccccttttatggggcggtccaacaaacacttctcattgacttggccaaaaggcattcagcgaatggacaacagtttgaagggtttgacaatttgctgaccataacgaagggagagaaggaaagagtgccaaaatggggacaatttcatgccgcggcagagacccccgaacatttgctgaacaaggttggcccccccccccatgtcaaagtcgaaacacttttaagttgggcgaaatgatttcttctcttggcaaaatgttttcgctacgtttcgacgaattgtctaaggtggggaag

SEQ ID NO: 27368 - DNA, 1937 bp, Heterodera glycines
  misc_feature (1061)..(1061): n is a, c, g, or t
  misc_feature (1068)..(1068): n is a, c, g, or t
  misc_feature (1102)..(1102): n is a, c, g, or t
ttgtaaaattagcaccgtaaaaagtgcattaaaggtaggaactactcagaatttcataatattgtcttataacaaaaatttattaattaattatggaggtggtaaaacaaaaattttatggataattaaaagaaaattggcgttcttatacagtcgggtcagaagtattgcttaaaatttttttattaattagtatttaaataatttaattcttaaaataggcaaaaaaatatttaaattacttaatagcattaaaataacctaaaaaatgtatagagcgtaaaagcggtcatggagtttttgggaaaattcgttaaaaagaaaattcaaaaaccgaaaaactctctagagtggcttgcatgaaaactttgaaaattttcaaaaatgaaaaaattattggatagagcttacggaactcaataaaattttggaataaaaaagaaatttattaagaatcatttctgagaatttgttttaccgactcaagttgactaccaagaaaagtaaaaaatttctgaaaatttttgcggaaaacaccaaaaactacattttagtaagtataaaaattatttttttaatatatataaaaattaattgagggtttgaatacaccctttttgagatgctctttcgaattacaagactgaaattgtaaagtttaggaacaaaatctcagcaagccattttcttgttcgagactttatcgacataatttcaccatatatctggcatttcttaatcggaaatcaatttcaccaaattattatattctcataaattttatttcgattaattcgtagtaattcataaaaaattttctaaaatgttaattagttttttgccagactctgattaacaatttgctgtgaaagttatctgttggtcgatcattagcagagggatggacaaatcatcacatttaacattgggaaaatagaaaatcgaagcaaatgggccaccaccattgatggtcgaaatgattaatcgtagttgggttgggaaatcacaaattcaataggtaatttggccgtacattttcattcattgggtggcttttcccnagagttntacgctcatctctttccccttttctattccgccntaaatcgtggctatgtcgagtgactgtggcctgcataaataccaaattattgtcattgaaaaatcagttttgggattgggctgggatggattttgggctgataattggacggctttttcgttacttctaactttaatagataataaaaactcaacagcaacaaaaaataaaataaattcattcaaaagaccaaatcaaactatgatttggccttttgttttggggctgttaatgtccctcgggcattcggctcccgttgtcaatacccgcaccgaactggcgctgcaccaaagcatcgccaaaggacaaggcaccaccgcatccactgcaaaaagcaccatgactacagcgattgctgtcatcgaacaccattcgaaagtgacttaaaggcttaacaaatgcaagttcgcacactttttttccaaatttaaggaaaacacccgagctctgacggttttcaaacgtgaagaaaagagctggaccagcattttgctgagcttgctcaaaggaattggcgggattgggacatttatcttggatttgggtaaagacattatcaaagacgtgttgaaaaccgtcaccgaaaagttgatcgaccacgcgctgaaggaaggtgttggacaaggggtgataattaagaatatgctataatattagactgcgacacgctccgcaaacggtgctcgtgcggttggggcgcttgccacccaaaccgtggtggagttgccgatgcatgttgtgtggaaggctacagctggaaatgctgcgaaaacgtagtttttacttgttttaactaataatatttttttattgttttttaatattcataggcaaa

SEQ ID NO: 27369 - DNA, 1015 bp, Heterodera glycines
agaaatcagttgacgaaaatttggagaaaaatgggaaccttaagaaacgaataaaaaaagagaaataaatggtaaatattacaaaataaaagaaaaaataagcaaaaaggaaggaaatattcggaaaaagaatggaataaaattgaaagaaaataaagaatacactggggaacaaatcgtacttaattcaaaaatggaaaaagaattgggattaaaacaaatgaattgttacaaaacaattaatgattagcaaaaaattgaaattattcaaaaattcattgaaatgtcaaatgaacataaagaaaattggaagaaaacactcgaaaaaagaatggcaacaaaaggaactcggaattagccatcagtaattagaaaatggaagaagcaatttggaattcgctgtaaattaaccaaaaagaaaaaatgagaaaaattaaaatttattggcaaataaaaagagaaagacgaaaatgagtgacaaagaaattggaaaatattgaaaattcataaatcgaacattttaagatggaagaaacaacttggagaataaatgttttggagaacagcagaaaaaaatgagtgatcttggaattaattaatttgatatataaaaggtttagcgggccaggccgttttcgcctggcccattttcgcgtgggccgttttcgcgtggggcggagtttttggactataacttttttctttgccaaccaaatccaaccattcgaacccctctcgaataaagccacccttctgaggggggttgaacgggcagagacgttttaaataacacaggacatttttgatttttaacttaattgttaacacttaatgaatgtaattttaatggtttggaatgaatgaagtccttttcaatcagtataaatatcaactaatagcatgggatctgaaatttggaaaaaaattgggaccggaacttgccagaataaaaaaactcccaattttataattttttccaatgaaaacatgataaaaaaaataaatttttcttttc

SEQ ID NO: 27370 - DNA, 1045 bp, Heterodera glycines
ccctggttcaatctctctaccgaaattaaaatattttgaattttctttttgtatactcatggctttcctatcgacaaaatatgattcttaattttttttaattgtattttatcattttttaaagaaaatccgtacaaattgagcctagtaatcccaaaaaccagccttttttgttaaaaatctgttaacaaatcttactcaaattttcaaaatttcccccggcggcgcctatcggcaccgccggaccgcttttatttccaaaaggtttttggaaaaagcgcgtcgaaaaaagtgatgttaaaagcaaactgaatttctattaatattcgatcatttggtccaaaaatgattaattgtttgaaataattgaagtaaattcgatttgaaatttttaattaatttaacttagctttaacttttggattttattaaataaatagcaaaataaattaattaattttgtattatttttacttgaaataaataaaatttatttttaaaattttttgaatttttaatatttcccagttggtcccggttcccggtcacggacaaaaatcgaggtcccggtcccggttttgctcaaaattcccggtcccgctctactctatttaaaacattaatgtcgacaataaatttttttgaggatctctttggatgttccgctaaaatataatctctaaatatcagatcaaaatatgctatgaagaaaggggctcaaaaatagcatttctgcgttaaaatttttagatttggtgaaggtttttagtgcatataaaatcatattttgggggttttacgagaataaatgcatattttgccatttttgcgtttttagagcatattttggtcatttttggcaaaatcttcataagaaaaatgcaataaaaatgaaaaatacacccctaagatcgacctttttgggaatttaaaaaagatacccttgaaaaccataaaaatttgaattttttataagaacttttaaaaaaatgttgatataagaaaaatgtaatttggttttagcatgtgaaaagattttaaaaaa

SEQ ID NO: 27371 - DNA, 1647 bp, Heterodera glycines
gtttttgcttctttcacttttacatcaatggcaaatgtcactttgtcctcgcttttgttgaaaagggcttcttccaagtccatcaatttcttaattgtaaattatttaaaattaaaacagtcattttaaatgccacccacagcaaatgtaatgaaattggggaatccccagtcattaaattcattgtttataacatgcgcattaaattctctcctgaaatctgccacaccgaatatttgtgaaacgattcgaatgactgccgaacattcgcagttccaattttctgcccaatgcaaattaattattaaattgttaattaatatttaattttaaccttctgttggagcagtgcacaaaaggaaaatgcccaaccacttctcattgtcattgccttccgacttcattcttatttgtgcaaatattttccatggcaatccctttatataagtgactgtttcgcttttacgttcagtccatttgagttctcgcaaaaattccgacattttttcaatttccaaagaaagtgtccactccgatttgttggattcggaaacgaatttctccattttttcatctttcactgtgatggcatcaatggtcaatgtcactttgtccgcttctctgttgtaaaaaccatttgatgggtccatcaattccttaattgcccataatcgattaataaggaataaaattaaatggccaactcacggcaaaagtaataaaattagggaaaccccaccagctgtttttattgttaaaaatatggtcacaaaaagtcccagtggaattatccgccgctttcttttgcgagacaattcgaaaagtggccgaacgaacacagcagcgccaaattgagtcttaatgccattaattgtcgctgttcattagcactaatgagcagttaattagcaccttcttctgaagcatcgcacaaaaggtaaaagcccaagcatttctcattgtcagtgcttcccatctttgtatttattttggcatatattctccatggaagtccatttatgtacaaagttttgctgtatcgactgctctcaacttcctctcgtgcaaatttggacacttttccaatgtctattattaatgttccaaatgtccaaattcgccagtgtttaggaaattgcactggatacagtaagtcaccggaaatcccacagaaattcggattggtatggtattgttcaatgccgaccacttcttctgttgttaaaatgccgaatggaactggtaaataagagaaaggctgtgaatatactaatttaaatagtcagaaaaagatttgacccaaaaataaatattattttttttaccaatattttcagaaaattcctcttttgagaaaagcggaaagcgaattttgaacaatgccgggccaagcatttgacgacgattctctgcagaacattcaatcccattttcacggcatttttcatcggcccaaagaagtgccgaaaaaaacaaaaaataactattaattattattaattaattattttctattagagcagagcagtaattgtaaaaaaacccggtttggggaacagcggggtccggcggtgccgttaggagcccgcgcgaaaaattttgtaatttttaaatgccgattgtaacagaatttgtcaaaatgacaca

SEQ ID NO: 27372 - DNA, 1003 bp, Heterodera glycines
ccgattttgagctgttttgccgcaagaatccttttagggtgggataaagaaaaaacaattccgagaattctaaagatattgctgcttaaactagggggaagtgaaacaatgccatagtcattttgcttttctgctgtatttagggtgaatttacaattttcgctggcttggaggattgtctgcattttatcaagaacctccatttttcagaatcaggttcgaattcgaaggccttaaatacaaaggagagcttcataatattattttccgcttttgttgcttagatttggagtacattcaacacatcgccttgccctatgctgaatcggcctttttcgattatttgaggagcgaattcaattgcaaaggagtcaaaatttcggcagtccccgaggtgtttttcgtttttccattttcattgccttccccaccctctttttaagggttcaatcgtttttcctcgtgtccctttgattatcgtcgaaggtcccttggcggtctgtcaacttttggagactccgttgctaaacctggtcaattacgccagtttggtgaccacaaatgcggccagattccgattggtctgttttgtttgtttctcctttaagtgttttcggcttaggctgctggcgaatccatcggtctgttcgaatttggccttcgacgtgctcaggggcccgatggcgctttgtcagcgtcgaaatattgctttatcggaggtggggaggcgaggagagatatttataaatgagaaagattttcaggctttgatagcaccagcaatttgttggccggcaaattgtacggcattccggttagtggaacgatggcacattcctttgtcacttccttcgaggtcttacaattagtgtttatttcttatctcattatcatccattttcagcccgatgaaaccaatgaaacgtccaaaatttgctgcttccaaaatgacaaaatggtcgacctattcccactgtcccaaggaccaaacttgacttttttg

SEQ ID NO: 27373 - DNA, 1398 bp, Heterodera glycines
aatttatttccttatttatttcggaatgccatcgtccaaagcctttaatccttttaacatttccatgctaattctctgattttgtgctgattcactcattccgattcgtcaggcgtcccttttagaatccccccccccccatttttttcttcaaaatgccctttcttccgtttggccaattcgagccgtgctgctcctccttcgattactccttcataatgtttggctcccgagttgttggaccagcacattcaaatggacgacaaaaaacggacagaaaacaaacggtccgatggcggggaaagtccgtcggcaattggtcaaatgagtgccaccaccagtcaatgggaacgaattgctcacaaattgttctgtttatggtcagcgccatagctttaatcagcataaatggcggaacgatggcccaaaacaccggtaaaacgggggagggcacggccaagccaactttgacgaatgaatcgaccttcaggcaaatgctattccttctcgcccggcctgaccatccccggggcggactatcggcgcgacttcggactttcgcgcagagaatgtgccgaagtgtgcaaaaggtaaatgtcgttccgttctgtcgggaatgctttgactttgctgcttcagcgatttgtgctgcatggcattcgaatggcgtcgcaacggcggacagtgcactttgaagagcaggtcattgaacggaacggtgacagcagcgacaaaattggaggacaatggcggagaggagcagaagcataacacggagcaggacaaggaccaaaaggatgaaaccaatggcggaggggaagccgacgcgactttcttcgcactttgcttagactacggtgggcccttttttgtaagcggaagacaaaaagcattggagagtgggggagtcataattcagcgaaaggcacaacagaacaatcaattaggctaattggccaggggaaatgcatgtctgatgacaacgagatgagcacagtgaggggcggagagatcaaaagtacaaaaacacgcggaaaatggccaataattttaattgatggtcgacttttataaaactttaatcaggccaacaaatttggagataatgggaggaaatcctctcaaatggaagtgatcttagtaatggcccgaattgggccgagtttttgcaatttccctataaaaagggtgctatgtcgttttataaaaaccatcaataagggcgttatatattgagcaaaattatgccaaacgtacccaaggaaccgggttttcaaacatttttggctataacttttttgaaaccttaagaaattttttgaaattttgcaggctaatagaggacacatagggctatctactaatagcaagaaaaaaaaagaaaaataatttctaaca

SEQ ID NO: 27374 - DNA, 1455 bp, Heterodera glycines
  misc_feature (1241)..(1241): n is a, c, g, or t
  misc_feature (1252)..(1252): n is a, c, g, or t
  misc_feature (1264)..(1264): n is a, c, g, or t
tttcatgggcttcatcatcatccattgctgatcaaccacatcatcaacttgacatcatcaagctcatcgtcctcatcaaacggttattcggtcccacttggtcagttcagttcaattttttggactggaaaaaaggccaattgaaagtgagacagagagagagagagagagaggtgccgccaaatttagtaaatttgggaaataaaattttttcgaagaaattttgacaatttaaaattaaatcgaaaatctccctgaatttttgggcaaaattaaaactcttcctgctgatgaaagcagagattgtgtcaaaaaattgacagaataagcatttcaactcactgatgaaaaaagccttggtgttctaaatgaatcattaaaacaattagcgaaattttttttaattttgggaaaatttttttaaaaattttaattttttaaataggtcatcatcgtcagccggccccgttgcaattcccgcccaacggtttgccaattcagcccgtatttgtgtcaagaggcaacaacaaccaataccagcaccagcagcagtacaactttggctgtccaagtcggttttgtatggttttgttctctttacaatctgtctgtaaattaaaaaataaaaataaaattttattttaataataattaatctcaacattttaacaaataacggaaatatgcaaattaattaactattaaaaacattttgtgaatttttggcttttaagataattctgaaaatggggattaatttatttgggaattatttcaagccctttcgaaaattaaattttttttcacaaattttcacctcttaaacttattcaaaaaatgttcacaattaaaaatatctttgtattatatataattgttgcaaatagatggcatttgttcacgaattggtgcccaactgaacaccttcaacaaccataatgacgacgatacagtaacccagccaccgtgtgctgctcgaaagagttccgacccatgcgccccgcgcattggtacggtaacccgcgttgattaaattacagtattcaaattggatgccatttttttttttttgaaaattttggcaatttataacagggcattttttaggaaattcatcgattaaaaatcaaaattttttgtacaaatttaaggcgaatcaaccgatcgcgaaaagaacaacaatctgtggacagaatggacggaatggacacagtaaaaaaatgcaataaaattataattanaaacaaataanaatcaaaattanaatgtgtttgatttgtcattttttgccagttgttcccgcagttgtggtggaggagacagatgaaacgacggtcatgcaaaagtggtgttgatgaccaatgtgttgggccaccaattgaatcgcgtccatgtaatgatgaacaatgcccctacgtaagtgaacctcttttgattgtgattacagtatgccat

SEQ ID NO: 27375 - DNA, 1180 bp, Heterodera glycines
cccgttgcgattggtgatgattttgagttccaaatgcaacaatttcgctggccaagcattgtccaaatggttgcacacgccgagaaaagatggccaacccaagcgattgcattgcgaagacattaaagaacaaacgaacttcgattggatcaacaatttcaaggaggtgtggcccaacatttttgtgatttttgtttccaaattgtttagcattttctccgtgccaatgccatttcttccgtcagttacgaaattcatttttcttttcgcgtgccgtcaatgccaatgatgccatttgaatgtgtggtgaacgaatcgacaaaggaaaagctgacattgaccaaagcaaatgaaaatgaatgggacatcgattggataatgaagcgttgtaaaattggagagacagcggcggttcagcagcacaaagagggcgattggaacaatgtgttcatttggctttttgctggcactaattgcattgggtgagcaataaaaaaaggcatttaatttttatccgaatttgaattttgcgcttaatttaggccattatctccgccaccaccagcagaagaagatgaagcgggacaaagcatcacaaaagggccgtcttctgctgacaaatgagtgacggacaaacgaacaaaatcaatgatcagacgcagaagaaatgaatattaattgaaaatgaccgagcataattcaaatcagtgatcaaatgtattttatgaagaaaatttttgtttcaaaagttggctaaatatggtgttaaaaattattttagaggaaaaaaacaagacgcagctaatactcatttttagcgaaaaatcaaattgaaaagcgaaattttcgctttttgcttatttttgacataaatttatcaattttaataaaatttaaatttattcaattttacgagaaaattttttttgtgccatcaaaaatattttggtgggcaatttaatattttttattcttcggccttattgaattttcgttgcacttttttcaaaacattttttgatgggttaaggactagcggtgccaaaacgccagttttaccaagaatgtttttaatttggtcgaccttaacaaaagttatgacatttttttgtcgaaaacagtacgagttggagcagtacgagttggagcagtacgagttggagcagtacgagtggagcag

SEQ ID NO: 27376 - DNA, 1136 bp, Heterodera glycines
attaaggtactatacatccacatttatgtgcacccaaattttggaactgtctcgccctcgggtgggacttaaaagaaggtggaggcaaatgtttgaaattttcaattcaaaattttcgttcgttttcgaatcgcggaatcgtgcgggtttaaaatttaaaagctgaaaagtttctatgatttttaacaaaaaaatccatttgtttttttttcattttttagaccctgaaataatgcatgaaaaggggcgggttagacgacgacggaattccttacaaagggacgcaccccatctaatttttgcaattttcagttccattagagcccaaaatcccctacctaaattgactagtgatagtccaattaaggtactattacatccacatttatgtggcacccaaattttggaactgactcccctcgggtgggacttaaaagaaggtggaggcaaatgtttgaaattttcaagtcaaaattttcgttcgttttcgaatcgcggaatcgtgcgggtttaaaatttaaaagctgaaaagtttctatgatttttaacaaaaaaatcatttgtttttttttcattttttagaccctgaaatagtgcatgaaaaggggcgggttagacgacgagggaattccttacaaagggacgcaccccatctaatttttgcaattttcagttccattagagcccaaaatcccccacctaaattgactagtgatagtccaattaaggtactattacatccacatttatgtggcacccaaattttggaactgactcgccctcgggtgggacttaaaagaaggtggaggcaaatgtttgaaattttcaagtcaaaattttcgttcgttttcgaatcgcggaatcgtgcgggtttaaaatttaaaagctgaaaagtttctatgatttttaacaaaaaaatcattttttttttttcattttttagaccctgaaataatgcatgaaaaggggcgggttagacgacgacggaattccttacaaagggacgcaccccatctaatttttgcaattttcagttccattagagcccaaaatcccccacctaaattgactagtgatagtcccattaaggtactattacatcccacattatgtggcacccaaattttggactgtct

SEQ ID NO: 27377 - DNA, 1272 bp, Heterodera glycines
cggaagacaagattcatttaaaataaaaaaaggcttattttgcgttcgcaaaattatcgactaattaataattatataatgaaatcaaaaaaacattaaaataaaatctaagtgaagaattttaatcacaataatactaaaaaatacaattacataataataaaaattttttaataattataccataagttcatttaaattgtgatcctttattaaataattggtcttgtctttatatttatttactttaatttaataaattttaatatcggtgattgttaaaaatgctataaaaacaaaacatatataaattccttggtcagtaaaggaaatggagtgaatttatttattttttctataattttttagattatttttaaagcgatatatattatggtattccatgaataaaattatacataaaaatttaaaaaagataaattttttcatggatttcaaatacactatttaatctaaatttattttattaatttagtaaatttatttttaatgaataattatttaaataaattaaatttgttttaagtgaatcttttttaatgtcatattctcatgatccatgggctcgctggcggcgcgcggcgcttatcataaatgcattttttatttcttaaattcttgataattaaatgcaaatccataaatttgctttgtttaatgccttctaaaagtttaaaaattcgtattttaacttttatgtttttttattctttagcgaaaatgataaattaaatttttattctatatttttatgtattggtgtattaatttcgaaatataaaattttattaggtaatagtatgtaaggtcggtgatattttcatatgtattaataggtaaagtaattgaaatgtaaattatttttattttgaaaaattacaattataaagtgcagtcattattttttactaatatgatatgagtttcattttagcttattaaattttattttaatagaatatataatttaataaccacattaaatatattaaaacacttcaggaaaaaggaaaagttaaacaaattttcttcattttttaaaaaattaaaaattaaaatagggtttacattctgttttattatgtttgtattctgttttgttatgtttgtctgctgtattctactgcattctgctgtattcagctgtattcagctgtattctgctgtattcagctgtattcattttttggcaatcaaattcttggcaaaatgtccccaaaaatgtacagttttttcacttttttgcatttt

SEQ ID NO: 27378 - DNA, 1414 bp, Heterodera glycines
  misc_feature (109)..(109): n is a, c, g, or t
tagcaaaaggggcagattgcgggacgcaatgaaatgctttgtcctgtaaattcaattacgttcaatgaaaaaaatagaaaattataccaaaaggggacacaaaataatntagtcgtaaagaaaaacgaaattatcaccattaaattggaattctgacttacggaatttcattttgttaacaatacgtaaaaggaacttccaaaaaaaatcttagaagattttttcaagaaaattgagagaaaatttttttaaaaaatttcaaaaatttcggtgatttattggaaaattctgatttttttccaaaaattctctaagtttgacaatttatttttaacgttgtgcaccccacctgttcaggatggacacgacgtccttcaccagtgggtaatttgggtctccttcccattgctttttgtgtccgtccactttctccgccctttcttcctctccatggccatctttctccccttccgtctcctccaaattggcatatttctcgttcgttttgctcaaattcgtaaccaatggcttcaaattaggaaaccattcgttaagtgcgcttaaataagcgcgaagtgctttggccaaaatgataattcgcttctgatcactccggtcgagccaaagcaaaagttcggcgacaacacttcgaatttgggggagaataatttggagagaaaaacaccgcgagaccaattcagcgaaaatgagcggaaatcgaggacaaacttgaaaagggagtagcatttatgaaattgtgaagaaacttgagacattaaccggaaaagtcgcgagaatccatggaaagtttgaagacaatttgttcggcatggcattggagtaacagacaaacgttcggatgaccatttaactaaaatttacaacaaagcgatgaactcaaattccgagtttttgaaaattgaacttcagcgaaaagagaaagtgcggattcggcagcatttttgacacaaaagttagaggacgaacaccacttgagaagctcgtaaacaacgtcaatgtgaagctgtgaaacagatttattgggaaaaaagaaatggaaaggcaaactcgagaggaaaacggatgaaaaggaagagaacggaaagtggaaagacagtgcaaaagcaatctgaaacatgacacaaggacaactgcaacaaaaaacagacccgtaatttctgcccgaagctgaaatttaaaaaataggtaatactggagaaaactttttggcgcgaagagcacaaataatttaatttgaattcgcccctccaaaattttttgaaagaaacacatggatggtttaaaagataggtattttgaatgatttacctgttttttaaaaaattattttttccttaggaaataagaacactttttttttgagatttgttttgaaaaatccaaaattctattg

SEQ ID NO: 27379 - DNA, 1304 bp, Heterodera glycines
gaaaaaatcaggacaatttgaattctaatggactgtaaaaataatttaaatatttaattttttatcatagggatggaaaaaatatgtacaaaaaaatggccaaaacatatacataaatatctaaaaaaaattccaaaatatgtatgtcaaatatgtatataaaaaaagattagtttttttttttttttggaaaaattcatcgtaaatggtgaaataggcactaaatcccataaattgtctctcattccataagctgcatcatctacttcttacaaatttttgtttttccaatttctgagggttcgttcggagattttcaagaattcagaaatttgtttgtcactaaatgaagaattcttctcatttttcattttataataaattttcaattttcttgctttttctccattcgaatattgatttcctcctaaaaaataaaaataaaaaatttattaaatttaattaaccccattttatgccaaattcctttttccattttcggaatgttctttcgctaatgcccaattctttcccaaattgtttctgttttccatttactgctgacattcttttaaactcatcaattctttgaataaattcctttcttttcatttcataataattttggtcattttttatttttattcctaattcttttttccatttataaattttatttcgactaattcccaattttttcgcaatttttagctcaattctattccaaattttttgagaatatttcccccttttcttaattcctttttttattgcatgaaatttatgaacaatttcgcgtttttgttgatcatccaattggttgttgttcaaaacattgtttgaatcagcgaaatttaattcattgatcatttttattgttatttgaattttatccattttttcattttcccatccttggccaaatatttcatcaaaagttggccaaacttttgcattaaatccaaaagatttaactaacaaagtttcgtcgattggacttattatgaatgataatgacaatataaaaaataaattataaaattgcatttcttattttgtaaaatttttgtatatattatgaaaatggctgtcaaaaaagcttaggttttatcattggaaatgaataataatttggtaaaaatcattaaaccaatatatattttttttattatattcttacttttgaattaaaattgttttataaaatttattgtttaacgtattatttttggtcagatttttaatgacttcgccccaatgtccgatcacgcacaaaaggcataaaatgtaaaaaagggcacaaa

SEQ ID NO: 27380 - DNA, 940 bp, Heterodera glycines
cgagaattaaaaaatggagaaaattcccctgaaatatgtaggttgaagaaaaaatcatacattttccgaaaacacatacaattttccaaaggaaatcttgattcaaaatgaggcagatataattatacacatatattgtcttgaacattgcataaaaacagagtcgaaacttggacaaaagagaagcgaaatcaacatgaaataattgggctgaaattcaaaaaatttacaattattttttgaaccaagagtcacaatcagtctcaaacaacgaaaaaaataggtaatacggtagtttctcaaaagaatttaaatgtttcactttcataaaaattttcttgtgatcaatgatcacaaatccggcatctatttagagactaattccgaaccctggcccggattcgaaagttctaatttttcaaatttcgtatctatttttcgtctataaacaaacaaacgcacggaaacaaactacagaattaccccccaaaaaaaaattatagcgaatactatataattattttcattatttcccatcatcatcatcatcatgttcctcctccttttcatgttcatcctcagcaacatcgtgtttgttggcattcttttgcgcttggctttgtgtcgcttttgattgaccatcaccagcagcagcagcagcaccaccattattggcatttttgttaccgccgccgccaccgctgctcatcaacatctgcaggagacgtgccgccgcattggtcaccgtctgtgccgggcttggcgagcgcgacgtctgcgtgtgctggtcccgatgggtacgcgtgccgtacggttggaacagacggcgccggtgctccgcatgggccacccgtcgcagcagggtgcacaaccgttccacatagtcctggtgcttgtacatgtactcctttgaaaatgcggggagtgataagaaccaatg

SEQ ID NO: 27381 - DNA, 1346 bp, Heterodera glycines
ccctcccccccccccttactcattttaccattttgccgtttccggggcttttctccatttttggctttttgtttgggtcacattcttttgttcccgccggttttcagtgatttttactcttttttattaaaaaatcgaaattatccaaaaaaacaatttatatttaaatttgcttatttatcaatttttctcccactgaattttcaggctgcagggtggccggacacgtcttataaaaatgaattttacaattacaaataatgaataattaaaaatggaattgcagccatttgctcgcttttggtcctttttcaaaggcccgaaaaacggaaaattattcaaatttaaattattaaatgggaaattaggaaaattgatagagaagaaattcaaatgcaaattctcccaacccattaatgaagaagcagtttaaaacctcaaaataaatatgtgtcatttgcataaattacctttttgtggaaacagttggccatgggaatgaaaaaggcaacgaatattttggacatggaaatttctgattaattaaatgaggaaatgaagagaattcttcttgtaaaaatgtttaaatcaaaataacaaaaaatatataaaaaattaaacaatctaaaaatagttgaacattggaaaattctttcatttttaaatgccctaattaagtaatttgttcttttttgatgagagtattttttaaaatctttttcggggtaataacaaaagacgagcggcgaaaaaagaattatgaaacaaaaaaaaatcgtaatttgtacttatggcacacatgaacgatggactgaattgggttgggtcacgtcgagagtctcgacacttgaaaaacaattgaggaaggaaaagacagacttggaaaatgacaaagagagggaaaatttaatatttttgcaaattaaaaaatgaaaatactcaaagaatttaaacgatcgaaagaatgtaaaataatgaatcgtcaaaaagggagcatcgctttagaaaaacaaagcgaagaaacgcagaaaaaacaaaaccatgcgaacgaattattgagagattgctattgcgaagttcgttagcttaaaaagggctgaccttttacttccaggagcctataaaattgcgataagcactttagaaaatgagcaataaaatagagcataaattttttatttcagaatgcccctataaggtttgaaattcactccttataaatcagaaattcgcattctctgttaaaatttaagttctttttaaggggtgttactataattctagaaaaaggagcagtcacatgtctgatactgctgaagagttacgccctggccgaaaaacaaaga

SEQ ID NO: 27382 - DNA, 1411 bp, Heterodera glycines
  misc_feature (837)..(837): n is a, c, g, or t
  misc_feature (929)..(929): n is a, c, g, or t
agtattgtacaattaattttttgagattgtggtcattagtatggcgggcgcttatcgaaagggcaaaagtctgctgctgaacttctttttggactatttgtacaaaatgcaatacacacagaaaaatgtatgaacaaattaacagagtaattaactgggagtaatgcctaattaagaaattgaactctaattagaaaatgttaaaataattttttagcaagaattggagttggaagaatggataacggacgacgacatcgtcgaggtgacggacggactgacttaaaaaaagcggcgaataccattattaaaatttaaagggttttctgtataagtcgggccaaaagcgttgcacggcgggcatttggatttgggcagagcccattttgatagacacaccaaacggagaacgatacgccgttttgttggtcctcaattagcacccccaatttgtttggggtttaatccaaatttggcacacagatggacacccaagggtgttttgagcagccgagcggaggcaacgcgtgcggaggcaatgggaacggcactcagcacggctcggcattctcaggcaattgtccgacccatttttgatttttaaatttaaattttggcattttctgttgtataattcgccttttcatcatttaggctgctcccccacggcacccgctctgttggcactgtccacgatgctaagctctgtccaatgctacacaatggcggaaggcattccggatgaagcgttggcagtcctttcaagctttgttgactacggcaaattggctagcgcagaggcgaaggaatttggcaaaccgtatcaggcgagattgngggatgatactgtagaggagataaacccccctttactcgctttaatcccgtgactaatttggcatttaaaaaatacttttttgaaatctcantttagcgcttggccttcctcatccgcgattttaagctcaccgatgagatgatttacggcgtggaagggggaaatcgattattggtaaggacaattcagaagtgaaacattggcttcattaagcagggtgccaatctctcttaatgagaaaagagataaataaagtgcagccgccccaaaaataagataaattaatacgtaaaataatataaaaaacggaaaaaataaataaaattctgaattcaggagaaagttttgtcccctccggcggacggtgccactgaccgtaaaatttcggcaaatgggcgaaaaagtgtggcaaacagcgcgccgttggcggaagtgcgacggcacatcagacaatgttttaaggacggcatcagttgctatttgttgccacacccgggcccaaaagtggcggagcccaattcgggattcaggggacaagtgaaaggtgggggaaagacggaggggggggggggg

SEQ ID NO: 27383 - DNA, 689 bp, Heterodera glycines
tttccccggcggcgcctatcggcaccgccgcgcccccaaaactcctattttttcttataaaatggcccaaaatcgcaaaatttggtaatttgatgaaaaactgttctcagcggcgcgccaaaactcttatttctcattagaaaaatgataaaaatcacaaaatttgatcattttttggtgaaaatctgtcaacaaattttaatcaaattttcaaaaattttcccggcggcgcctaccggcgccgcctgccccctcttcccaaaaagtttttttggaaaaagcgcgcctcaaaaaagcgttttattgatttttaaatttggaataaaatttaaaaaaatgatttttgctttatgattttaactattaaaaagttgtagaaaaaatttcgcttttcgcatttcgcattttcgcatattttggcttttcgcatttcgctttttttttcatttcgcatttttcagtttcgcaaatttcgcttttcgcatttcgctttttatttttcaatttggcccatccctgctacatatattagatccgatacattcggtatgccttgatttgtgaagcgaaatgaatttgcaaatgcaaagaattttgaatttttgccgaaatgtttattattgtcataatgtttttgcttatttgaatagaattttctatgtttatggtttttcttttacgagtccgag

SEQ ID NO: 27384 - DNA, 1003 bp, Heterodera glycines
  misc_feature (910)..(910): n is a, c, g, or t
  misc_feature (939)..(939): n is a, c, g, or t
atttttgagaaaaaaaatagtttttagattttgacccatgatcaaaaaaaaggaaatgggaaagcaaaatgcgctaaaaagaattttctcaaagcttttgcattggatgcaaaaaatggacggattcattgaaagtaaaataaaagaaatttaaaaagcattaaaagtagttatggaccggtccataactattactaaaattgaacgcgtgaaaatcctttcttaaactttgaaaaatctttaaaaattaataaaattatcttagaattgaaatagaaaacaaacgaaccaaaaaaagtaaaagaaaaatgccaaaattggcgttaaagtgccataaaagagagaacaaacactttggtcatttgtctttttgcgctttttttattaattatcgcgggaaattaagaacaaattaaactttgtaaatcaatgccaataaattcgcaacaattcagtcatcttcgccaccaatttgtgcagcaattcatgccgatagagagaattattgccttgtaatgtccattcgccgttttacgttcgtccataaatcaatcagtccgaacggactgctcggattgatgacacacggacaaatgcatgtgcgaaagggggggggggagggaactcaaagtgatggagtgagtgagttgcaatcgaccggaggaggggggaagggttattaatcgcgcctgagagttgatgaaaattgatggaaagttatgtgaggatgaagcaataagggaaaagcggcaaagaaaaacaaacggagagaacgccggcagaggaaacgatgggggaaacgattggggcattatgaatgaatggatggatgtgtgggagggggaggagagcagtgtgatggatggcagagaacgggaaaacggaataatgactgaatttggcaatcctncaaattattggatttggtgatgattaccnttacttttggacacaaacaaaagggaggaaaaaggggggagagaaaggagaaaaaagctttgat

SEQ ID NO: 27385 - DNA, 853 bp, Heterodera glycines
atttttgaccgaatggtcaatttgtacaccgatcaaaaggcaccgattttttaaaatgctttttaaacgatcagtgaattaacgattagaagggaaaaggcaaagttcaaaacggacaaagtgaaaaagtgaacaataaaaagcgttgaccgcaaatataattctgaatgtaatagaagcgattgtttccctaaaagggagggagtgaagtggttctcgcccttctgatgacttttttattttttatgaattattattttgctgggggggggggaatcagctggggcaacccagcagagaaatgaactaatctctgaagagaaataaatggtcgaaggaataaagcggaaatggacaaaacgaaggcgaagcggaacagtgaaaagtttgaattcttgggaattttgaccgatttttaaaatttgtagcacaacacaaaaccgagaacttggccacagttggccaagttagacgaacccgaattgttttcgttcggctgaaagttggattcgctaggtcatgcaaatccctccgcgcccgccccatccatcagcggaattctttcccaaacattcacctccaaagctcctcccgcagtccaaacaaacactcttttggcccctcacaatcggcagaccccccccccccctttcggggtcatggattcgctgaagtggccatgaaaaagcaaactcaacaggttttggatgcttttgatttgtgtgctgctccgaatatggatagggtcgacggggggagtgaatgaaaggaaatggaagtgaaggggaaaggaaaagcattcggagcggatttggccatgagagagaggcggggggggggggggggggggggg

SEQ ID NO: 27386 - DNA, 995 bp, Heterodera glycines
  misc_feature (936)..(936): n is a, c, g, or t
gtctcaactgtaaccaaaacaattaacaagtgtcacacaaatttgtaagaggtttattattatttgagggaaataaaatgctttatttattaaataagaaaaaatagactgatcactaaaataatccttatttaatggcctaaatggtctgaaaccggaaaatttcaaaaaaaaaaatcctcagggctggaaaaaatttgtttttgggaaacattaaaagcccattagaaagagaacaaatttctcttcttaattgccttttggctgatgggtctacgacaaatacccgctgagttagtgagggtgtcaaaattgagtacagtaaaacgaccaatttttgatcatttcctcttgaaatacggtagaaattagtgatatttacaatcaacaaaattcaaccatctcttgctctgtgtatataagttgtagacctatcattcaaaaggcaatcggtagagaattttgtcctctttctgacaggcctactcaaattttccaaaaaaaatgttcccagccccctagaaattttttttaaatttttccgatattcaatgtacttcggggtttcccgttcgccatcaaagagtggtctgatcaagtaggtgtaaacgacatttttgatcagcatcaaaaatttagcattcagatttttttcacaaaaataatttgaattaaaaatcggaaaaacattttttttttggtcacgtgacctttaagcatttcattcatttccggccaataaattaaatatatttgttattaaaaatcggaaaatgcatttttttaggcttgcgtgacctctaaaatctttcaattcatttccgaccattaaattaaatgtgtatatgtataactgtttatttgcagtttattttttttcattttcaaatcgatttgttttataaatttgcattataaaatcacttttcctacttncataaattcattccaaaatgtttatatttttaaaaatatttttatttgcttccgttaat

SEQ ID NO: 27387 - DNA, 951 bp, Heterodera glycines
  misc_feature (921)..(921): n is a, c, g, or t
aatttggagcggcttgtttcttggccaatcttctttccttttatcgttgacaaaattgaaaatttctgtcaataagccacctctgccgaacaatgctttgcttgtttccattctttacctacacattaaaaaaaaaattaaattgctaaaaatgtttttaatattctaacaaataccaattgcctcatgaaatgatggcgctatttcattgagttttgctgtttctgttcgtcgctgttcttctaaatgatcaaattacaccataattagcattatacatttttttaaatttatttattatttcatatttaataatgttttgattttgctgaaaatagacattggcacatctttttaattgccgatttttgtgggttttccaaaatggaaaaatttacaaaattatgtttgggtttatataatgataaattaaaaaaaaacacgggtggcacaacccggaaacccaaacaatgaaattaaaaattttactcgcaattgtcatcggtcgagcatcgatgcttgatataattggtgggtcattagcaaaagaaggacgtcgaatggttggacttcgcacaaaggcagtgttgtcaaaatggttctatgtattaaaacaaaattttacaacttttgttttttttatcattttattatttaaaagtgacagtgatttttgggcgctggccttttggcgctgaattctttaagaaaattaatttttcatagtcagtcaaatacaactttttggttatcgacatggaattccgatttgcaaaaaaatggaagtctggattccgatttccgaaatttttgcaaaaattcggaaatttattttttttaattttttgccaattcaaaatggtttattattgtgaaataattattttgtatgtggctttctacttcgaccatccctgctcntataccgtatatgctctaattatagcccat

SEQ ID NO: 27388 - DNA, 1520 bp, Heterodera glycines
  misc_feature (1435)..(1435): n is a, c, g, or t
  misc_feature (1468)..(1468): n is a, c, g, or t
  misc_feature (1483)..(1483): n is a, c, g, or t
agcatcatgcctctcatcagtgaacaacttcgtcatccgttgccgaatttgtaaactcgaagcgttggagacagaggtgagtgaaaacactcaatttgtcacataaacaatcagttttttgtggtttcagactgaatcggctaactgtccggaagaagacggcgctggctccggttgcaactcccgcagtgtcacctgccaaatgacaaccaaagaaatcgcggaatcggatgacggtcgagtgttcaaagtcgacttgggaaatctcacacaagtgacgtcactgtgcacgaagtggaaggcgcatttcgtgagtttggcatttttacaggcgaatcatctatttctgctttgttgtttcagaccaatgttcgtcaagtgatggaatcaggcggaggcggagaaccgtgtgtgtctactcgtacttcggcggcgggcggtggtggttttccagtttggctgatcgttttgatcgtcgttatcgtgatttggtgagtgctgcctttcattgcttctttcaacctttctcatttttgtgtgttttcagtgttttgggtgctggtgcgggcatcgctgtgtttatggtccgtcgacgaagtgctgaagcagaaggaggagatgcacctgcggatccaatcgggactttcacatcgaaggcggacaaaactgatgaaatggacaacatcccagcgagcaaggatgacgacaccgctcctgccgccagcatgggggtaaaaagaagcggagaagtgatgataaaaatttatcactgcctttttagggaatgcaaatgagctacgccgccatgggagcgtcgacagcgcccgggaaatcgatggtatagagcgaaacggatgcattatgaagtgatgacacaacatatctacgatgacaaatattcgatatatttatatgcgtgctgataccattgtgatgtgtaaattgtcgatatattgtatttgaataaaagttcgaaaaacggatatatggaccaaaccaaattcgaatgatcctgtcactgacgaatcattgtctgcaatttattgacccaaaagaattttttacaccctcagtttaggtgccccgactcaaaaacccctgtaattatggactaaaattttgaaaaagaaaggtttccctctgggttttctgggcccaatctttaaacctgtgaaatggatttcagaattggttgaaatgatgtcaaaatcgtgatcagtgcttctaaaacctctgtgaacgaattttcactctatgacacaactttttttgtaaactaaagttttaatatattttctatttttcggggcatcaaacagcaagtgccaaaaactcactcatgattcaaaaacttatggcataaaagtgggaaaaagtgaagtttagagtccggtaaaaaaaaatttccgggagcgggatcgggagttcaaaattntccgggacgggagtcccgaacgggattcccgtnaaaaatccgctcccngttaaatccgtccatttttaacgggagtcccgggcgg

SEQ ID NO: 27389 - DNA, 1443 bp, Heterodera glycines
acgggaaacaaaatatgtgaacacggaaatggttgaccggctcgaaaaagtcgcgaaatggacgattccccccgactcgtaattctcgaaaccgcccaccctttcccccccccccctcgcattggttgactgacttctctgttcgagttgagcagctgatgcgtcttcgattgggcctccagcctcgcggtcgtttccgtgttcagctgatccctgagcagttggacctgccgcgaaaatgcggtggaattttagcagtaattggcccattaattgtccgattggtgtgttaattgacccaattgatcagtcagtcagtcacactgtctgcccaatctttctttctttactcacttggcatgccgccacttgtgccgattgttgcgcctgctccaactgagaacggatcatcgcccgctgcgcattctgtcaagaagcataaccaggtcaaatgaattggtttggacaagcgttcgaattacatcgcaacttgacggggattggagctgatccgtggaagattggggactggccaaagaggcggcgaagggcggcaattggagggtggcgtaaggactgatcagcaggggcgaggacagagacatggcggtgggagagggaacgaactgcacaaagggggaaagcgagaggggtaattaagggggatttaagagggattaagggttatcaaagggcccatgggacggacggacggacactgaccgaatagaggggatttccgttggcatccaccgactgcacaaattgggcaggcaaaggcggaggggccacggaaggcgtggcgacggaatgcggctgatgggcggaaaaattccaaagtgttgttgcggtggcagaggaagaaaacggaattgctaagggaggctggctaaaattggcaaagaattaaaaaaacacacgaatttggtattctccgcccgacgaaaagcgagagtctcgactcgaaaagcccaatttttacatcagtcaaaatgccataagtcttacaaatgctttggcccctcccgtgtcgagagtctcgacttttgccgttcagtttgtccttctcactttggcatcatcgtcagttgagaggcgatgggctgttgttgctgcatatggtaagccgccgctgctgctggtggattagcggaagtgcctgcgcttgccgggaaggcggtgggccgttgctgcgactgatcgatgcccacgggggcggcgacggagggaatgttcgcggaagacacaacgagggatgctttgtgatggaaaggagcggcggaggaggaggacggacccggctttggctgatgatggtcatgggtatctgaagaggggaggggtggcactcaaaccatggcatttccaattcaaatttttaattttcatcaacgacatctacaaagcgacaacccggttttcctttcaaaaattctgaaaata

SEQ ID NO: 27390 - DNA, 2049 bp, Heterodera glycines
  misc_feature (9)..(9): n is a, c, g, or t
  misc_feature (23)..(23): n is a, c, g, or t
  misc_feature (77)..(77): n is a, c, g, or t
ttcaaaatntagccgttttgatntaatctgttcttcaatcattggtcattcccatcaatcattctcaactttacatntactcgtttaaacaaaattgcccaaatcgaagtaaaattcatttaaatccccttaaaattccattggggatgaactgaggtgggggggggctgattaaaaaagaaggaaatcacgcgatttaccggggagttgtgaagaaattggaggggatggggcaaatgcatgacgaatgaatggacaaattcgtcggacaaaaattatgatttatttttattttagctcaaagttatttatttgaaaaatcgtttaataaatcaattaaatttttcaaaatcaaggcaaaaaatataataatttgctatattttttgatcgaagaaattgcaaaaatatttggttttttgcaaaatgttcttatttttgaaatttttcgaccagacgccttcgcttaaagcaaccaaatttcattacaattgacagttaaaaaatttaaatttttaaaaatttataatatttagtgtttttgacttaaatggaaaggaaatcgcaactcaccgttttgccaatattttcagtgtgatgtgtgtggaaatttcacggaacaaattgctgaccaattcctccgggttgtcagtgattgtctcgaagttgatcggcttccaattgttgatttggatcagacctgaaaaaatcaaatctcttttcaaattgcaatttgattttttttcagtttaattctaacgataatattgtttcaaaatttctatatcttaaaaactacaaatttactgttgtcagtgaacttttttttaattactccctacaaagaattattttaccttttttatttatagttttggcccaattcactccaatgtctttaaaatattcgaattcctttttttttcatttttccccgcgcaaatttctcttttctgtccattttcggcggaggtgcgcgggtgatccaacgagaaattctacaccacaatctgccccagtagatctgtctcaatccaagccggacgaccctttctttgctaataaatatgcaaattcggagggggggaggggaaaggagtcattgcacacgctgagaaaggatggaccactagaggttccaaagccaagtaacaatatgaatgatggattagataaattaatttatttgagtgcccgtgaaaatttctgttttaaattttcacacggatagagaaaatagatagattatggattatatttgcattaaatatgtaaagtctcttccatttgattcgacttccatatctctttgtgccgagtattggcgacccacttctgcgccctctgcgataatagttgtttaattatagctagtgtcataacaaactcacagacatccatatgctgaattatgatgtgtgcccttcgaattgcccgtccaaaaaaagcctttcttaattttacccttttcttcatttgtcatgccatttttggccacaagacaaaccatcgttagcatatttcaatgtttcacatatcaaaacatcccattttcggctcaaatacaccaaaaatgtgactgacaaatgacttaaactaatgacgcaatttgctgattgactctaatgacctccccccccccttcatgtttcttctcttcctccgctgtgatccgctgttccctcacaaattttttcttctcgacggtttgcctagtcgttgacaatccccgcaaaataacacgggggatcggggaggagggctcttccccataaacctgttgctccccccccccctaatttgggcggggggggggggggagacgaacaccgccgccgggcgaaagcgaacacgacgaaaaagaggggaaagggaggggggggggggaagaagataaaatataaattcttcttaaaataaaaataaataaaaaaaacaaagcaaaaaatgatttaaaaaaaaattcaaaaaaaagattaataaaaaaaataattaaaagagaaaaataaacgatgatcccctgctctgctttctctgccggtgctctgtc

SEQ ID NO: 27391 - DNA, 1372 bp, Heterodera glycines
  misc_feature (26)..(26): n is a, c, g, or t
  misc_feature (32)..(32): n is a, c, g, or t
  misc_feature (41)..(41): n is a, c, g, or t
  misc_feature (51)..(51): n is a, c, g, or t
cattagggaattataaaaaaaaattngaaatntaatttttntaagtaatgnccaagtgtttgctgctgttttttgcctatttgcctccagcttggtctattggacatggcaattattttggacatcatgaggggttgggcgtgggcttggcacataattatgtcagcaaatatggcattccgatgaatttgaggtgcttctccattaaaaatttaatatttttttgtgtcttattctcggcatttttttaaatttaagtgaaagacattgctaaaaaattacaacaattacattttaaaagttcgaaaaaatttttatacattagaaatatttataggcacattaaaatgaaatatttttgaaaaacggcggtgggcaagcaaacattcaaacaatatattttcacctattcaagtgacgaacaattggatgaactcaaatggcgccccaaacggcacaccaaattggatggcacccaaatgatcaattcttcagggcagcaaaattgctcagatgagaattttattttgtccacattgttgagggattacgacaaatttcgcatccctggcggcggaaatgtgcgcgtggaggtggaggtaattaagagttaattaaaatttttaaaataaacaagtgtttattttggaaagcttagattgaatgaaattttgaaattttattttaaacatattctgttttacagtgcagattattatttggggttgaccgagaatcgggattttttaaaaataatatatcatttaaatatttttaaataaagaattatttaataattttttaattgcgtcaaattttcgccagatttgggtccaggaagtgtccaaaatcattgagatcaccagcgaatttgaactggacatttatgtcactgaaatgtggacagatccttttcttgcatttgcccatttgaatccgtgcaaaaagttttaaatttttatccgattttcaatttaaattcatttttagaaatatttctgtagacggtccgcgagtgttgccacaaatttggaacccattaggatgttttgtgaacagtaaggtggctttcataataaaaaaacaataaatataagtaatttttggatttattaaccttaaggatgcttttgttcacaaaagtccgttcggcaacatttttttgcaattgtaaatttttatttttttgggggtggggtctatgagacgttactgtaaagaggagggggggggggggggtcgtctgtatttaatttatcatataaaacaataaaattgaatttccatttcaagaattaatgaatttcgaaaatggtaatgattcatgaacagggttctttttaggtttttgcctatttttatggctaattta

SEQ ID NO: 27392 - DNA, 53 bp, Heterodera glycines
ccctgggtactgatggattacaccaccggacagatcctcaccgcgggtaatga

SEQ ID NO: 27393 - DNA, 753 bp, Heterodera glycines
gatcattgttgatgatcaaaaatacgagctttttaactctgaagtccgttgcaattcattcccttttttaatttttttttttttttaaatttttaattttgtttttttccattaaagttttctccggtggacaaaatgcaactgttggaaatcattgtttccgaaaagacgtccaaggaggcactcgccgtggccgccaaactcggcctggaccagaagaagctgattgtcgtggtcaaggtgagcgttgcgttcttttaactagaaattttatggtaaatacagtgagtacaggggatagcacggattccgacttccgacattttggggtcgtaatccgattccgaaaattttttgggcctcgggttatttaatcatttacaatttagcctattaaaaattttagaaaaaaattatcttaaatttgcgaattttccgttatccgaaaatatttgagatctcaaagttccgtttacggcttccgcaaaattttgttctcggaatgccacccctggtacgtattttctacatggtcggtgaccacgaatacggcattcaaccggacaattccattccctgaacacaaatttgaacgggaatgaatattctcttttttcactaatggtttaaaattggaaaaaagaagggggggcgaagggtatcaacggaaaattcatttttttacaactttgaaatttaatttattttccattttcccaggatggccctggctttttcgttgtccgctgcctt

SEQ ID NO: 27394 - DNA, 1442 bp, Heterodera glycines
  misc_feature (1387)..(1387): n is a, c, g, or t
tttgagccaacagtcggcggagatgaaactgaaaaaaaggaaaacaaaatttaaaaattgaaattggcattttaattttacattgcttgtgccatctcttcctccgcttcatttccattgtctgacattttattgaagcaaattaaataagtaagacagatttagacggatttaaattatctagcaaaactgacaaattatgtgaaatctgcaattcgtctataaaaattccaatttaaaaaactttgtttacatgaaacaaagaaaaagaagaatattttcgatcgtaaattgcgccattctttcgtaaattttgatcattgctacaaaaaaaaaacattttgccaattttattagaatttgagccggctcaaatctctctcaaatggcattgtttcaactgatatatttcaggataaattaaaaaaaaataataatggagattttaagttattttgcccggcgacgttttgtccaaatatttgtctaacgatcccctaagaaatttcggggaattttttgaaagcacaaagcataaagaagctaaaaaatatacaaaatctcagaaaagtcaaactattttaattttcatttgtcgacaaatgatttcattttaaaatttgataaaaaggtaggaggtgtacgggttcactgcgtttgggcgctagctcgtttttacaccatagctttttttcggcatccaaatccaacaatcttggtatcattcgacgaaagctcttaacatgcctctattagctgtacaaaaaacgagcctggaaaaaatttatgaagaaaaaacttcaaaaatttcgacttttttgcaatttcatgttataattttttggtaaatgtctaatcgcgaaacaatagcttagaaaaagcttctaaacatgttaatctttcgaaatgatatcaaaaatgatggatttggatgacattgaaaaaagttatagaaagttgtagtggaaaaacattctggcgcccaaacgagtgggtcccgaggtgtacatcaatcatattatattaaatacttagttacaaaaactttatttattttttttgggaaatttttattttttttcggtagtgcttttaaaaataagcaaagtgatcattccaacaaaaaaagaaaacattttatgagcacggcaaaaatcatttttaaattccttaattcaaaccgatcgtccatttcttaacttccattcacttaagccgagcaatccgttgagaagcctaaaaataaacagaaaaataaatttgaatttttgaataagcattcaatcattcattcactgacccgtccccgattttgtcagaaccagttatgttaatgcgcatttgattgcactgatcacgaatatgccagccaagcgcctccttttcncatttcgcccatttgtccgcgtcacgcacaattggacaacggatcagcagaaaac

SEQ ID NO: 27395 - DNA, 1539 bp, Heterodera glycines
  misc_feature (1527)..(1527): n is a, c, g, or t
gggtggtcaaaaaaggggttcaagaattcccccccttattcttctcacaatcgttatatggtataatggcaagaataatttctacaagaaaatttaaaaatgaaaaaaagcaaatctaaaaaaaattaaatgataaaacatttcattttttaatttttaagaaaaattattaatgtcaataatctcccaaacggaatgaccctctgtgaattatcaaaacatgtaaagtttttacaattattcatttaaaatatttacgctaaccaaaaatctaaaacatttaatatggtaagaatatttaaaaataatcataaagagtcgcatgtgtgttttgaagctttgatcgataagaagcatgagcaataattggatatgatgaataaatgaaattttatgaaagacaaataaaaaacaaactaaaagataatgtcaataaaatacataattaatttaatttggcataaaaatgtcaaattaaaatttaaaaatttgtatatggtttttaataagaaattttagaaaaacttttgtaatgacaatgctaattttaatgaacgccgaaaaatagtttgaagcgctcaaactaattccaactggtcattatatcctaaaaaggatgctctttgaatgattagaaatattatttaatcataactgatctatcattagaaatgcttttaaaagtctcaacaaccgaagagaaaaataaaataatgtgaattattaaaaataatttatcaaattaaaattggaaatttcttgagtgaagagaaaagatgaagacgagagcatttagcatgtttactgagtacaaaagttatagcatccatcaattatcaaggcatttcttttaacaaaggtgaaaaaataaaataatattaatcaacgaaaattaatgcaaaaatatttattcaattaagtatacagatggaaaagactgcagttgttactcgagattaaaagaattaaatgatgaaaaaataaattaaaatcattaatatgtaaaatgaaaaaacacccaaaaataaaatttgcttcagaatatttttaaaagttattaataaatactcgtgttgtatgttttgttaaataagaaattcaactgaaatagtgacggatagttacataattttcagcaaaaaattcagcaaaaataatttttcattgtttgcgagatacatttagtttctgatattttttaccaaatattgatatttttaaatcaaaaattttttttggaaaaaaattttaagaatgaatttttgagaaaatctttctattcttatggtgtatattagagtagagcgggaccgggaccaaaacacggacaactgagttcaactgagtaccgaggtcccggttttgaccgggaccgggaccagtcccgggttttttcccggttttcccagccaaaattcccggtttttcaacccgaaaaagtcccagtcccggttaagcccaaaattcccggtcccgctctactctagtgtatatgtacagagaatgtggtgagccgaagtgaccaanaagtatgggtgt

SEQ ID NO: 27396 - DNA, 1651 bp, Heterodera glycines
ttgtcattttatttcgattgttttgtaaattttactgtttttaaatgtaaataaaaaatattttgaaaatattaagaattcgtttttgcgtcccttttctcttctctgtgtttgcttttttgtgccatcatttctgcaattttgttctcaatctccgccattgtcctatttttagtttcgggcagtgcgccgtacaaataaattccaatcgctgccaatggcggcagaaaaaacagtgcgtaagcctttggagcaaatggatttaattcatgactgttcaaagaaatgttcaatgcttaccggcccatcaccgcttttgttacgcactgggagataagcagacaaaacaatagaccgactaaaaagggaatccattaatagtgagactttgcatttaaaaaaaatttatttatagtatcccattaaggggggagggggggtttcaagttggtttattaaatgttttggcgagggccaaagtttcccgagttaaacagttcgtgcttttttgttcataagtcaaattttttttcgctttttgtgtctgtgtctcggctcctcccggagtcaattaacattctcgagttccggaaatgaagactctcgaacagagctctacaaagaatcccgggcaatccttgcgattttatatatccaattaaaaactgttcaaccggggttgctttcttcacctgattgcctcgaccattttggaccatccctgcaccgaagaacgggcattttgagcgacgatttcgttggccacaaaaaaactcagcgggaaaacgccacagcacatagcggaggaatggagcacaacaaccaaaaccaaagcaatgttcacgaaaagtgactgaattggatacaaaaaaaaaaaaaatgaaaaatgctataaatacgccgtttcgattttgcccgattttaatatgtacattcatttcaatggtttgttaggtcgtttcgttaaatccgccattttaacgttttttcgacaaaacatagcataactttgcttaaagcaatcacattttacattcttggtattagagaccggacaagagggtcggtttcggttaaaaaccgaccggtccgatctctacttggtatcattcgatagccaagtttttttttctatgtattaatgcatgcaaaattaaaaaaatttggtcaattttaaactttttatatcggaacgtcgcaaatcgaaagggggtgccgccacccataaaaatgtttccatttatttaaattgaacaattaatttttcgaatcaaatgacctggccgtgtaggtacaaaattagcgaaatgaccaaatttgcaaataataataaggaaattgagatgaacagcaaggggcgtctgccaatccgatcgaccaaaagcgaagcaaaaattatggaaaacttaaaaaatgtaaatttaataattaaattaaatataaaatgcttaccaagccaaagatttgaatgccaatgtaaacaaaggaagagggcaaagcggagaagttcattgtctgctgtaacacttccacaatgtaagcatcgatcactaattgaaggcaataaaagaaattaaaaaattgaccaataaatgccctccgatgatcctaaagatgccatgcaaatgcttaggaaaatgccaatccaaag

SEQ ID NO: 27397 - DNA, 1832 bp, Heterodera glycines
tttaattgcccaaattaacgaatcggaataattaagtccaactaaattgccaatcgaatgctttttcactttatttctgacgcttggtaagaggggaccaatcaaaggcaggggaagcacatttttccaattgttgtgtggtttatgcgaagtgaaggaaaaaaagtgatcgacaagggggagtccatccggcggatatgtgaaacgggaaaaatgagaaaattttatcgccgtgggaaatctcgaggatcggccgattcaatgattgtggtgcatgggaaaatgtgtagggagagtgaccaagtattgtggcaatggggtgggagcaagggggacacggacacagaccaaattagggaaattgttcgcagttcgcgacaaaaaaatataatcattcaatcgcctcctctcacctctttccagccttgaaaacttttgtcgatcagcacttgttttgaatgagcaagtgcttggcgtgcaattgccataagttcgtcacgcgtctcggcaaaaccggaaccaagtccaccgagggcgtacgcggcacggaccaacacgggatagccaatctgttggaaaaaatgaggacatataaaaaaatgggatgggattaaaaaaaacaatgacaggaaattagatttttttcaaagatttttttcctattataaaaactaaaattttcttaacattttttatacgatttttaaacccccatcaatttcgttattttttaagaattttcaaaaaaatttttatatttaaaagaatttttcttcggtttttaatttctttgcttacaaacaaatagaaaatttttttagaaaatttatttatttttttctttcgaaaatatttctcgagggagggggatgaatttgtttttggttcctcgcctgttcagctgccttttcagcctcctcaattgtgttcgctgcacgacaatcggctactttttcgccaattttcagcacaaattccttaaaaaaacaaaatttttaaaaatggttttatattttttaattttaatttttcaaaagtcttttggacatgccttgaacaattctctgtcctccgtgcgcataatcgtctcaatcgacgtgccgagaacagtgacacctcaagaaaaaaaattaataaaataaaaaaaaagattttggcacccaaaatttttttttttggaacatttaatatgaaatatggtaatgaattgccaatatggggattactatgacgaaatatttgaatactgtaaagccaattaattgtaaaagtaccgtattccgacagtacgccactgttgtgcaaatcgacggcacagttcagcgccgtttggcctccaaaagtgcacaaaattccggtgggacgttcctttttgatcacctacaattcaatcaaatttcaaaggatgggcccatttgtcctgtccgatacttcggtcacatattccttgatgatgggcaagaaatagacacggtccgcaaaacctttcgttgtttgcacagtggcaacatttgggttgaccaaaacggtgcgcaggcccatctccttcagcgctttgatggcctaaaaacagaggggaatttttaaattgccggatccagaccacaaaatcaaggagttcaatagaaaggaaccaaaagccttcggtacaaatttttaaaatttcaaaaaaaaattattcgacccaactgatttggaagcgtaaaaaatcgtaaacttttagcaagtgacagagttccatgatttcggattttaggggtggttaggtaatacatcacttaaaaacaataaagggtctacggcttatttaaagtaggtttccccaacttggg

SEQ ID NO: 27398 - DNA, 1044 bp, Heterodera glycines
aaaatttttctaagatttttttcttgaaaaaattctaattttgaaaaatttttaaaaaatttctagcggcgtgattttgtctgtttccatatatttttgaaattaaggaaataaaatttataaaaaggaaacgacaatatttaaatattaaaacggacaacaaatcaatgcttgaacgagaatattggaatttaaatagttgttttttaggactatgccgttgttgaatttaattaaccaatttaatcatcgtaggaattctcagaacatcaaaaaaacagacagccaaaattgattaattgactgacctgtcattgtgctgctctgtccggccgccattatgccaacgccccacacgtatagcgcgaacatgccgaactgacagccgaggaaaatgccgcccttgtaaatgtccgcctccaccaggtccgtgttgttcgggaacagttgcctgtcgggcaccagcggctgattctcgcaagttttgaactgtttgggaaatttcaatccatttgaggaagagagtaagtaaaaagtggcttaatttcatccaaaatatgaaatctggcattttattgttcgattcccatttttatggcttctctttcttccataagttatttgataatttttaaatttaaagccatttaaaataattacttaaaacggaccaaaaatcaaaaaattaacaatttttaaagaaattccattaaatttggcgttagcaagaatgagatttaaaaagtaactttcagaagaagtaattttttctttaaaaaataaaaataattttctaaagaattaaaaataaacaaaaaaataaaattccctgtggttagattttgagaaatataaaatttgtggtacaattaatttttatttaatttattgatacaataattgcgcacaatgtcagcgttcgttttgccgaacagtccgtgcgcaaacaccgcaaccacaaacaaattgatgaagaagctgcagcataacgcaattgcgcactcaacaaagtagtaaaagttggcctcgaccactgcaaaaagc

SEQ ID NO: 27399 - DNA, 965 bp, Heterodera glycines
  misc_feature (934)..(934): n is a, c, g, or t
aaaaatcgcatcccaaagaatttatcgaattgtcgattcggatttatttcacttttcattaccgtattctttcctcttttttcgtattgtatttattctacgatgggttttgcctttgttcttttgctttcactttctctatcattcgttttctgacttttttaaatttttgatgataaattctttgcaatggaactgaatttcgttttggctacatttaaatattacaagcgaataacccgtcacaattcaaaaaaaacaatttaatttcccatcgaattttcgccatttagaaacaaaaaaaacgctttgaaattttttagaaattcaaaaaattaatggcagaagaaattatgaaattttttatagcttttcgcatttcatagagattttattagcaattaaacagctcaaacgcaactggacccacgaaattgtttttattggctcccggatatgtgtcaatgaaaaatgcgtcagtctacagtagttataaaataaagtactgtatcattcgtgctgattgtgagacgaaccgcaaaaagtctcggtggagcgaaccgcaaaaaatgatcagtgtcaataaaaataattattctgaccacttagtaaaaaattatgtggaatctaagtttcaataataagccttaagaaataaacatattaaaaaatatataaaaatttggaaaatttattattaatcactctttttgagaatataagcaagcaccaacagattgccttattacgccttattaacatgtaaataaatttggtgctccgagcacttctctcaggggtgtgacttgtctcagaaaagacgagagcgagagtttggcgagaggcgagagttcccaaaaagacgagagcgagagtttttcaatttttctgtagccgtattttttacttcaaaaacttcaaaatcgtatattanattagggttacgggtcccgggtattggggca

SEQ ID NO: 27400 - DNA, 1718 bp, Heterodera glycines
tgctgttgggtcagatggggctgctaaatttccataactttttgtttttaaatttcgatctaaaatttattaatttttatttccactcacagctcttcgaacaccgctgaattggccattgttgaactttggcctcttctgctggttgaaattgttgttgccaaagttttgcggaggcggtggcggcaaattattgttggactaattagcagaattgtttttaattatttgcatttttgtttcctaattgttttttggtgccaacctgctggtgctgtactcccgccacttgtcctcctccgttttgaaatgctgcttcaatgtcttcgccgcttttcaaatttgggtgatgaagcatgtgtggcaactgttcctgtacaaagcccttacaggcaagcaaattaaacttttgagctatttatttattttttaatttacgggatttattggccctccaaatggcaatggtgcattaagcgctcctccttggccgccaaaattttgtgcttcagttaaaactgcaagcagaacaggaagagcgacgacaaagaaggcagacattgtcaagaataatttgtttttttcttttaatgaaggaaaattttaaaattaaaaatcaaaagataattaataaataaattataaaattatatatagcctattaacttcctagacacgatttaattaacttttcagtattacaactttcataatgacaaaaataataaaagatttttctgtttatctaatgactataaattttgaaagtaaatttttatttaattggaatatttaataaatttattaatgaaaggaatgatttctgatcagaatctaggtagcttttatatggaattgttgaattggaatatccagtttttgtttgtgcttttccactatcgtggcgccgctgtgcgtgcagctgaacacaattttcggatgaagcacaacttaacccgtcttcagctgctgttcaacagtggacacataatgtcatcgaatataacctgattgtttagcccaatttttggggttaattaatttggctcaattggctaattgttggaatttgatgactttcttaatggctgttgaagcggcggacggacaaatgatttattttttcatgacaagttttccattaacaaaaggattaaccaactgatcagcagaaactgatcaattttgcctaattaaataagggaaaaagttggacaataaagtgaagagatctgttaaccagtttaattagaacaatttatgaaagagcattttagccacgatttttttgacttctagttttttattgcaacacagaaaagcggattgtaaaaaattcaaattttactaaacgattgtcccccagaacgcctaatcgggaacgaaatgccggccctcattttaaatgattggcaaaatactgctataattttttctttatttaaccgttttttaataaactaaattaattttaaaaatttgtctaaaatttatgggcaaatttagaaattatagttttggtaattttcaaaacagaatcaaaaatattcagtggatgggcaatttttgcattatttcgaacgaatatttgaggctgctggttgtgagtctttactcaaaaaccatcaaaatgaaaattattcataactagggactggaattttagggacgaaaatttttcaaataggcacctaaaataggcacgaaaaatgagaaaa

SEQ ID NO: 27401 - DNA, 986 bp, Heterodera glycines
taaaaaacgggcgcgaagcgcccgtctgaggccgcgaagcggccttaatagcccaacaaatttagaaacgggcgcgaagcgcccgtccgaggccaacaaaaattgaaaaaccggcgcgaagcgcccgactgaggccgcgaagcggcctaacaagctaaaaaacgggcgcgaagcgcccgtctgaggccgcgaagcggccttaatagcccaacaaatttagaaacgggcgcaaagcgcccgttcgaggacgcgaagggcgcgaagagcccatcttgagcctcgatgtggactaaaaacccataataattttttaaaaattcaaaaaaaaatctccaaccaattcgatcaatttgaatcgcttcacagtctaggtagcgaagctcccaaagcgcgaagcgcttttgcccagctaaatagccgacggttcacgcacccgctagttaatatatacgttatattgacaaggagtttcgttgctaaaaccattttctcccggccgaaggccgggagcgccctgaaagtagtggaagggtcttacaactttttgaggagcatccgggaaaactatagagaaaaattcagcgcggacgactgagtcccggggaccgatttttcactttttcttgcagtttagggcccctaactttttttctaaaacccgaatcaaaaagtgcccgctgtgagggcactccccacaactgtcctctacatgctggtattttttatttttttattagagccaccccctggcctgcacgcttggctaactgaagtgtgctcaaaaagtacacttcagtaccaggcgaataactcgccaggggttgctttgaccgaaaaattgtttctgagcaaaaatgtgtagtatttgaaaggctatcaaaccaagttttaaaatttcgaaaattttcaaaatttttcgagttaggcctaaaaaacggttttcgggtttttgaattttaggattttttaacgatttttcccagaga

SEQ ID NO: 27402 - DNA, 1076 bp, Heterodera glycines
  misc_feature (991)..(991): n is a, c, g, or t
cttaaaaaaattgcaagaataattaagtccaaaaaagatatctcgtgctttatcattgcaatattcataatcttgacacatattaactttaaatgtataattattaattataaaataggaaatatttaacagtagaaactgcattaaaaataaaggtgtataaatttatggttatgttattcggcaatacccatatggaataatctcccgaatccgttccttttgattctttttttaaacggggcttatattcatatggtaattcggggagatagaatcatactgtctcgcgacggtagctaatgtttccacataggagagatataccatcaaagtaaagcgataatgtatgataataagatattatcgttatcctctatggttgataagcataagaaaattttcgcctaaatattggatctttgcataaaattaaaaggttttaaaactatattaaaaaaaacaatattccaactttgttttttcaaaatttaaaaaatgaatgaaacaatgccaaaccaaatccctgaaagtatttaatcccggtgtttttatgcccctatttccaatcttcaggcaagttttgctttttatcattaaatataattgtttatttttgtcaattaacccttgacagacttggacatcgaaatgaaattatggtagaaatgagccaaaaattcggaaacgcaaagcaacagttggaaaatgcacttagcgaagaaaaagccgaaaaacagctcaatgaagcagcacagaaaggatttgaagaggcgcaacggcgatttgaaattgcaaaacaagagaaagagacggcagaagcggcactaaagaaggcggaagagaaacggaagcaattggaagtgagtgccatttgtgggtaaaaatattgggtatataaaaaatgtatatttgaatttgtgtctaatttgcaagactccaaaaaatttctgacataaaaaattctttcacttaaggtatcagcataganaaaccgattttgcgcaaaaaatttaaattaaattgaaaaacttaaacagattcacgacttataaattatcgctgacccacaaaat

SEQ ID NO: 27403 - DNA, 975 bp, Heterodera glycines
  misc_feature (875)..(875): n is a, c, g, or t
cagggaatgaatggcaacaaacaaatgaaaatttaaatggaataataaaagaaaattttaataaaaatttggagcaaatgttcaaaaaagcggaagaaagggcaatagaaagatgcccatggtttggtcatgaaacagataaacaatggataattgtgaattcaaaattcgatgatgaatgcacatggtgagagatttaaaattgggcaaccctaaatccgaatcccggaccatttacatccaattaaatagttattaaatgaattagatgcttttaacccaaaaaaatatgtacatccttgggaaatttttttttaaagtttttgttgaatccaggtcggtcctgagttcgagttgggcaaatccgagttaaggttcgtaatcagcaccctggagaacccctatttactggttttgagcccaaaactaaaaaagtttcaaattagggacacccattctttaggattgcctaaaattcaatgaaaattatatcaattcaaattttagatcgaagattccctattttcttaatttgtaaaagggttagcgacaaattttgagaaattttttaagctggataaagaatattcgaactatttaatgcgatttaaagaaacacgaaatttttatgggaatgaaggaaaaatgatcaattttgggttatatgaaaataagaaaatgaaagagtatttggcgcacaaatatgcagtatatcttggcattgtgtatttgctgaaaaagaattggcaatgtgaaaaaattggaaaaaaatttaaagaaatatgccaaagaaatctaaaatatttgcgcattttatatgaatatttgttccaactttatattgaaggtttattggaattataatgatttattanaaaacatattttaaggtaaagcacaaaattggcaaataaattttcggcaattaagccaatatttatggatcattttgaaaataatcaaacgatgttaatt

SEQ ID NO: 27404 - DNA, 1462 bp, Heterodera glycines
ttatcctttggacacagcgtcgggaaatgagctctgtaccaaaaaagatttgcatgtgtggctcagtgtttttgtaggaaagtcaagggacaaaggcgggaggttcgagtccgttgtgctacatgaatattttcatttatttttgtgcaaaaaattaaaaaatgacgatttttgggaattatttttggaggtttttaccaaccaaattggtccatcatggtatcattcgaaagctcctggtgaggagaagctttttctaagcggatgctaaccattttgaagcattagaaaaaagttatgggcgtttgaaattttgttttttgaataacttttctaatcgacccattttcaaattaatctgacctatcattagatgcagaaaatttttctctatcgatatataaaatttggttggatttaacaagtagaaaaaattttaaacaggatgaagcaaattcggtttttctctattaatagagatgaagaaatagtatgccaaaaagagagatatctttttctctgcactctctatttattggtacacatctcgctttttcggacggtgtgggaggaatcatatcattcttaaaaaatcaaaattcccaggtccgtgtgctgatcgcttgtgatgtcctttcacggggcatcgatgttttggacgtcgattgcgtgatcaattacgacctgccgataaacgaacgcattttcgttcaccgagctggtcgtactgccagagcaatgaaagaaggactactcgtttcactgacaacaaaagaagaagtgtgctaagtgactacattttcacattttactttcccacatttttttccctttagaaaatgaaacttaaaaagttgctgtctccgcacaacctttgggagagcattcaagaaacaaagtccaatgactcggactttaacgaagaatgcatgcaattatatgaaaacgcgctaagaaagttgaaaaaacgatttgaacaaaaataaatgattttttaaataaacggctttttccctgttgttttttagttgtctcatatcgttcctgttattacccacacatctcaattttcgttttccctcgtcttgttattttggttataaatttgtttaaactaaatttgatatacatattttggaaattaataataaacgagtcctaatcggttttgggtcaattttttattgtcctcatttgtgtgcgtacactcaataaaggcaaactgtctcctcattttgtagttcgggctgactaataatttgtttgttttttttttttttgattttctgtcagatggatggccgtaaccataaccatgcccatcatcacgaatcccacgttcaaatttcgaccaattcgctgccgccggccaacccaatcgacggaattgtaaattctcttccggatttgaatggtaaattttgtctggcgatagtcatgaaaaatataacgtcttttttgg

SEQ ID NO: 27405 - DNA, 1693 bp, Heterodera glycines
  misc_feature (63)..(63): n is a, c, g, or t
gagcatcacactgtgcatccaccagctgcgcgtggtcaacattgtcggtgttcaaaccttgcnccagcgaatcagtgtagagcgactccaaaacaccctgggtggtatctatgacccaacaattttcccagcccttcgttgtaaattgtcgaatggagtcacgtgcctagtttatatttcggggaaggtcattgtcactggggccaagtctcttgatattttgcaccagtcatttaccaatttgtctaatattataccaaagtattttcgtaaataatttattttcatttgtacaaatttaaataaacaaaatagtaaactaacaaaaaaatcacaacatcagaaccacccagagtgtccgggctgtgtgggatcttgctccacaaaatttctctttcgtcggtgcgtccgttgtccttcgttcggctgtccatcatcctccagatagccaaagggacgcgtctgcatcccaggccgaacgcgccccttggcatagaagggcctgtagtctttgtgggcctcatgcgtgtagagatcggcgtacacattgcgatcaatttgcgggaagttgacgcgtatggcacgatgttcgccgcctccgtacacgtaaaggtcgcattgtccaaagcatcatcgctaaaattcaattttttttaatattatgtaaaagaatgatatgttaaaaactcacattgggccgtcaatgttgtaagtggccagcgtcaggtctttcatcgcctcaaaggtgagcagctgctgcgcagtataggacaggcggaagctgcggattttgaggttggcgcgctcgtcggtgccgtcccgcgcagtgtggcggatgccgtagttcttggggccacccgcaacgaactcgacgatccgtcggtcggtgtgttcgcgcttcatctgccccagcgcctcgccctctgctacacaaggaccacccatcttgttgacgtagtagatggagtcggtgtctaaaacatagcgttgtccacccaaaaaacatttcgtgacaaacataccgcagtagagcagctccgcaccgtcgatggccgacacttgctccatgtagtcgtaaagatgaagtcgaccgtacgaggtgacaaacgcagcgaccggaaggcagttggtcggtggtgccctggcgaattcgtatttctatgcctaaaattagggtagcaattgttgtcgattcgagcaatcaaataataccaataaatgaaaaatggaatcaaaaaagaatctatttttgagttctcataaagttgtgaagcattatattttccaaaatgttctattagtttaatgtgatcttttgatgattaattaatttattaacaaaaaaagattttaacagtaatttaaagcaattcgcatcataaaataagtcccaattaatctttacttttgtgctacagaaagcataaaatagacatattaatatgcaaaatcaacaaatgacgggacacaaagcaatattttccggtaatatttaagtaaaaaaattttttcccttaatttcttattccaactcttcgtccgggaattgctcatcaatatatttacgcaggaaacacagcaaaagctttatgttggaacagatttggggaaagtcagcaaaaagcgcactgactccagacactttgtaggacagcaccaagacaacgtgttcccttaagattgttaaaatgct

SEQ ID NO: 27406 - DNA, 1310 bp, Heterodera glycines
  misc_feature (9)..(9): n is a, c, g, or t
tataaaaantcttgaaattaattaaaacattaaaaatatcctaaaaatacaaagaaaaataatgtacaccgcccgggtccgaacttcgcctatatgaaattctttaatcaaacaaaaaattaattttaaaaaatttttcacaaaaaaataatttaatttaaattaaaaaattaattaaataatttataaaaatcttgaaatgaattaaaaacattaaaaataaccaaaaatgcatagcaaaaataatgtacaccgcccggattcgaacttgccccccccctcaaaatgatgcctcagaatccccaatcacacagggattctgatgtctgaacgatgtcaaaagtaaaatctgatcacgtattcgtgatcagcgtcataaaatacccctaaagacatgtttttggaagatttttgtcgaaaaagtttttcactcaaaaatcctggtcacccccctttggtcccgaaaccaaaaatcacttttatttttataacaattcgcaaaaaagagataaaaatgtaaaataaaatttatattatagagaaaaaaattgcggatttttgtagtattttacttttacagaatgacttttcagaagggagttctgattttttttctgaaaaatctaaaatttccagaatttctggaataactttttttctttagaagatagaaatcccaaataaatcccataaaattctcccgattttttgctatttttataatataattacatgaaaatttatccacccttcgatttgttatgaattttcgaaaattaacccaaaatcccgtgggccaaaaaattggaaaatattttcgaatttttaaaaaattccaaaaattttgaaacgaaaaataaacatcatattcgtgctcagcacatcaaaataccccagaaaaatatttttgacccccattttcaacccaaaaaaaatttccgaaaatttctagggggcctagctcgaaaatttttgaaaatttccggccatatgacacaccattcgatagagcttaaaaaactctacaattttgccccaaggagttttttcgataaaaccaacccctgacgagttatggacccgggactcaaatgtcccgctcaggccaaattttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaacctacttttaggcctaactcgaaaaattttgaaaattttcgaaattttaaaatttgg

SEQ ID NO: 27407 - DNA, 1374 bp, Heterodera glycines
agaaaaggttggagccgaagcgtcaaactcattagcgggagctcaagggtcactaatcatttatgggttcagcccaatgtttggaatgcatccaatgcgacagacagacgctttggtattcgccggaggaaaacgaacggcacattgggagatgccaacgcggactgatcccgccaagtcaatgtgccaacagttcacacacccactgcatatttagctacttcaagcagggagggggtaagcggcaccataggcaattagcattggctaatttacactaattggaaaatttaatggaaaatcaaatcaccgttttgtgtgaaggtcatacagagggataattgagacagaacataaaaagagggcgtaagtgagggatgggatggaagaggaagtgcccacccgcaaaaatgatccaaaataatccaatccatcgttaatttctcggcggcatttttgataaacaaagggagccagcgggagagatgaagtgaacaatgaaaaaataagttggattgggaagacaataggaaggggagaggggaaacaaagaacacagagaatagggaggggacagagaaattagagagagtgattagggaaagtgccatggtgagagagagaggggggagacagagaaagtgggagggggacagagaaattagagagagtgattagggaaagtgccatggtgagagagagaggggggagacagagaaagtgggagggggacagagaaattagagagagtgattagggaaagtgccatggtgagagagagaggggggagacagagaaagtgggagggggacagagaaattagagttgccatttgcccacttctcccccaatttttgttagatttttttgtgcctattcagtgattacaatcactgaacgacgctgtggcactgccgatcaaatcagcggctgcactctgtacaaatcgatgatgcgggccaaaaggcatctgatcgcgggctcagcgattgacgtggaaccaacgaaactgtggagagtgggaaatgtgggacaaagtccgccaagtcatcgcagacgcgagacgaatccattggtggtggaagtgtgcacgggcggatgcaaagagaacggatgtgtgaacggagtgggaggaggaggagaagcgaagtggacgatggcatggattgtggtcatcggatgggtggcatggtggacgagcacacggacgaggacagtcggcggaaggacacggcaaacgcacgacggacgcgtgggcgggtgacaaatggagggaatggaggaccatctcactcaagtttatcagcagcggagcaaaacactgatcgatcggaggactgaccgaacagagacaggccaacaaagcctttccct

SEQ ID NO: 27408 - DNA, 807 bp, Heterodera glycines
agttatggccagaaggaactcaaaaacccagtaattcgaactttttttgctctgatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactccggcccgggcccccccccccccccccgaaatcagaattttctgaaaaaaaaatttttttttgaaacatcgccggcataattttatttttaaatatcgcgtttatgcaaaggaaacataaaataatgcaatcaattcaatttaaaaaaaaaacacgaaaatacacccctaaaaatagaggtttacaaaaacgaaaaaatacaccctaagaatcgactttttgagttgcccccccccccgaaacgaaggtcctggctacgcccttggcgtatgcaatttattgatgagaaggaatttcgagtaaataaattagagcaattttggtttcattttgaagagaaaattctgaagaacatgtctaactatcgttttttacgtgtaaataccattttttgctggaaaaggaaagaaatttattgaaaatttcacccagttgaaaaatttttccctatgttcaaattttcttgaaattttgcataggcccatattttgaccttctctatcgaatcacagtttattttttagctgtctagtttttaaatcgagatcggctcttccatttttacaagggaaaatctcggtaaaatttt

SEQ ID NO: 27409 - DNA, 1236 bp, Heterodera glycines
taattaattgccaacttcgattcggcattggccatgcacacaaggattatggccacgctcgcaaggggacgaaagatgggcacactgttggccgggagcacattcacaggtcaatgagctgaaaaggcaacatttttgattataatttgcttaattatccaaaaaattacttatagtcatttgtcggtgtgcaaattgtcccctcggggcacggtttaaattcgcaggggtcgggcttttcgctgcaataattgtgtttttagataataagaaggcaatccgtataatattttaaattaaatttaatatttcttcatattacccaaaatattttaatatagatattttaaagtgattaatttaattattttcctttgtttacatttcgcacaaaatgccgccaaattttggcggacattcgcactgttctgacgaagcattttggcaggtggccccattctgacagtccaattcgcatttgttcgcgctttcttcatgttgaaactcgcaatttttgccagaaaatcctaaaacaaatatttaaaaacaattttaaattattttaaaaattatttttttccaaaatattaccaaatttgcatcggcattcgtagtggcccaattggtcgtgacaaatgcctccgttttgacacggttgttcatcatcacaataactgatccgtgacgcgcacatgtcgccggtgtaaccaaacttaaaatgattaaaaatgcataaaattttaaatttattttccctaaaaaatataaaatattaaaaaatgaataaaatttatcgaaaataaacgctgacactcacctcgcattcgcatttgtaactgccgaccaaattgacgcatttgccattgaaacaacgcgtcatctcatccgaacattcgtccacgtcatccgtgcaattttggcccttaaaaattcatttagattgcaatttgaaatcataattttctgtttttccaccttccatccctcatcgcataagcatgtgtagcttccgttgaacggattcgtaaaacaatggccatgttcgcacagattttcgtggatattgcaaatgttttgaaattcgcacagcgctccttaattgattagaagttaattattgtaaatttctggcattttgtaccaattcggtccggcgcacaacggcaatcgtaccgagcaatgccatccacgcatgttgagccggcgtaacacaaattatccacacagtcgtcaatg

SEQ ID NO: 27410 - DNA, 1119 bp, Heterodera glycines
gagtggttgggacagatgggcgcgaggggcgaggcacgtcgttaatggttacgacgaatgtcgttgtagggcttggtgtttggcgaggctcggaagaaaatgaggaatacacagtcagcggggaatttgagcgggatttagtaggagcaatggggagggatgactcgagagtcggcgaggaagacttaagagggggatcagcgggggcggggtccaattccatttgattaatattggataaaataactgaaggtgcaattaggtcaaatttcaagtgtttgtgaatgtcgttaattgcagaaatggcaagtcttggatttttgcgattcatgaaccacggggtgggttggttcgctgcacaatttcctgtaaagtgctttgaatttcgccaagttccaatgattctggcacggaaagaggagggggagaaaggaggttgatacgcaaataattacgaatcagttgcaaaatttttgccaagacaaggagaaaaattccaataagacaggagatggtggccacaattaacgaagtgtgtgggtgggggtcgtctgttgggctttcagaaagtaaagaatcgagcccaaaatacacgagagagggagcaatgacggaaaaagaacttttggccaaagattttgggttaatttttactttgggctttgcgtcggccaaacccggttgaaggataattaccagaataaaaacaaaaaccaccgttgggattgctaagggggaaagagggtgttcttcaattgggccactttgtgattgggttggacgatcagaaatggaaggcagggtgggtggagtgaccgagatggattgctgtttgaagatttttgcccaccaaaaaggattggcacataatcatactgaacacaggaaaaaaagacacataaaaaagggagggggacggggaaaagctgatcgttcggcgataagagaaattcatctttgcggggcgaaaggtgatgagaaagcgaaaaacggctggaggggagggaatctgaggattacgttgggaggaaaaatagggacattaggctggggttgtggggcaatggcgtgaaattgtccggcatgtacgggttgtgaaataacagggggggcgggggg

SEQ ID NO: 27411 - DNA, 959 bp, Heterodera glycines
atgaataattgctttatagaaacctacccagcatggaattgtatatcagattcgaatttttttgtatttaagcttttcttgcgaagtatctttaaagggtgatggcatttaatgggctagaataggtgagtaattaagagtggatgaatatttgctttatagaaaactacacagcatggaattgtataacagattcgaattttttgttatttaagcttttcttgcgaagtatctttaaagggtgatggcatttaatgggctagaataggtgagtaattaagagtggatgaataattgctttatagaaaactacacagcatggaattgtataacagattcgaattttttgttatttaagcttttcttgcgaagtatctttaaagggtgatggcatttaatgggctagaataggtgagtaattaagagtggatgaataattgctttatagaatactacacagcatggaattgtataacagatttgaattttttgttatttaagcttttcttgcgaagtatctttaaagggtgatggcatttaatgggctagaataggtgagtaattaagagtggatgaataattgctttatagaaaactacacagcatggaattgtataacagattcgaattttttgttatttaagcttttcttgcgaagtatctttaaagggtgatggcatttaatgggctagaataggtgagtaattaagagtggatgaataattgctttatagaaaactacacagcatggaattgtataacagattcgaattttttgttatttaagcttttcttgcgaagtatctttaaagggtgatggcatttaatgggctagaataggtgagtaattaagagtggatgaataattgctttatagaaaactacacagcatggaattgtataacagattcgaattttttgttatttaagcttttcttgcgaagtatctttaaagggtg

SEQ ID NO: 27412 - DNA, 1114 bp, Heterodera glycines
tttaaatttccttccccttttttggaattttaaattttttttggtattttttttttgcgggccattttgaatttttgaaaaaaaaaattcattaattttttttgaggagggtttggaaacgccccaaattttattttcaagttaacaaagccctctgatgttttttctatcaaaaagggggatgaataaaaattctaaaaatttttactttctttttaaacgagcgaaaaactttaggcttagcttttttagtgaaaattcaagcactcatagtttttcgcgttctgatcagaaatgcaccaaattttgcagggtaacagctgagaagaagaggtaattaggtttaaatttccttcccattttgtggaatttgaaattttttcggtattcttattttgcgtacatttcaaattttgaaaaaaataaattcattaatattttttcagagagtgatctgaaacgcaccaaattttattttcaagttaacaaagccctctgatgcttttactatcaaaaagggcgatgaataaaatttctaaaaatttttaattgctttttaaacgagcgaaaaactttaggcttagcttttttagtgaaaattcaagcactcatagtttttcgcgttctgttcagaaatgcaccaaattttgcagggtaacagctgagaagaagaggtaattaggtttaaatttccttcccattttgtggaatttgaaattttttcggtattcttattttgcgtacatttcgaatttttgaaaaaataaattcattaatattttttcagagagttatctgaaacgcaccaaattttattttcaagttaacaaagccctctgatgcttttactatcaaaaagggcgatgaataaaaattctaaaaatttttacttgctttttaaacgagcgaaaaactttaggcttagcttttttagtgaaaattcaagcactcatagtttttcgcgttctgatcagaaatgcaccaaattttgcagggtaacagctgagaagaagagggtaataggtttaaatttccttcccattttgtggaatttgaaattttttcggtatctttattttgcgtacatttcaaatttttgaaaaaaataaattca

SEQ ID NO: 27413 - DNA, 706 bp, Heterodera glycines
tgtagtgtgcttgcccgactgcttggtcgtcccatcggcagcagtgccgtgatggccgctgccggtgccatcgtcgacgcgtcgtcgtcgtccgctgctggctgttgccgcctttgcttgttgcgcgacgtgcggccccgcctcttttgccacggttgcctgaggccctcgtaggtgatgtgagtccacatgtacaaactgtccaccggttggccccaccggtttagctccaccgccgatgccgtgctgttgctggcgttgtcgtcctcaccgaagtcgtcgtcgtcattggcggcactaacgctttgttgttgtgccccctccgccgttgtgccagcggtgtccctcgtgggcaaaaggcggggcgacgagatgccactcggacactccgatgaggaaagaagcggcggcgcttcaaaggaaattgtgcagttatttttaatttttcagagaaattttaatgttgaaattaaagcaaggaatttttttaaatggccgggaccgggaataaaattcaaccggggcgggagggtccagggaccaggactaccatttgttttccgagatctccggttgcggtgctaaagacatatttgtatacaaaaaaatttttaatatgacattgatgcagattcataaattgcaatgctgcaaatgtgagtgagatggttttatgaaaatttagataatttttttataagaatat

SEQ ID NO: 27414 - DNA, 549 bp, Heterodera glycines
tgttccaaaaagttttttggaaaaacattgccaaaaaccattgagcttagcaaaaaatttaaaagattgttaatttatttaaaaaaatacagaattttgggactcagaaaattccaagaaccccccccccctgaaaacaaaatttttaaaaattttcctcgaactcgtcccccaaaacgtaaatacaaaattttatgggtacatttttgaatattggaaattttcgtaacaaagtgcacttaaattttcaatttttttcaaaaaaaattttctctgggaaaagtcccggttggtcccggtcccgggttttttcgcggtcccggtcgaaaaacttggtcccggtcccgacttttctggtcccggtaagccccggtcccggtttttgtcaaatttcccggtcccgctcaactctagaattttttaaaaaccaacactgggcgcacatcatgtttctcattggcataaatccaattgaggaaatcttagctcaaattgtggcatttatgcccatgatataattccgacgcttagtttttgcaattcttcgct

SEQ ID NO: 27415 - DNA, 906 bp, Heterodera glycines
atcacgaggatgtttaaaaaaaaaaaattttccaatgtgtcggtcggcaccaccggctgaaaaaatatacatttttatctttctaatttgatccaaaaatacataaaaactgctcatttaatttcgaataattttaaggaaattgcatttttttaatggaaactgagaaaaaaacaaacaaaaaatagacaattttgcaattagcgccgaaaattctttaaaaaaagtcatcgatcagcgcccttcaaaaaaaaaaaaaggtttttcatgaaaaacaaaaattgcaatttaaagactactataattaattatactataattgccgctacctacctccttctgtcgctgtcggttcttcaacttgcgaatgggtgccacaaattcgcgtcgtttctgcttcagctcgtcaaccccaacatcgtccggcatgtcgtccaaccaatccttcagctttgccgtctgttcacggatcaataccagctcttcatcggtgccaaaactgttgaaggcctcctcttccagcttggcactgtagtcgtacacggccgactcgagcaagttcagcgccaacgcatgttccgccttggccctctccttgcgctcaaagtcgttgagactgaaaacagggggcaagaattttcgatttcatttttcaaaaaatgaaaataaattcccaacctccaagttaatttttttttcaattgaaattttcctttctctcaacattggatgttaagttgataacgaattaataagtttttcaaaaaattttcaaaaaatcgtcaatttttcaattatgaattttcctacaaataattttttttttctaaaaataaaatttttggaaaattctcgtttgaatttttttttggggggggggcgagctgctcatgcttaagttcacac

SEQ ID NO: 27416 - DNA, 998 bp, Heterodera glycines
  misc_feature (932)..(933): n is a, c, g, or t
ataaaagtgatacaaaaaccaaaaccgctaaaataacgaagcggaaattaattcacatagaaggatatttaaattatgactacatatcctattcaataaaaaatagctggggtaccatccattctattaccgtttaaatcacgaatgaacaacaaatgaggtaaaaactttaactggaaaaataaatagacaaaaatagcaattagataagtgatttaacaatcattttccgttgcgcatcaaattggaaattgtttgcagtaaattgacaacttttatagaatttatttgccgaatcgatcttcaattgttgggcctaaattatttgaaatgcttatgaaaaaaacagaacagatgatttatttggttaccttttcaaggaactcgctttccgggatggcgattgtgtcaatgtcagcactttccgaaataccgcccccgtgtcgaacacgttcgtacacaatgtgttcgttgactaattgtttaagcaaaaagagcagcaagtcattattgtcacgtttataactcagttgtttccagaatttcttaatttgtttttgcttttcgatattaaattttgccattacctttttcatttggcgcatgaccgatgcctaaaaacattaatttaaacactgttcatacacatttttgtggacctcatcacacatattttctgcttttcggttttttaattcgaggtaccgcacaaataaaaaatgcctaacataagtttttgaaaccaaccttttgtgtgctgataaaacattgcaataaaattttcatcgccacactgacgtcgtcatcgttcacaaagttccgcaaatgcattttggcatgagcctcggccattcggattattgactcgacattccgaatggttatcgcaacagacccagtctcctggagggaaccaacattgaaatggtgtnnttcgtcggtcatcatacgtccgcctcttttcgcagatcactgtacacttttgagatgcgttcatt

SEQ ID NO: 27417 - DNA, 1514 bp, Heterodera glycines
  misc_feature (21)..(21): n is a, c, g, or t
  misc_feature (59)..(59): n is a, c, g, or t
tttaaatgtaaaaatcttttnagaagaatttttataaataaaaaataaaaattaaattntaagtaacaaaaaactacaataattaagtataatgttaattgagtaaacatttatttgaaagtttgaaataaatttgaaaatgatttctataaattataaatttgaaattttgaaatttaaatttgggtcactcgaaattaataatgaagaaattatggaaaattgacatctggctttggacaacaacattaatttgaaaataaaatatccatgaaaaattaatgcgttgcgaaatgattgaggaaaaattaataaattatgcaaaatgtgccgcataaataaagagtctttcaaattagtgaaatgtgaatgaccttcttaagaaatatggaatttgaatgaaaaataatggaataaataaatcattttaatttaaatttaaatatttatgctttaaaaaattattattttaatatgaacttaaaaatatatttttttttttcaaaatttcagagttcaattcaaaattctgatattcttttatattttttcatttcgaatgaacgatttaaatgagaatttttttttaataataaatgaatttaaaatgcttatttttcatttaagtttttgtcaaatttccgcaaataatccaaattttgtgaaattttggccggacagaccgaccaatccattttgctgaagcaaattgaatcgtcttcccctgcctcaaattagaggccaaaatgctgcaacagaaaaagcggaaaattccattcccccaattgctcggctcattcctttgcaatgcttcaactatttattagccatggggaaaagcggcggcccaaattgggggcccctggggggacacgaggaatgaaaagtggggaagaagtaatgtttaaaattggattgaacatgagagttgcatatgaattgtttttcgaattaaaagttggtttcaaatgaaatctaattttttttttcaatttttaagtgaaatttaaagtcaatttaatacaaacgtcacaaaagtcttcatctgacttcaaaaaaatttatttgcttttgtaaatttttgaagaaggcaatcaatttggaatttaattatattcaaatgaaaacgtaattgaaaaaatttaaataattcattgtcattataaactttctttaattaattttttttttactgggatatcatttttaacaaaagaatgaaaacggaaacgattatttttccattgaacattgggaaaaatgccaattaattaaaattaaaaataattgggcattaattttttttaattaaaaaagagagaaagaattcatggcgacagacacagaattaaaaattttttaaatacttttgttttgcttttaaatatcaaaagaacaatacaaattaaaaaaaaaattaattaaaaaagatttttttgttttatatgtactttcattaattttttgaattgatattcaaaaattcattggtttggatcataaatacaccaaaa

SEQ ID NO: 27418 - DNA, 1049 bp, Heterodera glycines
  misc_feature (96)..(96): n is a, c, g, or t
  misc_feature (996)..(996): n is a, c, g, or t
ctcaaatgcatttctgctaatggacaaaataaggacgacgacgacgatgatggtaatggaaaaagctttatctgctttaaaaatgtgcttaaattntagtatcaaaaaacatgcaattaataattgttgcaaaaattcaattttcagaaacatttgataatctgccatatttaataattggtaaattactgggtccaataaaacaacgcccatacttttgttgtttaaaatgcagttcagtaacattttaacgaaggaaattaacatttttttagttttaaaaatttggaaatatttcaaaattattgcctctggtaccgtattttctcattttgtaaatttatattaaaaaagttttcaattgaatttttattaattattatctaaaattcagtttcttaatattttaacgaagtaattactattataattttatttggaaatttataaatttttaaaaccaaggcttacctatagcgtattttctcattttgtcaaactttttgtcgtatggtgtcgaattttacgtttcatggactgtacctatacattaatttaagacacaaatcgtcgtcggagacgccgtaagcggcgcaatgctccgccgccgggatacgccgaatggaatcaggaagcaaataacccacgaactttggcaaaaattatgttgttcgttgtagtgatgactgtttttacgctggtggttaaccatttttgtaccaatcgctctggaaacaatcaaagccaatggcagacagcaaccattgtaaccaccatagaaagctcgaaacgatgtgagaggaattatactgtagattgtgcttcaaattataaacaagaaaaatcacaaaaaagtcttaaaatcggttttatggatacatttgcaacaaaaacattgattttttgagagaaattttttaaaaatgctaaaaagctttaaatattttaaattacgaaatttttgggattaagaagtgattctttaaaaactactanaaattgcacaatatgtaaatgggaaaatgtaaataaaaatattttacatacct

SEQ ID NO: 27419 - DNA, 1422 bp, Heterodera glycines
ctattttctatttttaatccatcagcacgctttaacatctccttttatagatttaacacaaaatacaaactgggcaaaaaattcattccatttgctgggagggtaacaaaattgtggaatcaactagataaagaactaataaaaacaaattctttaaatcaatttaaaataaaacttaaagtagggtaatatgtaagaccgggaaagctagaatgtaacaaatttctaagtgatttggtatttcgacctcatttgactttgacctcaatttatttattatttattttcacatatttttgtctttttttaattcctgtgatcatccatatattttgtcacttactctacgacacatttaccggaatagtcgtcagagtaagtggttttcgcccttctgatgacttttttattttttatgaataaacaataaacaataaaaaaaaaaaaaaaaaaaaaaaaatcttattcattgaatacagttgcaaataagatacatttcaaaattttcaggggtaaagggtcgattcttaggggtgtatttttctgaaatttttttggtcaattcttatgggtattttttttgaaattttttaggtcgattcttaggggtgtatttttctgaaatttttttggtcaattcttatgggtgtatttttttgaaattttttaggtcgattcttaggggtgtatttttctgaaatttttttggtcaattcttatgggtgtatttttttgaaattttttaggtcgattcttaggggtgtatttttctgaaatttttttggtcaattcttatggatgtatttttttgaaattttttaggtcgattcttaggggtgtatttttcgtttttttattgcattcttgttgataaatttcccaaaattcgcaaaataagtgcgaaaataagggcgaagcgccaaaataagggcaaaaacttattttaagggcgaagatgtaaaataaggatttttaagggcgaacacccagaataaggatttccaaggtcgaataagggcgttaaaacgcaaaattttcaaacaaaaaaaaatgtgtttttcgtgcatttctcgtcgacttaaagccgcagaaaaaataaggaaaaacttataaatccgggccctagtaatgatacatatatatgctccgttaagaaattataaggtcaagaatttttgtgccacttcacctacttccaatggaccaatcgagctgaaattttaccaatcgaacctcttctgtgaatattaagaaacatacaaaaaaattggaaattgtaaaaaaatttgttatgaatgattttcgaaaattgccccaatatgagtgttaagaaattataagttcaaaactttgaatttatgggggaccaggtcgttttggcgccgacgttttggcgccagggtcgttttggcgccgacgttt

SEQ ID NO: 27420 - DNA, 1114 bp, Heterodera glycines
tctaatctttgcatatatttcgaaggttttatatgtttttcttaaattttctagaataatcaattggttggtccaatcgttccatttttgcttatttgtttgttttttcgatgtaataatatgaccatttgaaccagttctctctccatggcttccctcattttgctgcttttaccgctgttcgtctgctccttccttttcgtttttcgccacctcaaacttcgtcgccagttcagttccgtcccttcccctcgctcctatcccttcataggacacatgctcatcaccaaaccggacattgaggagacaatcggtcaaataatggccatggcttacctttacccgtcccatccgcggatgaccgccttttggattgggcccactcctaccattatgatttactctgccacgctgctcgagtcaatcaccggcaacacggaccatctgaacaaaggattttcatacgaatttttgaggccgtggctcggcaatgggctgttgaccaggtggggctgcactgtttccaataggaaattcccacctttttcagttgtgccgaacaatggaggcccaggcggaaattactcaccccgacatttcattacgacattctgaagcttttcttgcacattttcaaccatcagtcgagcattctcgtacagaaattgcacaaaattagtcaagagaacaagttggtagcgaatggcgaacaaacattttaaattatgccaacatctaggggattagttgcagacgtttcgccgttggtcagtctttgtgcgttggatatcatttgtgagacttcgatgggtcagtcggtcaatgcgcagtttgagtccgactctgaatacgttcgtgcggtgctcagaatcaacgacatcatccaacgtcggcagtgcaacccgttgatgtggctggacacacttttcaattggttcggtgacggaaaagagcactcatgggctttggaggtgctgcactcattcactcataaggtgcagtcaaatcgccaatttgccaaatcaaacgaatgatttgttaggttattgttgaacgaagggaaatgcgaaaaataaatggaaatggaacacggactgaacgattggcctttttg

SEQ ID NO: 27421 - DNA, 1034 bp, Heterodera glycines
tttagcaaagcggagtcaattataaaaacaacaatttgtcctttgtcgcttaccgtcccgcggttgtttggatgggctcgtagaggaacaacaatgttggttcataataaccatgcaaaaagcacatgtccagcacattgtccaaccgttcgtccaacaaacgcattttgatggtgtaactttgcaacaacatttgttgctgttgttgctgctggttgtacagcttggcctcctccctgctgctgactgcagacggttgttggcgcaccaattcgacgatgttaaacggcacaacagccaaatgacgtccatacactgaacagggagatgtaagttaggagtatacgaaaaaacgtatccaatcatgtccaattagtccatgaaatttatagagatgagactgggggttgacaaaacaccaaaaacgaacaccccaaaaaatttggaaaatgatgatatttgaaattttagcaaaataaaccttggaaatcaaggttcggacgaatcttggattgaaaattttatattcgtaaagaacccatgtattcaaataatgtgaaaagccagaattttggaatttgtcagtcaatacggattaaaaaaacgatgaaaagattagtatttcataattgaattcgaatttgttcgaatgttgacacatttattaaaccgtcgtcccctaaaagcctctagacatttcagttttgaaaaacacaataatttaagcacccgtaaatgcacaacaccgatgttcagggtcggcacgaagttcgggctgatgaatgttctcatcggtgtaaccgtcgcgcaaaaattcgtcctcaatggaatgcagcgaaatggttgtcagtgccattgtggccgggttcacgccaacaattgacagtttggcatcatcaaaagtcatcgccaacgagtcgtaacaatcggcactgactaaaaacaaaaaatgaatgaaattttctgaagacctgtaacaaattccaacttttccaatatccaaaacgaattctatgaatttggccgccatttaa

SEQ ID NO: 27422 - DNA, 521 bp, Heterodera glycines
aaaaaaaaaaaaaattattttttttttttttttttttttttgggggggggggggggggggggggggcgccgccccccgcagaaaaaaaggggaagggggggcgggccccaccccccccccccccgcggggggggggggggggggggggaggggggggtttttttttttttttttttttttttttttaaaaaaaaaaaaaaaaaaaaaaaaaaaaaaatttttttttggggggggggggggggggccccccctttttttttttttgttttaaattttttttttttttttgggggcgccccccccccccccccccccgggggggggggggggggggggcacattttttttttttttttttttttttatataaaaaaaaaaaaaaaaaaaaaaaaaaaaattttttttttttttttgtttgccaccacccccccccccccccctctttttttttttttttgggcgggggggggggggggggtttttttttttttttttttttttttttttggtggtgggggggg

SEQ ID NO: 27423 - DNA, 963 bp, Heterodera glycines
  misc_feature (900)..(900): n is a, c, g, or t
agtgcggaaaaacggagaggggggcattttgcatttggtaccaaggtctgcggttgttttttttaggaaaatcactgtcattttagggttccgattcactcgcagaaagggaaggtggttccgctgctccaaccgggactgtgaggcaactgcagcattgagtaaagaaggcggaactaatggtgtgctcggaagaaaagagcacaaccatctgccggacccagcgtgcttccacgcggaggtaaaacgcaacggaattaagacgacaacgatggaaaacccgcgccaaaagccatcaaaagtattggcagaaatccgtgcaaacaccaaggacgaaacctttgtttccatgggcactgacctcgcactggtggcagtaatgagaaggtacttctcttttgatacgtgtattcctctttcactcttatttcaaaatttttaggcagaaaaggaagatttacggcaacatggaccgtgtcaaccctttgagtgttgtcttacccgatgccctgcttattaaggatggcgaaagcacattgttgtatgacagccgagcgcatcgccaaggagaatcggatgtggtcttggtctttgcacacccgaagttaagttcattcatttcatgttcaatttttcgcttttgttttcagctgttggacgttttgaagcgggcgaggaaaatttcagttgatggaacattcaaagtgtcaccagccgcatggacgcagtgtttcgtgatcggcgcttttgtcaaccggcggctcgcattatgtgtgcatgctctgttgcctggaaagcaacgaaaatactacgaagaggcgctcaatgcggtcaaagcggtgatggcacccaacaccccagcacatagtaagtgatcatttttcctaactttatttcatnccaaaatttaagtcatcagtgactttgaaaccgcaacgattcggccatgcgagaaacgtttcc

SEQ ID NO: 27424 - DNA, 1135 bp, Heterodera glycines
ttttgctgcttgccttaattattatttgtttgatttttttattaactatttccaaattgccgtggcattgttcggcaccgcaattggccatgtgctttaagcggaaggatgaaaaagaaggaagagcaaaaggatgagctcgaaaaaatggcccagagaaaaaaaaaccaaaaacaagcaatccatttaaaaaaaataagaaaatttgttttctaaaaaactaaaaattaattttacttaatcatttccccaaaattttttaatttacataatcctaattttaaaatattttgttgtctacattaattgaaaatattaatcttttttaactgccatggcattgttcggcaccgcaattggccatggccatgtgctttaagcggaaggatgaaaaagaaggaaaagcaaaagatgtgctcgaaaaagcatcccgataaaacaagaaataaccaaaaacaaaaatccattcaaatataatccatttaaaacatctttcccccaacataatccaaatttatttatttgaatttgaaatttgcattatttatttttcattaaaattttttaaaaatagtttttaattattaattattgcataaaacattttgttgtttttttcacaagccgaacattatgtgaccgtttacgcatgcaccagtttaattacgataagcaacaataaggacacttttatcaaaaaatatggcaattaccggtgcgaacagtgccaattaggcaaagaaaatgaagagaatggcaacgcgaatttcccggtatacaagccaaaaggtagagataataaaattttaatatgttttttagtcatttaggttacaagttaaattatatatttttacaaaaaaaattaagaaaaatttattattagcgacccagtgattagacatttaaagatctttcccctaacataatccaatttaatttatctgaaattcgcatttatttattttgcattaaaattgaaaaaaattatgtctattaacaatgctgacaaaaaaaacacaagctatttatttttttaatgtagagatctccgaattttacatatacgaaaagcgatcatgacttgttaaaagtgatatttgttacaaactttacttcgaaattcgaaaaactc

SEQ ID NO: 27425 - DNA, 822 bp, Heterodera glycines
tttgaattactcaatttgaagggatttaaagcgaattttgttgtgtagcgaatggtcgggcaacggaaatggcacaaaattggcaccaatccccacaaataggtttgattctgtgcctgatgtgcccttgcaaatttttatccatttccaaattgtcaattcgcttttgccatcgaaatgcgtgtctactaaagcatcgaaacgtggcgaaagaagtgccaatttgaggccgagttgagcatggtcaaaaagagggaaaaggtccatccaaacgtcgttgcacacccagctgaaacaagcaaaacatggccgagaattcactacttcggcacccatcgaatattgcaagagacggaacaacagacaaatgtcaatgacatggctctattcaagattttgaatctatttccgcaatttttgaaaatttctaaacgaaaaatggaataaaataaaaactagagctcgacctggaccttggtccaggcctggatttttcctgggcctggatttttcctgggcctggatttttgtccaggtaatccagctccaacatggaatccaggtccaggcttttttcaaaaaaaaactgagtaaatttttcaatgccaaacgctcattaattgccacaaaatagccgttttttaagtttttacgagagtgcggcgcgggacgggatcctgcgcggaattttgcgggatcccagtccgcaatcccgcatttgttgggaaatgcgggtttgcgagattttgagggatttatacctgcgggatcccgtcctgcaaaattttgagttcaaatcccgcagcggaatccgcaaatttg

SEQ ID NO: 27426 - DNA, 1505 bp, Heterodera glycines
ttgttgtgtctcaatgtctggacacacaataaaataataaaacacaatttatgtcggaggtcaaatgcagtacaaatgtaaaatagcaaaacgaatgttagaaggaacaatgtggggaaggaaggattgcttaaataaacaaaatgaataagggggagggatgacacgtcacaaaattaatcaataatcgatgcgcgccaaattcaaattctttaacactccaacacctcccttctttaagctgaaccctcaggggtttggcgagaagcggaccggcgctttccgttggcgttgcgatcgacgctggaccaaaggaggactcggagatcgtcgctttgcctgagtccgtcgaattggtgccggttgcggaggaggctcgcggattggcgatgggtcccggtcttggatacgtcggggacttttccaatctttcgatgaacgttccatttagccaaaatctctttccacggttgaaattcaaaagcaaaacgggaacagctgagttcgaagccttcgaccgaagaacaattgatcgggcgaaagtccgttgagtgccgaattcagggttgtcctgtaggcgagaagcatcttttctgcccaaaattttccatctttggcgcatttcttcatggccctttgaacgtatcgacgaatctctccgcttggccattcgattgcgggtgatacggcggggtgaaggtatgcttgatgccaaattcgtcgcaaaattccttaaattctgcggcatggaattgagttccattgtctgacacgatttcttctggaaatccgagtcggtagacaattgatcggaggacatggagcgttgctggtgtcgaaattcggtccattcggtataattcaggccattttgaaaatgagtcaatcaaaatcaaataggagtggccatctgagcagggaccggcgaaatcaatgtgaatgcgttggaatggtcgtgagcaagacgtccatggagcgagcggtgctttgggtggactcttttgggcgctctggcaatcttcgcattgcctgaccatacgctcgatttccaagtccaatccgggccagtacacgtgctgacgggcgagggctttcatgcgcacgattccggggtgtgccattgtaaagccttgatgatgcgttcacgaagttgggacggaacgatcactcgctttccgtagagcaaaactccatcaatctctaaaatttcctttcgcttaggaaaataaggtgagagatctggttcggtgcacttttgaggccagccgtttttggtgtaatcagaaatttttcggaggacttcgtcttttggcgttcattctgaaatttctgcttccgtaatcggcaattgatcagttgcagtttggaggatgacgtttatgtagcaatctgtctctgtgcagatatttgctatcaaaatgtcttcttcgggccggggataattggcgattaagcgggacagtacatcggcttgtctaaaggatgacgtgttgatgtactttatg

SEQ ID NO: 27427 - DNA, 2238 bp, Heterodera glycines
  misc_feature (1388)..(1388): n is a, c, g, or t
cattttgatcatttaaagtatttttagaccaaaactttgaaatttgaatttttgactttttgttcgaatttggctccaggattcagaattggtcgaaattgatgccggattcgtgaccagcgttactctgaaaacccttagaaacatgttcccatggtttttgaatacaaattttttttcaaaaatgttcgaattcgggttaggggttcgtaattggccaaaaaggaggccggattcatactctgcagccaaaaacacccctagaaccgtgtttttggaatttacagaaaagtttcaaaaagaaaaatttcgggaccagtaaaaccatatgattgccgaatttttcattttattatacaatgtccaaaacaaaatgcaaagttttcagcattcatgagaagtgcggccgagtccgagcggttggtttcgcgccggacatgcaaattgtcagcattcaacaggaggacagtgtcattgtaaggggaagtgccaatgaataattgtcatttttattcagccaaaaagccaatttattcatttcgaatgtcattctttttattaaaatgaccaataaacgaagtgctgtttttacaggaatttgtgctgctgcaggagggcaaagttgtgggcacttttcggcacaattgcaccgcaaaaggcgccgttgtgctcggcgtccattggctgtccaactcccaagtcgcttttgtcaccgacttgggctgcgagttcttttgtgtgtacgcgtacaaacgcacgctgaaaatgacccaacggttagccatggccatccattggttcagcttttatgtgagcacaccgaacttttgtttttggatccataatttaaaaatgggccatcataagcacatcataattttgaacaactttttctgtttcggatgggtcacacttaatctcactccttcctatcgtttctccccagaaaactaaaaaattggtaaaactgaattttcaaattatttatataattttcttgaaaaacgttagaaaaaattatgtttttttaaaagaccgctaaaaaatgtcttataattttcttagaaaatgacgggcgaatgacttcatcccaactttaggtcttgaaattccaattataaagtacatattgccacatttttccaggctccctcaaatttgtttgtttgtgccagcggtgtacagaacaacctttttagtttcgtaacttttcaggtgggacaaaacggagaggctaaaattgaaagcatttcaatttagcaaaatgttccgcacactttgggcacggctgaggttgattttggctactcttccgcaaagccccgtctgtggagcgggacattgccattgcctcaatgtttgtgagcaaccccgagagaatgtctttntaaaaataaatcactgttttaaaccccagttatggcaaactgtgcattttggtgctcaactttgagtccgtccacgggttcgccactggactcagtgtgtacgaattggtgccgtcggggccacagaagctgctgaaactgaactgtttgctgggtttgcacttggtcggcctggttgggctgcacgttgttgacaatttggtgctggtccatcataaagtgagctgaaagtctttattctcccatgacacattcctactttttataaatcctaaaaagcatattgtttatttgtttggagtaatgtccgatttgttcattgtcagaatgtccaatccactctgatctttgatctaaaactgtgcaccgatcgtccaatttgttcaacaaaactttgtctcccatctgtgccaaatgcgttgtccagtgacagtgtcaatgccgacgatggcaatgaaaacaaaagtgctggtgatttgccacacaatcaacagcatgcaaatcgtgttttatcaatcggtgatgcttttctgtacaattcggcttggaaaatgtgcatgccggacgttgtggtggatttgcaatacgaattgttcacccgtgtacagcttcaactggagagtgccgaacatgcattgacgggcgaaggagggcacgacttggtaagataaactcatgttgtaattacacgccaatttcaaggattttctcatacgctttttaattaatcggaggaatggcgagaaagtgctgcttgaattgcttcagcgtgccattttgcacaaatctctccaattttctcgaattacgcaaatattccgtcaaattcttccggaaatccaaccgaaaa

SEQ ID NO: 27428 - DNA, 1418 bp, Heterodera glycines
tgtcacatggtcagcgccagcctggaactccaactgtttgaccctttcgtaaatgccggccaacatgtttctgaaggtattttaacgtatttttgaattactggaaaatttgttagtgtaaataccgacaattgtaaaaatttattgttttgcctctaaaatcattttaagtcgttcggcgtcaagaaatgcgccaatttgcatgaaaaaaacctgtccatatgtcgtgcctcctcaagtcggtacaaattctgcacaaattcgtccaatttcatccgtctcgagtccttaagtgacggcgtgtgcaaatccgtgttcagcatgatgacagcaaatgccaaaatgtacatcgagtccggcgtgtccaatgcgcacagtctgttccggttgcacgcaacgtaatgttgtgcaaaggcctaaagatgaagaatgtcaaagataaaaaaaatgagactgtatttaattaatgcgagattttgttgtgaatttgacaaaaaaaaacaaaaattgaagcaagaaaacaacaatcccaagctgaaacagcaaaatgttttttaggttaaacattttaaaattgatcaaaagttttgattttgagagaaccctcaaaattcatatctccaaaattgcaataaaaaaagcatttgcctgaataatgtggtcaattttttgcgcttccaatggaagtcgaatgtgtttgagcaattgccgaagtgcaatgtcaatttccatgtcgtacattgaaatttgttcgatgaaacaactttaaatgtgcaaaaatttattggattctaaattagttcgcaattttcctcatttcgccaagagttttttttaaactaactatggttactgaaaaaaatttgtaaaaatgtactttagcacggcggtatggaattgtgagcgcaatgtgccgaggtactcgccgatcatttgtttgctgatcccgcgccgttccatgaacaacagtgccaactcccggggactgttccgtacaaagccccaactgatcagcagctgaacgccaaggtccggcgttctataaaaaaatagattttaattcaaaaagactattgaaccctcatttatgggaaatttattgtaaattagtgaattgcacattaattaaacggggggggggggggtcaattcctcctctctaatagaatttttacttgttaaaaaagttgagcgcaattcggtagagtcgacgccgttgctgttcattccattcgacacgcatttgcatattcgcgggaataaatctctgcaaaattaaagtgaaattattacattgtaaatgaagtggtgagaaaatttcaaattttggttattttaaattccattcaattcgacaacccttaaaccgttgaaagacagttttaaaatatagataaaattgttttatgttttattct

SEQ ID NO: 27429 - DNA, 2201 bp, Heterodera glycines
agtagcgccttgctaaaagcttcttttttaacaaaaacctttatttttctatgaaattttttctacgtgagcaaaaaagtaaaatttttgaaaaccccaaaaaattaaaatttttataaattatttggttttaaaatttcttagaattttcctcattacaaaagctttttaatttggtttatattgacagggtttctttcacaaaaattttttgttttagtaaattttttgaaaaattttcttcgggggagggggaaggctgaagtgtacctaaattgaggtgtcaatattcacgtaacttcacaggtttcccgttgacttggaatgggacaaactcttcttcgcctcctcctctgatgccattgtccgtctccgttgcaatttctggcagaggcaccgaaaaatgtgtggtggtggtggcccgagtgccgtggtccatccgccgtgcaattactatgccatttttgtgccatcgagcggcgccgttctccacaaatttcctcacaaccatccacaagaaaaagtgcggaagaaaaaaccattcccagtgttggtctccgtttccctagtttttgtccaattttccggattccattttttatcaccccatacatttcgcgcaaaatttaaagttttcttttcaggaaaatacacagaaattggacggcgattgtttcgcagcaaagcattctgatcagcagcatgtggactttgatcggatgctgaattggtggttgcccgacggttggttggtgctcgcccatttgcacaatttgtcggatttggttggtctgtgcctccgtcacacacttcggcacgtacagcccaatgatcaccaccatctccgcttttggcatgcgcttcaatcgttgtcttcaacgccaatggacaacaatttcggctctgattacattgctcacttggaatgcattttcaacaatgtcgaaaacagctcggcattgcaggtgccgcaaaagacgacgacgacggcatcattacggtgctcatttcgcgcgttattttcgcgcagacggcaaacggttggtgaggcatcgattagtccaacattttgaaaacggcactgagtcctcgcaaatttattagaatttttgtatttcacaaaaatacattaaatgattgcttactttactttttcaccaatttttatttatttatgggtgactcaccgtaatcaatttcacttcttcacccgtgtttactgtatgtaaaatctctcattattgtgtttttgttttgcaggtgtactgtagtgcagtgggccataatcatccgctgatttgtcataatggagcagcgcaacttagaaagaaaaaagattttacaccgcaaccgccgattaaggtgtgtgacagtgacggattctgttccgtgatttttagcagtttctatgtcccattatggtacttaaaaaaacaattttgctatcccgttaattctcagaaagatgatttgagaaagctctttttccaataatttaacttttttatttactggctttttggtctcgattaagaagcctggataaataacagcagttcaaataatttaaaatattttcaacagcttgaacgtagcgaatttgacgaggaaaatgaaatttcgccattcaaccgccagcaacagttagcgcctgaagcgttcgcttcggttgcgcgtccgtgccacaacaccttgcgcgtgcggcatgcgttggctgatgcgcgcgcattggaatgtgccggaatgtcgcacaaaaaggcggaagtttgggtcagcgttcacgcgttcaaacggatgatgagaaaagcggaaaagaatttgaaagtgaagaaagaggagacgaacgcaaaacaattcgccaaatgaatcaattaaaatggcaacaaaaagcatgtgattgattctccttttgtccaattaaaaatgccaatacccaacttaaatcatttaaataattatattcagcattgaaaaataattgaaaaaataaaataaattatgataaaaaccgagatttatcaatgatggaaaataatatttaatcatcataggaaaagctaaattattatttttttcttagtaattttatgtttaataagtatgtcttttaaggcttaaatttattcccaaaaaatttttattaaaaatcttttgaatcaaattagggttttacttcttttctgcttttatctttttaaatt

SEQ ID NO: 27430 - DNA, 1660 bp, Heterodera glycines
  misc_feature (22)..(22): n is a, c, g, or t
  misc_feature (31)..(31): n is a, c, g, or t
  misc_feature (1484)..(1484): n is a, c, g, or t
cacactggtctgaccgcatgcnagcgcaaanagcggcacactcgtcctcaacaaatatttgttgcgatgaaacggccgaggcattttttgacgcaattttgacgcatgacaaacttcaacaaccgcagcagcaaccgcttcagcgtacgtgcacgacaacgtcaacaacaacgacagcaaagaggcagttgacggaggacgagcgacagctgttagccgacgtgatcgtctccagcatgtttggcacgtcgagcaatcaaacgaacggcgaagacgctgcaacaaattcagctgcagcggaccatgctggtggcagcaacagcacaatacgtcaggcggagattgacgagcagcagcattacgctgcaagcacaacttcatcatcgtacgcctgcacagtctcttccacgtccaaacaagctgatgatgcggttggtccaggtcaattgtccactcatactagtgctttcactgctgctgcatgcacttcgtcaaaaattcaatgcagcgctggctttacacttcgtgcttcaggtgctgtgaagggcgcttttattttttttttgaaattacacgtacgggcatgcttttcgcaggtggcgtgtcacgccgtttttcggacccattgttgcgtcagcgtggtgcaagcagggacgaagagcgtgaatgcaggggaaagtcagttttttaacaaattaattttaattttttcaataaaatagtgttttttataaacatttgttcaatatttccaattttttgttaactaataatcacaaatgcctcaaatcaagaccataatttgtgtgaatttttataggctaactaacggcttaaaattcaaataaaaatgcactaaaaatgatcatttttatgcgaaatcttttttctatcggtattaaaaaaaaattttatttggcttccctttttgctgttttttccatgatactctttcaatttgtttttaccataaattattaatgccaatcttccatataaattaattaaagcgcaacaatttaaatctttttttttgtggtaaattccaattaaattttaacagtgacatcgctgcaaatgccagccaattttcggcggcaattttggcacaaaatgccgacacgctgctggaggcaggcaacaaccgcatgagatgggaggaaacggacgacgaggagggcgaggaaattgagacactcggcgacgatcggagcataatttttggtgatcagggtgagtgtgacgagcacccattacttttgttgtttgaataactaatgattgttttttcaagaatcacttgtctatctaattatcagacacaatcactttcaatcgcttatttaatgctgcttaggctatttgggattgaaaaaacttaagtttgaaacccgattttggacattggcgcaaatgtcgggtaacagtgagcacaacggcaattaatcaataaattcaaaaaactcgtcccccgaatttattanaaatttccaaacagaaattttgcaaaaaaaaaaaaaatactttatacaaaaaattttcatgaaaaaatgtttttgcaatttttctaacgatttttcaaaattttattataaagtacttatttttagaagaaattttcaaaaaaaacgggtgaaaatttttttcaactttttttccc

SEQ ID NO: 27431 - DNA, 831 bp, Heterodera glycines
cgcccttgtattttggttaccccttgaaatcacatagggcgctgggatttttaacacaaattttttcccggacccgtgtaactccagtcggagctgtctgaccttcactagcttgccctgctttccgtaatggtccaccacgggttttgttgactccacaaatgtgtgcagtctgtttttgattgtctccacgttgtcatcacttcgtccacgccccatcagccgcttgaccagcgtttcatcgttggcctcgaaataaatgaccaaaacgggcgattggatccaaaaaatttggcattttgtagaaaattggcattttgggagaaatttatgggccaacctcttgctcaaagcgttctccttgtgtcacttcacgaggataccctaaaaggttaacatctatgtacttgttgaggagaagtgacaaaagtatgggcgtggggatagactggggttgggtcatttctgtcccaaaaatgaaaaactaattattttaaaataaaaatatttacacaaattttgtctttagaattatttatatttatgttattttaaataatttttaaaaatttaataatcataattatggccttttgccatatttatacaatttttttttacaatcaatgagaaaaccattcgatgattctcgctttttgagcatggccgccttcacaatggcaaaaactgtgccctaaatgcatttctttattaattatacaaggacgtgggtataattataaattatataaaataattacacaaaatgtatgtttaaatgatcgaaatttaatttttttaaaacttattttagaaatatattcacgaata

SEQ ID NO: 27432 - DNA, 1017 bp, Heterodera glycines
ccatttgtccattttttggcacttttgtccccttttgttgtccatttgtccccatgtgtcatccatttgtccattttagtggcactttcgtcctcttttattgtccatctgtcaattttttgtggcattttcgtttcgcttttgtcgtccatttgtccccttggcgactctcccccaattgtccgccatcatttcctattcagtcatcagtcattgtgtgttctgtcctctctccatttcacttcactacggagtagtacaacaacagacgcagcaacagaggcgggatcacaacaacggccgaagtggagccggcagcagtgaatcggtgagacatttgttggcatgacactttggggagtcaatggcaacacgtataatgggaactcgtacaataaaaatttgacagaataaagccttaagcctaagccaaaaaatgtgggagttcggactggaatcctgctaaatcccgtatgggatcccttccgctccgggctctactaattaacccttcccatttgtccaaatttgccatgtaaataattccaaaagcagcaacagtctggacgaatcatttgtatatagcaaatatataatagacgacgatgatgtatatcaaatcaaatacattcgaaattaaagctatgctgtggtgggtaataataataatataaatcctaaaggaccattataatcgggaaaccatccaataatcacattcataatcacagagcaattagtcgtcctcactgttgatcggcttcttcagaatggcatccatcatcttcaccgtttcgtgatagagcgtttgttcgttgccggcggcgggcgacgcacggcccgcgtaagtgaggccccggggctgacgcttcaggaagaaaaggaagcgccggtcctcatgcttcagcaaggagaggaagcgcggctgcacaaacgtccaggcgcccatgttctgttttgtggtggcaaaaagaaaatgaatgtgggacggacaatgagagggaagggggggggggg

SEQ ID NO: 27433 - DNA, 1719 bp, Heterodera glycines
aggaaaagaaactaacgaggattcccgtagtaacggcgagtgaactggggaagagtccagcgctgaatcgcagctcctctgggttgcgaggtgtagcgtatagaccgtgagcttgggttggcccgcttgttcaagtttcccttgaccggggctccagagaaggtgcaagacctgtccaactggcggtgcctatccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgtactgctagcctccagactggggtttgctgtccttctgttcagtggcgaatggggcatttgcaggcggagtgcgctgagatgctcggagtagctgcgtgagctcggtcttgaggccagccttttggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcacttgtgcgttctcggtgtaaaagccggtcatctgttcgacccgtcttgaaacacggaccaaggagtttagcgtatgcgcaagtcattgggtgttcaaaaccccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgctttactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacga

SEQ ID NO: 27434 - DNA, 1176 bp, Heterodera glycines
aaaagggcgatgaacggcgtggaaagaatgacttgctttccacaaatttaaaattgaatttttgtctttaaattttcaaaaaaataaaaatattcctcccatgccaaatgatctattaattaattaattaaattatttaattaattgctctgatttggtttggtttggcttcaccctgcttcttccgctccttcttctgtctctgcttttgctccttccctttcctccgatccctcgggctcttccattggcaaaatgaatctgatcaggtccatgaatgcctttgtgtgtccgtctgcggactccactgaatttgcctcctttttccacgcatttgcgctgttggcaaaaagtgcgaacaaaaaaatggcaacaaacggaagagagggaaaaatggtggacatttctttaattgcactaatttattattaaattgcttgaaatgtgaaaaatattagtttttggatttggttcgcccattgtgccgtatccgtcgcttttccgtctcacaaatgccctccttcccccctttcctttccccttttatacccccgtccctcccacttttccttcccccctttttgttttgaccttgaaccatccgaccggacaatgaattcagtccattcgccttttccttccttccgttttacttctccaattcatttcacccaattttttgcgctattttcagcaaagaatggaaattaatgaaataaaagcaaatgacagacgaatggggggaaaagcgcagccgaaaattggggtcggacgtaaagcgaagcgacaaaagcacaattaatcacaacacaaaacaaatacaaaacaataaatatattaatggattggaaatgaattaatcgctcttttgttggaggtaacacggcattttaaaatgggcaccaaacaatgctttaagagaagacaacgtggcacaaatgccaatgagcagagcaaaagctaaagtttggaatgggcagattatcatatgtttatttgggttttattttatgtactcacttattactgtaccgtacagtatcccttttgcccacagaatgaatttgctgaaattgaaatttacaaaagtcattccaaccattttttgatgagaaatgcaaacctttgcctttgttcgttcatttcgtgagaaaaatggaaagaacaaaatgaaaa

SEQ ID NO: 27435 - DNA, 1270 bp, Heterodera glycines
ctcctttctgctcacccaatgtcatcgtaaaggcggaagaacactttgttcaaattggcatccgaattttcgtccttcttctgctgctgtttctgaaccgccgccgcagtctccccaataattgggcatctctccaacagccaattgaattcaccagtgccatccttcgtcagtgtcagcttctcatttgtcacttcgttcaccaattcaaatggttcaattggcattggttccacacgaagataaaattgaatattgtaactgacagaagtggtggcacggcgaaatgtctaaacaagggtccatcgtcagcaattccatcggggaacagaccaacagaatcgattgaattcaattgatcaagatcagtgagaattgtcggtgaaatgcggcgacgcaatttgtccaaatcatcgccatacaaaaagctcaaatgccgaatgcttttcgcaaaaagtggccaaattatttgcttgttggaacgaagaaatgtgagcacagaatggtcaatgtaactgaagaaatataaaaattgctttaatatatacaaaagtctaaaattacttacttaatccaaaggctattaaagcgaattttggtgggcagcggacggtcgggaaatggaaatgccacgcatttgtcatcgatcagaacagacagtttcgcttttggtccttcgtccttgcgaattgtgattgttctccaaattgtcaattcgctttttccatcgaaatgtttgtccaccaaaacatcgaaacggtcggaaagcaatgccattttgaggccgagttgagcatggtcaaacgatggcataatgtccatccacacgtcgctacaaagccaactgagattcgtaaaaaaatgtatgggtaaatgaaaattttgtaattttaaaaaattccttaccgtcgattcatttttgtggctcaattttccctttttccaattgattggtgtgtcaaaaaaggcaaggcaaaactctgttgttatgtaacttaaaaagagagagttgggaaaaatgagagagcaaaaagaacgcaaaaacaattttgaaacagaaataaattcatcacattttttggcaaaaaacagacggagtatttgtaaaaaatattatttttttcaatttatccgctcaatcatttttatgcgtccaattatgtaccgtatatgctctaattatggcccagtctctattaataccgcagtctccaattatcccccccccccttgaagaacattggccccgaatgattgaattaaactgata

SEQ ID NO: 27436 - DNA, 1716 bp, Heterodera glycines
ccgacaaaattatgcaagatcacaaaagatgaaagtgaaaatgaagaaattaaatttaatatagactattattttattgacttcatcttctgaaacaaaacaaaaaaaaattactatttctgcgtttctgatttttggcgccgaaacgaccctggcgccgaaacggcggcgccgaaacgaccctggcgccgaaacggcggcgccgaaacgaccctggcgccgaaacggcggcgccgaaacgaccctggcgccgaaacggcggcgccgaaacgacccgttcccatttccttcaacttcacttcgccaacatttgctcgcgtacatacatacacatattgattttcattcacatttttcttctcgacaatattcctttgtttttccgtaattttaaattaaaaaaaacatttttaatcatttatttttaaaatttataaattaaatttatatgcattcattaattaatagggattccttttttaggcacaaaaaacgcaaataggcaaataaaaatttttattttgtctatatttcattgcaaatgaaagtaatttaaatatttcaacttttttttgaataaggccaatttttaaataaaaaattttatcaagaaaaaatttctaaatttagaggatcaatttcttggaaaacttttttacttcttaggcgtttattgtaaatcttaaaattattttatgatatatacgcgacgcattttacaataatagatttcaattaaattaacctgaaaatggagcaactttccgaaatttatgcaattcgcgcacttttgcgtcattattggaagaagggcaccaatgccgaggagacagtgcgcaaaatttgtgccgtcgaaggaccaaatgttgttgacattgaaacggcacacaattggttcagtcggtttgagtctggccacctaacacttgaaccaaagaaaacaatgtaaaattaaaatttatttttacgaatttgtacagaattttgggtaaatgtcaaattttttggcagcctatatctggattccatgttggacctggacctagatttcctggacaaaaaccctggaaacgccaggtccaggaaaaatccaggcttttcgaggcatggacctgattttttaaaattttttttgaaaaagcaaacaaatgttaaaaaaaaatcaattaattgctttggaacatataaaaatatttaattgaaaataacattttgtttttaaattttttaataattttttgaaaaacttaaaaatacatcggtcagatgaaataaaaattctaaaactttgcccaggaaatcaagcttttttcatatttgacatggatctggatatcctggataaaaatccctgaaaatccaggtccagaaaaaatctaggatgccgaaaaaaagttatccattgcagttggcttcccagcgaaacttgggacgaggtgttcaaatttgtgccattctctgacttgcaccaacacatccaaatgacttgccaacgtttctgggcactgtctgaacccattctcaacagactgtgcccacgtgtcgcaaaacccataaaaatttgttgggaaagcgaagtatgaaaaataataaaaaattattattatttttttaattggctaccaatcagtcgttaagttaaagatcaagcttttttagttagctaaggcagctagaggatttataaaacaataaaaaaggaatattattaacttt

SEQ ID NO: 27437 - DNA, 1576 bp, Heterodera glycines
cagttaaatagtaatttttgtctttcggcctcgtatgggtctgggttttcagtaccggtctcaggtctcgagaaattcggtctcgagcatcacattacggcattcatttcccaatacccaaaatgcttaagtggtccaaatttggattcaatcgccttagattaatttcgaatccaccgaaaaatttgtttctcagctcaacggtttattttatgtttggccaacgctttttttgcatcgagaattgagataagggggaaattgtgtgagaacgaagcggagacggcttgtggagggtgaatcgaatgaaagaatgaataaatggaagtgaatcatcgccaacgccaaagcggggaggggggggggggaaggcttatcgatggaaaatatttttaaaagaatttccaattttgtattgattttaggatttaaaaaaaaaattatgtccacttccccgggcttgggtttacgggtggctcagcaggaatactatgtatgtgagaaatgattaagctgaggaaaatcgagaaaatgcgtcggaaaaccgagactgagaaatgagtaaagaaagacgagaatccatagagattttcaacacgagagtcgagcagagattcaattttcagttgataaaattcaacaaaatggtacgatttggcaaccatttactcatcataaacagttttgattgattctgtcatttatttaaagcagcaggtattgttagtctatttgtatgtaatttttgtctatttttggtgtttttttgtgaaaatggacacaaaaaaccttgcaaaattggacacggaagaaagaaaggacaaacaaaaagcctaaaacataaaatatgcaaatttttttgtgcaaaaggacgcaccataaaagggagaggggggggggacgaaacggaagagagagaacaaaatttggggggggggggggggttttattttgttaatagctttacaatttttaatttgcttttcccaactgattgacaattagcacaaaatggatgaaacttttcaattttatgcaaaaggccgttgattttatttactgtgaaaaggcaaaacgaaaaatacctgttaatttatttaatgagtttttgggtcttttaattaattgacaagagattaaatgaaaaaaaacaaattaattttttatttaaaaaacaaaatattccaaccattcttaaacaataatgtctgcttcatcgacattttttctgcttttttccttttggtgccaactctaaacggttaattcattaataactagtgttgctctcggggtttttttttgggtcttggtctcgaatctcgggaaaattttcgttcttagcagcagcactgtttctgcaaaaataaatgaatttgagaaagaattgttgtatattatcaatttagtttttattttgtacatttcagcgcttagatgctatgacggcactgaataagatggccgcggggtaataaaaaaggtgtactgcccccccccccccctcaacaaccatgtgcatgaaatatgcgtgtgtgttgacaggtaaaattcaaagttttttttgaacacagaa

SEQ ID NO: 27438 - DNA, 1313 bp, Heterodera glycines
ttttttgggattttctagaaaaaaattgtataaaaaataagaaaaaaatgttttaaaaaattggggaggggtgaacagaaggtaaccgttattattttttacattataaatggttgataaaataagctgaagcacttactgatttgtccagcgcttgcttggcattttctcgggtgaaccgatccacaaaaatgcaatttgactgaaatagaaacggtccaattttatttaattagggcaattagaccaaaataaacggaccaaagtggcaccgatgttgaagaatggcacatattgcaacgatttcttcatcatcacagtgcatttagatggccaaaacatggagagaacgtacaggtccaaagtgctctgaaaagcatgcattttgaaattaaaaggaatatttaatgtcgggtacacttccttccccccaaatttttttttaaaattttcaacctagaaaatttcaaaaaaaaaattcttttgaaaatttctcaaccgattatttcataattttaagatgaactactagaagggtgatggggatacggatacttttcaacaaaaattgccaattttgtggattttcgaaaaaatttagccaaattttttggaaaatttgtttaacaaaaaacacgctttgtctggagagatctttgggcgaggggggagaggggtggggggattagagttttcttagagattaataataatgtcccacctgatggttggaaatgatcaccagtgggttctgttccgtgccgccgctggcgcgctcaatgcgttccgcgccgcgcacttccaccgtcacgtccagccaaaaggagcagaagaagttgaacgcggagaaggcgaacacacagccctttgaaccgaaaaaattggataatttttcagtgctggagaaaatttattttttatttttttgaaatttgaagaattaattcggtcccggatttgtgaatagaccaaaatgaatgcaatattaatagccaatattcgcgacccgtgtcccaaaaaaaccaaccagaaattatagtagcaaaaaatttttttttttttttttgccaaaaaagaggaggtggacggacctcaccgcgtcgattcacccttttttaataagaaaattaaaaaaaaattaactagaaaaaaaactagtagtatttcatcataaaattcgaaggacaacatttttttttcataaatttgtttaaaaaaattaaaaatttttcgagggggtgatgaagtaatcacacgcattaataacaataaaaacatgaaaccctatacttcgttggcccagaaagtgaaca

SEQ ID NO: 27439 - DNA, 1883 bp, Heterodera glycines
attttaccagttttatccggtccccggattcttaaattggatcgagaattttttccccgaatttacaattggcccgaaaattaggaagtaagacccggatttaactattcaaatttaaccccagcaggtactgtaagaacccttagtccctaaagctccgggattttgagcccggttttgggtttcccggaagttgcggaatttggtttaaacctatttttggctcggttcaaaattcgaaaaattcaaagatttgacacttctaactttttttaaaacgatcgaatcctgataaatttggtatcatccgaaagcttttggggagctaagtctaaaaagtagtgaaaaattttcttggatgttttaatttcactgtctattaatatttatacttttggtacggaaatggctggtatggaaacggcggcatggaattgaccccaacccgtatgtttggttatttttttgggttttaggctttttaaaaaggaagaaaaatataatgttttaagctgaaagattactagagattaagttttaatcgaattctaaccatcaagctaaatgtacacatgaattcgaattaaagaaaataaaataattttgttttccttcccccccaatttctgtcattaatttttcattcaaaaatcagagccccacactcttcagtgtttttccgagttttaagaaaagaaaatggcagagattaaaattccgcaaataaaaaattatcatcgcaaaaattgtcataccgtctgtatcaaaattataaaatctttaatttcttattgtgtccaatttccgaaccaaattaagatgggactaattagaatttcctcttaaatgccgaacattttcttgaagaaaactcagttctggtcgtttgaaataaaattgattatttcaataacaaatataaattagcacagcaaatcatagcatcagtttctcgcaaatttgggccctcttaactttgggtcgccattctccgcgttctccattttgaccatccgtgtgcctgaaatagaaagtgcattttaaaattcaacttaaattaaatttaaaaaatggctgacattacaaaaaactgaccaaattgcatcgcacgcttaggccgctgcacaaaacattccggcacgcccaaagagcggagggcgttgcgcaacaaaaatttgttggcggtgccgtcattggtcggcagtccgaagccggtcttcaacgcggtcggcaaagtgttcagccagcagaccaacggctcctcaaggaacggtgccctgaacgaagatgatgatcgtttattgaaagcagcaaaagggcatataaaaggctaactcacagaaggcttttgccattcactgtgccaattcggtcgtccctgccaaaattgcgtgctccgatccgatgcatttccatggacaattcctccgcaactccgtccaatcctttgctaaagaattttcagtaaatctgcacatttttagtggacgaacaacaaacaccttttgaaaacagtttggtgccgagcatagccacctttataataacaaaaataataattaataataataataataaatttccaacgaaaaatagatttaaaaagagcgaaaaaatcttttttcattaaaagatttaagtgattttatttgaatgcaccgagttgttcatcagagccggagccaaccaaagcaaattgagaagggcaaaggctaaacgaatagacgaagaattaatgaataatttaaaaaataaattaattaattttcgtgaactataattttggtgagctattaatcacatttgttgcccagtttcgaaatcgatgcctttcattcgcgaaacgaaccacaaaacacagccaatggagtcgtccaacacct

SEQ ID NO: 27440 - DNA, 1288 bp, Heterodera glycines
acgatgaccgtgtcgaatgtgctggtgttgctggacacacgctcaaaatgcaccaactccacttcgtcaagtgtgacaacaaatggaggctaaaacggaaatgaaaatgccaaattctgttctcaatattcagaaaatgaacccattctgtgaggtgcaccaaacatgacgaggtcggtttcagagaaacggtggaccgatggggggcaccgatgaacgacaagtcattgaacggcgtgtcaaagtccacctgctcattggtcatccgaaacactttgtcacagaagttctggaaggccatgttcagcttcttgcgcatttcgcgttccatcttaagcatttattaaaaattaaattcaaaacgtaagattttgcaattaaatattaaattaaattgcctgctcgctctgaatgtcgtccctgtcttgcatgtgatggtacttgcccaagtcggtggtgatctcgccaacttcagtgaagaattgcacatccgaatatttctttttgccccacagcaccggattctgtgtgaccaatcgaattgatcaaaaatcaaaaagaaagaccttcaaatggaagtgcaacagaatgatcatttcgttgtcacacggctggaagaaggcgtgcttgatgttgttgtacatcacctcaattttgtcgccgcgcaacgacgtgtaacggaaaccgttgacatgtgcctcaagcgtgccactgatgcgttttgcgatgatgttcggtcgcacgtacaaatcctgaacaaagtcttggatgtgcatttcaacaatcatttctcaaatccccccgttcccggatgtcacacctttagcttcgggtttcccttgccgttggttgaaatgatcagtttgtcctgtttgaccgcgccctccttctcccgctcctccgcttcctgggtgcggaatcgcttttgcatctccttgatcagtcgagcggccgtctgcaaatttacgctgggcgtctcgcgttcgcccggctcgcgcacattgcgacttttgaaagtgctgaaattggacagacaattaaactgaagaacacacacacaaaaccacgtacagttccttcaaatatttggcgaatgcgttgggaaactgtgcgctctctttgccaatttgggagccggggtgggtgaaattgatacgcaaataggtgaagtcgccctcattggtcggctgactgatgtttttgatcatcgaaatgtgaaagggcgtcggaatgccaaaaatgggcacaatcactgtgtcgtggcgtttatctgtggaaattggcaatg

SEQ ID NO: 27441 - DNA, 1034 bp, Heterodera glycines
ttctctttagaaagagttacattttttaaatgacagattttcgcatgaaaagaagattcttaggggcgtattttccgtttttggtagtagagggaaataattcaaatatttgcaattccctctcttgagctctttgaccccatattgattttttccccattcattcatgccctcccttcttccatcctcattcattgtgttattttccttcctattttgtgcttccccaatttgctccgtccctccgacaaactctacgacatgcgaaggatatcagacgcgccttagcatgaaataaaatttgataatcaattgaaataatagtgaatgaaaatatcaaatattttatacgaattaatggtaatagtttagatggtatgacaccttttttgaaaaatttttcaaaattttcaaaagtcttaaaaacatgtttctaggggtttataggtacgctgagcacgaatctgacatccatttcgaccaattcccaaccccggacccgaattcgaacaaaaagtcgaaaattcatttttcatcaaaattcacattcatgcaactaaagcaatacaaatgcacgaaaagacgcataaagatatattttgcgttctcttttatgtttccagcttattaattaatatggctgcgttggaagcgtttcggaatttctcgctgaaaaaattgcacgaaaaatttttcaaaaaaggtgtcataccatctaaactattacccgcgtcgctttgtgcggagtgtcgccgccttttatttggtcggagttctgctctgcctctttctgtccgttcttttcttcggctttttgctgcaacggattattccccttccgagcgtaaaaccaataaaaaaaaaacaaaggaaaatgccatcggagttttgtcggctttaggtcgccaaattgccgcttttcttcggcgtatggcctttgtctttctacgtttattatttgctgtggacaaatttcggtttgattttgcgccaatacaaattttacgccataatttatttgctgagttttaatt

SEQ ID NO: 27442 - DNA, 1593 bp, Heterodera glycines
cctctctctctcccaatctctctctctcttactctctcttacctctctctttatctcttactctctctttcctctctctctctcccagtctctctctctctcttactctctcttacctctctctctctctctcctagtctccttctcgctctttgtcgaaagtcatagcaatacaagaaaatatcacagaatccgctccccattgacggttactgtctctaagatggcatatggggaaatggtggatacggtggtgcatttgatgcagccggcgcctgaattatcccaccgattgattgggttggatgagagggattaattggaatccaagcggacgaacaaaccgaccagtgcccccccccccctcctgcaaattggttgttgtggcgttgctcttccgtttttagtttatttttttttgaatttttgtccaaattaaactcgtcccctttcggcttttcctatgatgaaatccctgtttccgagtctcgacatccctgatatttcccactccaaacaaaatctcgacgacaaaatctcgacgaaagggatgtctctctctctctctcccccattctctccaactttgtcctcaccactcacttttgccattcgtcgccgcttttcgccgccaaatgccccccaggggacacatttttgggtgtggccaagtgcgaagaatggcaaagatgggaatggatgggctgctggatgtgtcaccaagggcatccatttggacggcgtaaaaagaaaagtcgcctcggggggggggggggggcaaagattgcatttgtttttggtgcgctgcgcgttcattggacgaattgtactggtcaattttgctccattcgttcttaagaccccggatggttttcagtagtaagtggatgaaaacttaaaaatgcaaattcaaaaacggcgtcaaaaagtcgaaccaatacctgtaaatttatgatttaataaataggggtcaattggtttaacatttattatgccaatatttcaaatttgtccacaaatttctctgggaaaattaatgtcacccgacaataccgtaagccacgggaaaagagacttgcccccccccgcaatcccctccccccaatgtataaaaccccaagtcgacgattttgccactttttgacggtaaaaagtgccgtgcgacactttgaagggattttagcgccaaaatttgcaagtcattgccgggaaatgacaaattacccgtcaccggagggcatgccgataaaatctccgcagaaagagtggccaaaggcacatttcaaggaggaagggagccgcaattataataatgggatgggaaattgagaaaaataatgcaaaaaattacaaaattaataaaaggaaacattggttctattgtaaaattttaaccatttttgccaaatgagcttctatgccgagatatgacgtgccaaactttttggcattttataattagaaaagatatacctaattatttcaattttcataagaagccattggtgcagaggttgtgagttagtcaaatcctttttaagtcataggttagaatcctctgcgtgcatgtatatattttataattttgatttt

SEQ ID NO: 27443 - DNA, 994 bp, Heterodera glycines
tttttttgcgttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccgaatagcttcctatagcctgtactttattctgcgttggatttttgctccccattaattgttgagtaccccaacggacacttgaaaaatcgatttttttgttt

SEQ ID NO: 27444 - DNA, 1334 bp, Heterodera glycines
  misc_feature (1325)..(1325): n is a, c, g, or t
gctttttctccatcgctccgacttatccttgacgcgtcaccgataattgggtgtcatgtgaatgggcttttcctcaggtggcaaatcgacacggccaatggcaaaagaaagtggaggaaggaattggatgcggaagcggaggagggggcgaagtgggaggaggaggagaagccgtgggatgtactcgacttaccaatcattggaaaattggaggtgggcaccagggactggacgttcccaggatttcggcttggggggggggtaccccactttttagcttgcttttcgcaccactttttttgcggcgcactttttaacaaaaatatgtggtgatcaagggggtccgcggtgccgataggtgctgctaggagggaaaatatttacccgtgcctagaaggcattttgctgccaacctctaaataaatgtgtcataaatttcagatttggattaatgaccaaacgtccagaaaactgctgcaaaagtgtctgatcagtgccgtcaacaatttgatcaaaacattggaaatcccttttaatgcgacgaaacaattcgccttccgcgtccgagtttatggcgatgaatattttgacaacaaatataccgcaagtctgaagatgtgcagcatcaaaacattcaaagcgcttaacccctagattaatgaagaaaacattttgaaatttcgttatcattttcatattaaatttgtaattttattttagtaataatattattggctttgaatcataaataaattattaataaaataataattattttcttaaatttgcttaaaacaaacactttattctttaccgctaacaaaacaaccagatttttgaaagaaatgttggtaccataaaaaactgttaattgccaaatgaataattactatagcagaccaattgacctgtcatataacttgaacgaaaattaatgtgcataaataatatcgaaaaattgattaattaattaaatttattttttcttttttaattttcaaattttgttaaaattatgtatgctaattgacaaaataacaaacaaaaccctagttggaaaaccaaaaaataaataaaacgaataaaagcagagcagtagcaatttttgtttgtgatattcttttaggaaatgataataaattgaaaatcccttcgaatattttataactacaagataaacttaattctattagtagagctcgcaaaaaaaggcaccaaaaatcgcgaaaaaggcactaaaataggcaccaaaaaattgaaaaaaggcatatgcctcaaaatgcgagctctatctattagatataattttaagataaaaaaaatanataaaacat

SEQ ID NO: 27445 - DNA, 988 bp, Heterodera glycines
cgacagaaacaaatggagagacggacacctgctgagaatggacggagaaaggacaaaattatgaaaaaaaacttcataaaaaacgccaatttattaagtaagaaaaatgttttgtactaagaaaccgtggatggtcattaattggacttaacattaattgttggacgcataaaaatcgattagacgcataaattaataatagaattattgatccattccactgttcagagaaaagtaccatctctttttacaaacatttttcggttttttattctcctcatttatagatacataatattcccttttagttaatctaatttaatcctaattggcaacaaatgtcagacaatccctgcaaagtcgaaaaacaaatggcaaaagcaatgtaattttgagtctgtatttttatgtttaaattcatcatttttccgtttttcagcttcatctccggcgacggttggctggcggtgttccatttgctcccgccttctcaacttggccttggaatcgcactgatcagcccccgatttgaccactttgtggacgaacatttcaaaacgcgaaaatgggcattgggcaatatacgaattcgaagcaaaattggacagaatggcacaaaagaaatggaaattataaattccgatttgaaattgctgccaattgcgcaaaatccgccgccaaaaaaagtcattggattcaacagaatttcgataaggtaaaattgaggaaatgaaatgattgttgggtaatagtttttttgctagttaaaaaaaaaatctattttagaacataaaaatggattttgaaaaattcaaatttttgacttttgtcccgaattcgggtccgggggttctaaataggccaaaatgaatggcatattttatgatcagtgaccccaaaaatccttagaaatatgttcccacgacatttttaaacaaaaaaaaaagaattttgccaaaaaagggggggagcatctaaaaaattactg

SEQ ID NO: 27446 - DNA, 1185 bp, Heterodera glycines
ttgtgctttcctccgtctgatcagcggataaaatgtgataggtgcacacctgcactttgcacccgtcctccggatcaatttcttcgctctgtcggcattttttttttaatttttggcattttatttgccattttcaaattcaaaaatgggcacctcctccacactgagcaacgtgccaccgtccatgtccatgtcggcgaggaggcgaccattcaaagaacagctcgaatttgtcggcatcagcagcacattctgatgcgactcggtagaatgaatggggggcggaggctaaaaaaataaaatcaaaatcaaaatatttttgatttaaaataattttaaataaaataatttaaaaaattttaatatttatttactttctctttgtcgtcattgttcagcccattggaatgttttgcagcagccacaagcatttttgttgagaaaatattttgtggtaaagcttttttaaaatcattttaaattaattttaaataaaataaattaaaaattattttaaatgcatttaaatgaaatgtttttattcatttgtgtgggaaggaatgtaaaaaaacaaagtgaaaaaatgagtgagtcattcgcttctcttcactttacataaacacatcgaaacatttatttattgaatgaatgaaattgtgacgacaaaacagtgatcagaccggaaacaaaacgaatttgtaagaccatttttcgaatagcggaattttcagtccgtccaattccgggaagcaaacgaagtccaaatcatgatcatggactttgtgtcatgatttcgagattcgattgggcatctcgtttaatagggggatgctcgtgatttttgagacgacaaattcatcggatttttaggatatcggtctcgactttcagggataatatttctcgcttctcaaatgagaaattcctcggattttcggggaccttggtcctaaatctcgggaatcaattctcgatctctgtcttgtaggattttttggggttttcagtaccgattcgcgggatcaatttgtcggcttcagtttttcagtcggataaaattttgactctatgacaaacgctagtgtgtttatctacaaatcagatggccgtgaactgctcgaatttgatctcggacatgcactgacagtcagtccatcatcaaatttaaatcataaaatggaaaaa

SEQ ID NO: 27447 - DNA, 850 bp, Heterodera glycines
ttgctaaactttgcacagtcaattttccatttttgtaaattcattaaatcgtcaatttttccttttttaaaaaattccttaactatatttccttttttctaaaaattctttaaatcgtcaatttttccttttttaatttctttaaatcgtcaatttttccattttgttttttgccagaaattaaattaaatgcatcaataaatgtccgtggggaaaaacatgagagcaaagaaattcatttttaatgcatatgtatgcaaaaaatcaaaatttaatggcaaaaacattgctaaaaagctgtctctctttgcttggtatttatttatatacaaaaagctgtttttacaaataaatttttttactaactcgagactgaagatttgcgcccaaatactcgagagcgagaaattaaaaaaaaatttcaactaaaaaacgacctctcaaatttggcttttcacaaaatttactcatttttgaaatgaaaggtgtcaaaaaactccgattttgagattacatccaagattgaatgaggcattaaaacatccatccattagtactctcggcattacattttcgagacttggactctcgaagaaaacgggtcacatggtcagcgtaatctttggcctgctgatcattggcataatatttttcatttccaccaatacatcagtcaagtcagtttcacactttaatccattccttcaccgtttcacaaacttaacaacacaccgccgcacaaaaacaacaaaaaatgcaattcccaacctcatcatcatcatcattaataattcatcataaactaaacataagtgattacatatgtatcccaatttaatatatttttgtg

SEQ ID NO: 27448 - DNA, 709 bp, Heterodera glycines
tttggccctgacctttttgaatggtcatagcgaatgcctttcttgttgggaactgcaaacgctcatattttatgccgccaggcgatttgtcttcatagacatttcgtgttctttcaagaaagaatctcacttggccgccaatagcattgctattgataacacgaccaatgaggcgatcatcgccaagttcttccagaactatgcgtgtgccattgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgttgacttcatcacacgtgtcaatgtgcggagcgagaatcaaacgattgagcaactctttgtcattgccaaggagttgttggaagttaggatagacataatctatcagctcttccttgctcttaacgaggaactgcggaggaatccagaagtgctctccggtttctccgagcccgatttggcggcacatttgcaagtacgcttgctgaccttggcccagtctctggttgatggtcaatttcatcgtggtgaattgaccaaacaacggagacgtttgaaa

SEQ ID NO: 27449 - DNA, 1836 bp, Heterodera glycines
  misc_feature (93)..(93): n is a, c, g, or t
gataatttttctagatgttgtttcatatctcaatacattatttatcgcttttaaatgaatgggaaatgaattgtcagtaacaaaaaaaatatnttgtgaacatttataacaaaaatttttttagcattttctaaagaggctttttgacttcaatcataattatattgtcaattgtttgaaacgcatctgttgccgttggaaaaggccgatggaaaatttttcggcttttcgcgaaaaagttttcccagaaaatggcgtgggacaaataaaaattgtacttttattatgagcaatatatatttcctatcaatttcgggtttgctttacacgtttgccaatgaaaaaatggagttttgtgaatgcaaattttaacagattttctttcgaagtgtcataagcgggttgtttcgggacaaatgcaaaccaatttgatgctattcgaatgagctaggcgcgctctaccctttcatttgtatcaacaaagggtctaccgccactccctggcgagatatggccagtcaaagcagagtgggtctaataaaacaagaatttttaaaattttcggcatttgcccttatttcgagcctgctctacgtgtgcttcttttgccaatatggccctgctatagaaatcttgtaatggttcacgactaagtgatgaaatatttttagcccatttcttttctatccaagcatgcgaattgtttattgcattttatagcattctggaaaaagatagtcagtaaaaataaagcttgttttaggaatatttgagtatatttacaacaacaatttttgggcaatttctaaagatgaaggaaaataatttttttatcaatattttatattaagttatgtttttgaattgattgaccctatcaaatgaacagtgatgcagttgtaaaatttttcggcttctcgcgcaaagtttttcctggactgtttctgacagattgttgagataatttttctagatgtttgttcatatctcaatacattatttatcgcttttaaattgaatggaaatgaattgtcagtaacaaaaaaaatattttgtgaacatttataacaaaatttttttaagcattttctaaagaggctttttgacttcaatcataattatattgtcaattgtttggaacgcatctgttgccgttggaagaggccgatggaaatttttcggcttttcgcggaaaagttttcccagaaaatggcgtgggacaaataaaaattgtacttttattatgagcaatatatatttcctatcaatttcgggtttgctttacacgtttgccaatgaaaaaatggagtttgtgaatgcaaattttaacggattttctttagacgtgtcatgagcgggttgtttcgggacaaatgcaaaccaatttgatgctattcgaatgagctaggcgcgctctaccctttcaaatgtatcaacaaagggtctaccgccactccctggcgagatatggccagtcaaagcagagtggggctaataaaacaagaatttttaaaattttcggcatttgcccttatttcgagcctgctctacgtgtgcttcttttgccaatatggccctgctatagaaatcttgtaatggttcacgactaagtgatgaaatatttttagcccatttcttttctatccaagcatgcgaattgtttattgcattttatagccttctggaaaaagatagtcagtaaaaataaagcttgttttaggaatatttgagtatatttacaacaacaatttttgtgcaatttctaaagatgaaggaaaaaaatttttttatacatattttatattaagttatgttttttgaaatgattgaccctat

SEQ ID NO: 27450 - DNA, 814 bp, Heterodera glycines
cagcgtctgcatgacgatcttcaaaggacaatttttgaaagaaaaacaactagccatcgtacctgaatgtggttatgagcgaaacgaccgggccagtgtttttgccataaagtaccttgattggcgctcaaaaaaagacggaacacgcatacagcacgcaggaaatggacttgaaaagcgttggcggcaatttaggctggacggatggattgaggagcagaataagtgcattgaagtgttaggctgttactggcacggatgcgaacgatgtttcaaacctgacgaccggctggtggacggaaaaacatgcagagagctcaacgaattaacccagcttcgcctactaaagttgtgtgaacctgggtcaccagacgatgcgcaaactggattgaccattgaggcaatttgggagtgtcagatccgagaacagctctcaagggatccggagatgagagatttttttgacgatctgggaacggatcggggaccaattgatccacggcaggcttattacggcggcaggaccgggccattgcagctgattgttgagccaaaagaggatgaaaaaatatctgttttcgacattatatcgttatatccgtgggtcaattattccactaactatccggttggcgttccgtcaataatccacccgaccgctgaggagatgattgttgactggacacgagctgaacaattacaatttcgtggaatttaccgggtccgcgtgatccctccgcggggacttcgaatacccgttttaccgctcaaaattgacgaccgcctcctgttctgctgctgccaccgttgtgcc

SEQ ID NO: 27451 - DNA, 1336 bp, Heterodera glycines
ggggttaaaacttaaaaatgcatatttttattgtgttcgttgtatcaaaaacacctccaagttttgcaaatttcgaaaaattctcattaaaaaaaaagaaatgttcgcaaaaaaatgacgaaaatatttattgaaaatgccaaaatgacgacgaaaactcaaatttttcgtgttttttggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctattcattaaacttggctcagactaaaccggccagactaaactgtcccccaccccatcataggtcgtctgaaattccattttcacaaattccattatccattttaaatttttttggctatgacgcagcatggacatgcaaaaggcagccaagttcaagccgagaaacagcctcaagagctggacgattcttctcgaatggaattgtagtggagaagcgcaaccgtcggaacacatgaacaaggataatcttcagctccaaagtggcaaatcgattacctgcaaatttaattattaatagtttcgagaatttatttttatgatttatcccattaaaaattttaaattttcatatttttgacagttttgaggagtttatttgtttgttcggacctgttcaaaagtgccatttactaatcgagttttggggatttcggtaaaaatcagttacggtaattaccggtttttaccgttactgtaacagtaaattaaggactttttcatgttttagctcctccacaccagggatgggctttcgcgtttcgctttcgcatatttcgcttttttttttgtactttcgctttcgcgtttcacattttggcacgaaacgcgaatattacacccctaagaatgagggatgagttgccctaaaattttcagaatttgataaataaattgactaattttcagtgaaaacatgtttaaaaatggtcaaaatttccaatttctcccccggcggcccttatcggcacagccgcgccccaaaatctcctatttttaatagtaaaatgacacaaaaacgcaaaatttggtaatttttttagtgaaaatctgttaaaaaattatattcaaattttcaaaatttttcccggc

SEQ ID NO: 27452 - DNA, 912 bp, Heterodera glycines
agagagtgggatttatttcgtggctattgacttttattattgccatggcatatagaatatgcgaatacgtaagaattggcagagattgggttttatttcgtggctattgacttttattattgccatgacatatagaatatgcgaatacgtaagaattggcatagagtgggatttatttcgtggctattgactttattattgccatggcatatagaatatgcgaatacgtaagaattggcagagagtgggatttatttcgtggctattgacttttattattgccatggcatatagaatatgcgaatacgtaagaattggcagagagtgggatttatttcgtggctattgacttttattattgccatggcatatagaatatgcgaatacgtaagaattggcagagagtgggttttatttcgtggctattgacttttattattgccatgacatatagaatatgcgaatacgtaagaattggcatagagtgggatttatttcgtggctattgactttattattgccatggcatatagaatatgcgaatacgtaagaattggcagagagtgggatttatttcgtggctattgacttttattattgccatggcatatagaatatgcgaatacgtaagaattggcagagagtgggatttatttcgtggctattgacttttattattgccatggcatatagaatatgcgaatacgtaagaattggcagagagtgggttttatttcgtggctattgacttttattattgccatgacatatagaatatgcgaatacgtaagaattggcatagagtgggttttatttcgtggctattgacttttattattgccatgacatatagaatatgcgaatacgtaagaattggcatagagtgggatttatttcgtggctattgacttt

SEQ ID NO: 27453 - DNA, 1005 bp, Heterodera glycines
gaaaaatttttttccttctctttagaaagtgtcaaaaaatttttgtgtttaatattcagaaaacgtgtttttttagtgacaattttttttcaagagaaggggatatgaacaatcacttataaggctcatgcttggagataaaggaatcggaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaatagcatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaa

SEQ ID NO: 27454 - DNA, 1378 bp, Heterodera glycines
  misc_feature (17)..(17): n is a, c, g, or t
  misc_feature (57)..(57): n is a, c, g, or t
  misc_feature (61)..(61): n is a, c, g, or t
  misc_feature (98)..(98): n is a, c, g, or t
  misc_feature (107)..(107): n is a, c, g, or t
  misc_feature (1325)..(1325): n is a, c, g, or t
aaaaaggaaaaaaatgncagtcaaaaattatcgattttctccaatttgtttccatanttcngaaagtattcggtatcatatgccaaaacaaaacgaantcgttttanatatcctttctgactgactggttttcttgatatcgaagctgtttctacgctattctaaaacggttataccaaaccccagattttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaacaatatttcacatttcactccataactttgtgangtcggcacggatcgagaccgggataagacattggaaagagcagctcgagctct

SEQ ID NO: 27455 - DNA, 1228 bp, Heterodera glycines
  misc_feature (1142)..(1142): n is a, c, g, or t
atggacaacgacaattggaggaagcggaaaacgaagagtctgtggacgacctcgaccagtttctacacgactgtgtggcgattgacgatagcgatgttaattttgatgagacagatgcaagagatgcggaagaccaaatggaaattgacgaagaggacgacgatgaggagggagagagagaaacgaacaaccaattggacaatggccaaagagcgacgaaatcgaccgctaaagtcgttgctaacccggacaacctcaacaaactctttatgccgttgcccaaacttaacgaacagcttttacgtgatgaagttgacgtggaccaattggaacatcaattgacggagttggaaaagcggaagcggaaacaatctgttgccaacctgacattggtgctcgacttcttcgctaaggttgacggactgacacgtaaatgtgtaagactcattttagttgaaaaaataccaaactgagttcaaagaactcgccgccatcactgagcaacgcgatttacaccgggcctttcatgatcggctgaagaagcaacgcttgcacgaatttatggaaggattccgagagattgcgacagaattgcggatcacttatcagatgatcaccatccaaggagatgtatcacttggtaacgttcctccttttatttatttttttactgtttttcatccagaattggttgattcgcttgatccattcgccgaaggcattgccttcaatgttcgtccccccaaaaagtcatggaagcagatcaccaacctttcgggtggtgagaagaccctcgcctctctttcactggtgttcggtttgcacaagtataaaccgactccattatacgtaatggacgaaattgacgcggctttggacttccgaaacgtttccatcatcgccaattatcttctggtaaatcttcccactgtagcacattttttaaaattaaatttaatccgccgtcatttattaaggagcgtactcggaatgcccagtttattgtgatttcattgcgcaatcaaatgtacgaaaaggccaaccgactgatcggcatttacaaagtgcgtgactgcactaagaatgtggtcgtcaatccgtctgccatgagcaaggcttttgaacaggacaagaaacggaanagcaacccttaaccgataaaccattttccgatctcacttatttaactctttggttctctctttgcaaataaataatttttgacttt

SEQ ID NO: 27456 - DNA, 920 bp, Heterodera glycines
ccccccccccaactcatttgtacctattagtccccacccccttatggtcacactccttcgccctccccttagccattcccctcaaactctccccctcccccctccctccccgcgctgtccatctctccaaaactgctccaccgaaatgcaaataatcccacaccttcagctcccctccccccgccaattcgtttcgccaaatccaaaactcgtcttccatttatacgcccctcaatatcaatgcatttgaagcaatttcgcaccattaaattcggcaataaagcacgtgcatgtattgtacatacaataaaatgcagtgaatcagtgattgatggtcgaatgaacgaattgaattggatgaatgcttcgattggcaacacgcgcataacaaaattcgaaactataggaactgcttacaaatcagcagaagcaaatatttatccaaataatgaacaaaatttaatagtctttatttgctttttaaattatttgcaattatttaatcaacgcccctttttgccgttatcacagagtaccgccgagtcggcatgtccttttcatgctctgctttctgtaactgttgtccatccgttacgccaattatcactcatttatcatttccaattatctctcatctgtcgtgtccgtccctttttgctgctatttttggtgcgttcgttccgcacttttcttcgtccgtccgtccgtccgtttgccgtcatccattttctcacgccattgtttttgccgatccgtcgttgatcgcctcgaaaatcaaaatccgccgtcctcagttgttttattacaacaccacaacaacagcacataactctctatctctcccacctcttttttacaacccgacaaccattttatcttctgcgtctccccctccctccgaccgaatttccatccaatcc

SEQ ID NO: 27457 - DNA, 997 bp, Heterodera glycines
tccaagacttaaaactgggagaagcaaggggctgtggctgggggcctaaaatttggggccacattgggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaatttgggagaattcgaataattttttgactgcaaattttttttctttttt

SEQ ID NO: 27458 - DNA, 1676 bp, Heterodera glycines
tctcacccatccccggcgtggccatgccaatccgactgacgaccacttgcggaattgcccaccatgccaatttgcgactttggcccaacggcacaccatttgaatcaaccacttggacaccgtcaacaaactccctgcaaaaaagatgaaattcaaaaatgcatgcattttttttgtgccgcactttcgtcgcatcatcggaatgttgacacaatttgcaaatgcaacggccgcgaatggcacaaggcgaccccaaattggtggcattttctgtagaggaaaaaatttttcaaaaaatttgtaggcatcgctaaacaccgaccgtcgctgcatgattcagtcccaacgcaacgcccatcgctccacctacaatttgagaatcatagaacagacaggacaatcaaaaactggaaatttttttcgaaaaattttttttaattttcccacccgttgccatcagatacgcctgcaaaagttgtgcgccgctcaacgcatcgcccgaacggttagagtaattgacagtggcattgtacgtcttgaaaatgtgccaaaaaatttgggggaaaatgagaaattccgggcacttttgctgttggggccccaagaaaaaaaatcagaaaggactcttttgcttttttgttaaaataattcggaaaatttgtttgaatgcggtttccgaggttgctggctgatcacaatctgacatatattccaacaaatcattagcccgaactcgaacaaacagtcgaattgaaaaaatttcaaagtacaccctttggttttttcctggggcgccacaacagcaaaagtcgaaatttgttaagttttttttccacctggttaatgaattgccaccctacaaccgcaggagtagacctgtgaaaaattaacaattataaaatgcatcatgacaaaaaaaaacgggcgttgaaccgacttgtagaagctgagcatgccgccggtactaaaaaattttcaacaaattttggaaaaatggttgcaaaaatgggacggacatgatcgtattagctggcacttgtgcactcatccgtccgatcagcaacagtttttcgcccgtttgcggatggaatgccgagtcgtacagatgtttggcacgccataactcatcgacggacaaattgtcggagtatttgcctttcctggaaaaaaaatgggagaaaaatttatgtaattaatgtcatttttaatggagctttttggattaaaacaacagaggattttatgaaggaaagaagaaagttgacggataacaaatgaaatctcaattcccataagcgaatttcaatagtcaaaatttttgagagggttcgtccgcctaaaaacgaaggaattcatccagcgaagtaacaaaaattcttaaggattgaactcaaattcaatagagttttcaacgaaattttcaaggtagggttggcctgattaaaaaatccggtcatagaaaccttagtgtgcttttttcaaagtattttcgatgaaaactttttttggtacttttccattatgcggccacaccccaaaattgtaaagcgccagttttgtgcaaaaaattatttaggaggcataaaagccgcaattttagctaaaatgtcatcgaatgtatcgtcatcgtcctttaaagcacgcaaaaaatatttaggaggcataaaagcggggcg

SEQ ID NO: 27459 - DNA, 846 bp, Heterodera glycines
tttttatttgttcaaattttattatttcatttaaaaacattatctaaaagaaaaatggaagtgattaatgtgttacattaatataaggacaccttattttttgttagttcccatgaaccgatcgagttgaaattttaactgtacgtagcgattctgaaaatattaagattctaacagtgacaagacgaaaggatttcggaaaaaaattttatggatttttttttcaaaaaaggggtgttacataaatataaggacactttggaatactgagaaaagcctcaacaactacaaaaaagaaactgataaaacaagctaaataataaagaataaatcttttttcacatttctgtttattttgcgaacagaaatatatcttttagggagagttatgttgaattttctaagttttcaggagaaattaagggccaaaaggcttaaatcgcctctaacatttgcctaaccgaatcaaactaacagcaaccaacactaagataacgtacagacatcctataagcatttttattcactttatgccagaaaaaattcattaaacacaaaatttttgcgggtgaaaaaatacgaaaatctgagtaaattcgaaaaaaattctagggggttgggaaaaagtttccgtagaagatgaatatgacgaacagaaagagcacaaaattctctacaaaatggcctttggatgattgctctatggcaagtattcgctgacaaatgaggagcgtttggttaaacacgaatgtcgcaaaaagtaaggaaaatggctaaaaattggtcatttttgtggttgttgatatttagccaaatgctcctcagcggaaacgcggcatagtgccc

SEQ ID NO: 27460 - DNA, 1325 bp, Heterodera glycines
  misc_feature (228)..(228): n is a, c, g, or t
tcaaagtatgctttatatgcatacagagagttagagcataaatctcgcgtcatgggacgctaatttttagttctttatccaagtcgaaccaatcatattgattgtagccacttgttcgtatttttgagcgtaacatatttattggtagcagagtcgaactttttaatggacatttcggtcaaagatagcatttatttaaatcaataaaatttgaacttgtatgaattntaaagtggaaatggatatcgcataacggattaagcggtaaatattcacgcacactagagctacttatagaaacattggtaggtggtaaggtaaaaatgggcaaggctgatgttatcgaattcacggactcttggtcgattttctttaaaaccatttttaatataaaccgccaaatatatctgatctctttgtctttttaatagctcttttaggaatagtttttcctacaattgtttttcttttaatactttttcttcttacacgagttccatattgccttcaatcccaccattttccgttaaattatgaattcctttcttgacttgactaattagagcgctctttggagattccccattcttgctggtgtctaaaacacgggaacctgttgccagtgcttctttacccaacaatgttccaatagattttattttagggagaatggctctccataaatatcgtaaaacatcacctacaccgccacctcgctggcgaccataacctcgttgataaggaggtactccatgaaaatggttaaaattctctcccataccaatctgctctaatattataaaatcatcgaattttacggtatttggatcagatatttgatgtaccatatttatacacttaaaattacagtattattattatcaaaaaatttcattcgcacgcttagattattttatctctatagatttcatcaattcattatgatttatacttttgttaaatgtcattttgattcatttgattgttcgacacactccaaagcaattgcgcatttacagcaaagtaaatttaaaatttaatttatgtaattttttaatttattaattcttatattaaaaaacagggcccgtatttatatttgctaaaatacgccaaatattgaatttttattttctaaaaaaaccttaaataattgcatttttaaatttaattgttctaatattaattaataagattctattgcaaatatgtgtgactgacattttattattaatgatgacacttctcttctgtccggtataatttatattaaataattagttcaatattcattaatattttagtatgcaattacgacgggaaaa

SEQ ID NO: 27461 - DNA, 1109 bp, Heterodera glycines
tctgggtttttttttcaaaaaattttttttgccaatttattattttaatagttagctttgggtattttgggcactttggtttcccctcctctgccccttcagggttggtccccattctttgcccccctggtcttgggggtccaaattttttttaaattaatttggtgtttatttgttacttcggacaaaagaatttaatagaaataaaaaaaattatttcgaatatttttttggtgattaaattgtgagaatgtttcaaaaatttaaaattttcaaataaaaataaatatggcattgtataaaatttgaaaatgagaaaaattcgtaatttagaagcagagaggaatcgattggtatatatattgtcgaaattccatgcgtttttatctgttggacggttcagtcccaaagccatttgcccatttcagtatcgggtctgtaactcttcagggattggttgccgcaaaaaaattctttcggattcttccattacagaccgagagctattgattgatatatatatcagaaaagaaccggtagccctaacaaaggagaggtacccaaatgacggtgggacttgcgaaccaaattttcagggaagaaaaaaaaatgcccattctgcaggaagggggggagggaccaatgaatgaatgcatcatcaaatgaacatgtgatttgtaatggaacagagaacaaaatgtgtgctaactcggtttattcatcaaaaaagcatgaaatgaatgaatgccttttgagaaaagaaaagcacccgcgcataagtcgaaaattcagatttttggtttccagattattggtcaaccattgtttaaatacatggaaacgaactgaaagtcatcagtgcttcaatgaaaaatcatttaatgtcagattcggatcacccaatgcaattagtgccatcataaagccaaatgaacacattgttacaattgttgttccaattttcatctttcttctgctgtagcttaaccgccgtggtctccgcaattttatggacataaaatagcaaaaatatggacataaattctccgaattgaggggtaaattttcaaaaatattcttcaaattcattaaattctattagaatacat

SEQ ID NO: 27462 - DNA, 852 bp, Heterodera glycines
aaaaatgtaacaaaacccaacacgcggcgtgcgagttcataaaatgcaactatttttagtcagtttaaaaattaaataggcataaaaccaaaaattttggttttgaaattttaatgaattttttaagaattgaacccatttgaattaatggaatgaccatgcaaaatcccaaaaatgcggcaaaaaccccaaaacgcgaaaacgccgcttttacacggcaaacaaaaaccatggcatggaataagcttacacatggcgggcactgtctgtgaatattgttaagtttcttcctgctcatgatcaatgaattgtatttttttttgtcaattaaattaaattaaattcaaaggcattctcaaaaagcattggtgtccaattaacggtaacaagtgcaatggaacaaaaatcaaatgaaacaaaaaaacgaattgttttttggccaatttggcccgagggcaatcttccgaatccgcgcaattcgcaattccatccgcccaaatatccccattctgaacaacctgtttccccccaaatgattgcgtgtgaaattagagtcctgtaattgttaaaaatcggggatgggattgggaatcaggccgggatgtgatttaaaatccaatttttggtccgggaaaatccacacgtcctatcccatccgggccctattactcataattggttagaatttctcaattggtgattttgatgtgatccgcgatttcaaccaattaatatgataaataaactaaatttatcatctacgccaattttttcattagaattctaagcgaaaacacaaaaaagatctgctaattaacaggattattacaaagatttttaccaacctagtcc

SEQ ID NO: 27463 - DNA, 1855 bp, Heterodera glycines
tgagttggacgtgagtaggggtgtaaatgtcaggtcaaaaaatcggaaaaaagggggcggtcgaaacgtcgcggaaaattttgacgaaaattaatatctgacaattgtttaacttaggaaagctcttaccaattcttaaaatatcgaatgttttaaagacacaatttcaggacgcgaccgaaatgaatacaattaacaaccgacagattgcgccaattccccaaactttgtcagaggcgcgtcagaaattgcgccagcgcccgcgcgtcaaattcaacgaggaggaggaggtgatcaacccgggtaagtggctgatcagtgattggattgacatttgatggctccgttgagtttagaagaagtcgacccgaacatcggccggttcaggtaacaaaagcattggacaaatggccaaacgatttacaattagtgaagggattaaataagttttgagttttattttcggaattacttattttgtcataaatacaccactgaatatgcaaaataaacctaaaaggcatggacaatcagtttttttggcccaaaatccgccgcttcaaataatgccttttgcgtctattcgaagttgaacttttccatccctctcttttgcaacttcattcatttgttcatgttttgaccatttgcctccttcccccagaaatatggttcggactgcggtcattccctcgtccaattcgaaccgccgtcagagggacgtggaggaccaattgttcgacttttacacgcccagcgagccgaaaaagaaaaaggtggaatttctgccctcttttttctgccgtgggtttgttgtgagatgaatcccctcttttcagctcctccaccatccgttgaccgccgcttcgcccgtcggtgcgcgttcctccctctccggcactcgcattggttcacttgcgctcggttcgctgactctcaacgcggcgcccgacttggaattgttggcgaaggagcctttttcgttttttaaacaatgcttcgtcagatattctcccgctttgccaccctccgcttctttgaacgccgttgcgccatcgaaatacggtccctcgcccgcagcgaactcttcggcacggcaattgctcggaggaggggcaaggggcggagattctggtatattcctgatacaatccaatggaaataagagcagctcgtcccctctcatcccccgatttttttttaatttactaaaaaatttcacaaaaaattaacatttttctagcgattttttaaaatgatgaattactgtttggggtggtgacgtaatgcacccactggactgattttgctatttgcaacttttcgcagttggcactgttccgtcggcagttgcgcctgacgaatgtccgctgaagaagaaatacgcgaaggaagcgtggccagcggaaatgagaaggcgttcgggcagcattctctgagcaaataagcaaatgaactcgaataaaactgcaaagtttctgcgaaacaccccattttcttctgttgttaaaattgtccgttttatccctcccttttcatctcattcattcccttcgctcattcttctccatttgtgtgtattttgtttgctatttttgtttgtttgttccattttcgttcgaataatttttgccgattaaattttcttttaaaattatttttttacagttcatttagaaatatttcagctccccccctgaaattttttttaaaagttgtcaagcttagagaatttctcgaaagaatcttaaattgtccaaaaaatcgcagaaaattttttcaattttttttttataggagtttgtctaccatttgtttttttagggaattctctcctatttttggatttttgagc

SEQ ID NO: 27464 - DNA, 1015 bp, Heterodera glycines
ttcggttttaattatgctgtacatgcttttaagccccgccgtgcggcggctccccgttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattacgctgtacaatgcttttaagccccgccgtgaggcgggacagttccaaaattttgtaccacattttactgtggaaagtccaagtaccttattggacaactacgtgtcaa

SEQ ID NO: 27465 - DNA, 994 bp, Heterodera glycines
aagtgttcttaaagtgccatttaccgggttttaccatactctgaccgattaaaataccttaatatttccagtcttgaaaataggagaaaatatttagatctgatcacagccttcaaaattattaaacaagaaactcacctaaaccctctaaaattatataacatatctcaaagaagaaattcaccttttcccagattaatcactaaatctaaaattactaaaactgaacattcttttaccaatcgtaccacaaaaaatttacaagaattaagcaaaacaatcgacctttcatcaataaactcaattcaaagttacaggaccaaacttaaaaaactgttggagatctaggacatttccatatgtgtaagcggcttttgtccttcatttggattcttttatttgaataaatttgaatacataattcgcaaattttcttacataaaattagcatccctaatcattttatctacgcaatcgaaatgccttcctgttactaattatttatcataaaaaagattctccaaaaaattaacatttataatttattgaatttagcaaatgaaataaagtgaattaaataaaaatgccagtgataataaatcaattgaaatgggtagaattcatttcattccccgccaccctctctttcatttcccagaaaaataaaattttcttaaaaaaatagacaaacgattgaaaataaatgaaaaattttaatttttataaaaaaaacctataaattattattaatttattttattaaaaagggttaaaaggatcttaaacttttaatatataaactttctagttttagaactataagtttttcctattaagagcataccccattaagaaaaaaataatttcctccccctggaaaaaaactagaggtgtgccgtgactgaaaaaacccgtgaatcgtgatcgtgatccaacccgtgaaattcacggtaaccgtgaccgtgaccgtgaatcagggcacacctctaaaaaa

SEQ ID NO: 27466 - DNA, 1771 bp, Heterodera glycines
ataatttaaaggcaattaatgacattctcctcttaccactgtatctctccccaaaatgccgatgaatttttcgtacgtttcatcctccagcataatgccattgcggaaaaagcatccctccttcgtcacttcaatcttttttcgttcatcggcactcatttgctgttcattctcatcataaaggtccaaataacggaacatcggatgtttgctggcatttcgttttttggccgacaacttaaaaatttaatttaaaaataataattatattttacaaactaattaatttaccttttggtggtccagcgatcctttaacatcaaatttgtaagtgaaatccaatgcaaattgttgctgctgctcatttttaccactattcttttcatctttgtacttttctgggaacaaatttttggtcagaagaaaaaagcgttcttcacccggcacaccgtaactgttgtcctaatgaaattaaattttaaaaaaccttattttaaaaattaaatttagctaattagtgataaatccgctttcatttgcgttgcggcccaaaaatttgatgcactgtataaaaggagtaattttagtccatgaattttactccaaaaatgatcgataaatatatatatttaaaagaatttataaaaaatttgtctataaatataattttaaatattttgccctaaaaatatatagagataagcaactaattgttaacaatcggggccaacttttaatattttcatgcaaaagaacatttataaattggcatgaaattttatgaattttgatgcagttaaaaattattaaaatttgtttaaaaattattaaaatttgtttaaacacactttgatgccaaaaaatgcaaaatattttggcagaagagattgttggtgttccatttcaaatttcttcctccattctggcaaaatatgcccaaaaatgcttttcaaaaaagtcaatctccgccctttggccttgtttttttgagtgcttttctctgcttattcttcaacgtctccatgcccgtcttgacgtctttgatgaagaattgttgatcaaccgttttgatgaaaatgtccatgttagacaagcgaccgttgggatttgaaatctgatgaagtttgcccattcgcaacgatgtctgaaattaagattggcattgtaaaagagattatgccaaatattcataaatgtccgtggttttaaacttgtccttttttagagtccaaatcctaatccctaggaattgaaaaattcaaagttatcattattttttattattttttaaagccattattaattttgtgtacaattaattgttgcattggtaagttccataaatctgccaatttgctgaatgcttgcatgccgtaggcagtgaattcaaattggcgttttccgtcagcgcccaatgtgaatttttgacccaattccagcaatgtcggcatcggcattttgtattcaatgcttctacgactgtttctgtcctgcttgattgacggcacattatcatgaaaaactttgccaaaatcgatggtgctagtgatggtggataaagcgtggatcaatccttggcggatggcttcagttcggttcgtaaccgacacaccaacatcaatttggggtgacggagttgccaaaattgtgactagaaaaatgccgatgagaaacaacaaaacacggatgaatgaagaaggcattggaaatgcattataataatcataaaatgtcatttcaaaaagctaaaaataattaatttttatttaaa

SEQ ID NO: 27467 - DNA, 1956 bp, Heterodera glycines
gtgcgaaaatggggtttgacaagtttattggggacatttgactttacaaaataatacccctgggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatatttttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttaccctgaaatgagcgccggagctagcttgctctaaaaaatttttcgaaaatctgagtctttcgtttttaatttattttttgcaaaattaaattcttaaatattttttcagaaagggtttttgaaacgcaccaaattttatttacatgttagtttaggcactctgatgctttttctatcaaaaaagggagatgaatgggggtgttaaaaagttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagtttccctatagcctgtactttaattctgcgttggatttttgctccccataattgtttgagtaccccaaacggacacttgaaaaaatcgatttttttgttttcggggcagtccccccgaaccgatgcgcccagatttatggggagacacgaatccttcctggaat

SEQ ID NO: 27468 - DNA, 1396 bp, Heterodera glycines
caaattcattcaatctatctcttttgttcaattttcaacctttttcctattttaatggtcctacctttttttgacaatttatcttacaattggagcgtttaattgaaaactaaggggacccttatttagtgttttcaaataagttctgaggtctacatcaaaagaattagtaaatcaatgcataaatttccgaatttttggttttatacattattttggatgtaaatctaagctaaacggatgtcttcagattccccacctcccctttaaaattttgttattttcgatgcaaatatagcctaaaaaattctctagagtcccctcccattttaaaatttttatagaaaattagcatttaccgctttcactcttttttcaaatcggctttatccctaattttaattgttgcaattaaattttaggggttacacatttccccttctcctctttcctctctgttgttatcacaacacaattccaattcgtcaacagcttcttcactcatcgacgagatgacttcttcaagatcggtgatcccttccacccccttttttcatccgctttttccttccctcctccccccattcagcgaacgcgtcgtgcaacttccaatactgcttcaactactgctactgctggccgtagacgcagccgttcaagacgccgtacacgtgcagaacaagtacgagaagcgactcgccgcgcgttacgtcagaacaacggcggcaacgcgaccaggacgaggaagaagcgcggggcagcgatgcgtcgtccgcccaagctcaaaccgctccgtggaaggccgaggggatcgcgcaaatcgagggcggcgccgcgcactgctggacaaaagcgtggccgtggacgtccgaggaccgtgaaaaaaggccgtgcccgacgggggaggagcgctgcccagcggcagacgacgacgactgcggatgcagccaccaacacggacgcgcactgggtaactattgcggagttgagggcggcgaccaacactgaggtgaccgctgcgactactccggcaacaatgacgacgaccgcggatggcgctgtggcgactaacactgacgcaaccggagcgacgactgcgacaacggacgcggcgaccgctgcgactactccagcggcaacaacgaccgcggatggagcgacggtgaccaacgccaacgaacccggtgcgactacggcgaccaacactgaggcgcccgctgcgactactccagcgacaacgacgaacgcggatggagcgacggtgaccaacgccaacgaacccggtgcgactacgacggctgcggcgaccaacactgagacgaccgctgcgactgctccagcgacaacgacggcgaccgcggatgggacggtggcgactaacactgatgcaaccgga

SEQ ID NO: 27469 - DNA, 1029 bp, Heterodera glycines
tctagagtccacgctgaaaagttatattgactctctttctgaattgacggtagaacttcgaatcgaagccaatgatgggcttacggagcttaacaaattacgaaatcgtgcttgttgccaacctttggacaaacatcagagttcgcttgatattgttgccaggtctttttaacccatcaatcattgtttgttggcagatttcagctgattgtgagaattcaacttttcaggtattatgaccaactttgcgcgatggaaacgaaactgccaataactccgacacagaatcccgtcagctttaagtggaaagatgcctttgacaaagggtcgctgttcttttcgcgcgcttcgctcagtcagtttttgtctctaaaatctcacatttgttattcaattttgatatttttagctcttaacgacagttctttcgaaagggcgtgcgttctctttaactgtggcgctttgatgtcggcaattgcttccaaccaacagacgaacactgacgaagaactgaagacagtggcgcatttgttccaacagtccgctggcgttttttccaaacttaaggacactgttctcgcttcggtcttttcggcaaaataattctcctttaaagccaaacttttaaacaggtccaccaggaaccgacttcggatttgttgcccgacactttaactgcgctccttactctgatggttgcgcaagcgcaagaagccatttatatcaaagcggctaaaggtcttttgcattaatttgttaaaaaccagaaaactttagacaagctaaagtcgacttctctgcttaaaatagctgcacaatgcgcggatttctatcaagatgctcaaaagttgatgaatcgtgagactgtaaaacggatttgggaaaaggtttcacattgaaactagtcctttgattcggagtaagcccatttttttgttaaggaatgggttcaaacggtgactggaaaagggctggtgttcgcctctttggcacaattccatgcagcagaggcagcgcttgacgaacaaa

SEQ ID NO: 27470 - DNA, 1118 bp, Heterodera glycines
cgcatcggtgagatgttccatatggaattgttcgatagatgagacggcattttccaattgctgcacaattcgctgttttttggagttaattggggggggggggggtaacgacggagggtctgcggcgatttgcatatgacattacgtcttaaggactacagaagagtcaaaaaaaatttggaacgctctgctaaaaatgacaggttttgacaaccttaccctgaaacgtaaactcgcacggatttcgaacttttaatatattatcaaactgcaattttgttatctatccataattcttgtttaatatcagggctcggatcgaaaaattttcaaaatcagaacatcaagtccaaaaaataagatttttgggtccaaaataaggacattttgcaaaattgcttcaaatcagttatttttacaatttattcgatcaataatgtatcaaatattatatttttcacctcccatgatcatttttaacaattttggtgaggaaatgagcaaatcatacatttcggggcaagtgagatcgtaattcaatttgatttgtgccagacttttcacggtttcgattttcaatgaattgcgtacataagtccattgcgctgaacaaagagagaaaacgcgctccacacatgcattggacacgggaattgaaagaattttgctgacaagcaaaagaagattgggcaatttcgcttcaaaaagcttcatccacttctgttcagcgttcatttctctaaatttctcatcagaaattttttcaagcgtctcattcagtgccgtaatttcgtcaaaaagttcattgtcgttcaattccggcgcaatttgctcagccaagctcatcacttcggcgcgagaaacttttttttctttgagagaaacccatgccaaatccgttggaaagcgctcaacccggaaccatttatcgacataggtaagtgttgatttcagaaaagtctaaaaataagaaaagcttaaaaatctccagattaaaaacccggaatgaggcacgtaaatgagttgattcattagggtccaaacgacgcagcatttgcgcggtgatcattccgtaaaactcctcagagaaacgttcttcgattttccgtttaaaattt

SEQ ID NO: 27471 - DNA, 1411 bp, Heterodera glycines
  misc_feature (1393)..(1393): n is a, c, g, or t
ctcattaaaatgtgtcttacaattaagaatttgttttagggtgccatgctcatcgaactgtgccaccgcaaacaatggcacaagtgttcgcattggctgccgaactgttgtgccgagtgaccgacacaatgcaaccaatttgcctggacaacccccccccccgaaaattaaaaaattttaatttttaaatttcttttttttccggtcgccaaaatttcgttcattgcccgcgacacttcgacggatgcgcgcgcctttggcttcgttttcggcacggcggacggcaaacacaaattttacggggtgaaaacggcacggacggcggaccacgcggtgctctccattcgggtgggcatttgatttggtttaacaagacaaacaaattttcttgccaaggcccaaaaaatcataaaaaattttctgaaccaattattcttttttttaaatgacaaaaattggtgattttttggcgaaaaacggctacaaactcatgctttttgttcccgacgacgcaaattttaaaataacattaaagaaaattttttttgtaatttttgccccgaagagccaaaaaaaaagtctttggattttccccttggaagtttttttttctggctacgggtctgctgtctcccccaatgttaaaaagaaacataaaaaaaaattttttttctaataaattatttgagagaccggacaactgagtcccatccaaatgtgtcccccattttgcatgtttaacttttcaggacatgttccaagttgtgttcgagatgaagaagaagcagttggaggaggagaagaagaagcaggaggagcaagagaacacactggtgagaacactcactgaccaactaaaggaattgggtggagaatttgaattttactctttttttggcgattcgtttgggtccatgccattcgaaaaatttttttttttgaataaatgcaacaggcaggacccgaattcttgttaaaacagaacctgttcgggtccatctctcggaaatccgggaagttcccctggtcccctagggttttcccaaatttctggggtttttttggttacaaatttcctcccgtttttttttaaattttgaaaattgtcaatttgtgcctaattatttattcaaatttggcagaatgccgagcgggaggcgaagaacaacggtggtggtgccaatggacagcacagtaatgggaaggctggtggtgacatttatttgtcggcatcgaaaaccgaaaatggcaccggcggcggcggtggaagttgcggtggctgacctgctaatttggaaggtgaaggtggagaacattcaacaggtcagcagttgacaaatgagggacgaactaggcgtccacccccattccccttcgttttcccccaaaattntttaaaaatttttcaaac

SEQ ID NO: 27472 - DNA, 1169 bp, Heterodera glycines
tggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagacaaagagatagacgttttttcaaaattttcagagccaaactcgcccagaaagaaatccagaaaattagggtcgtcgctattattcccgaaatgtggtggagttcatttgagtgtgagcagaaaagagatagacgttttttcaa

SEQ ID NO: 27473 - DNA, 1229 bp, Heterodera glycines
  misc_feature (1188)..(1189): n is a, c, g, or t
  misc_feature (1193)..(1194): n is a, c, g, or t
tttttactaaaattataagcaaggttaattattttgaatattttttcaataaatcgcccatttccggcactatgccaagtttgggcgggacagacctaacggggagatataaagtatagggaatatcaaatctattcccgaaggattcatcctcccgaaactgtctgactgttcgaaaattttttttaaattaagcctaaaaaatttgtctaattattttaaatagtttttcaaaaaatcgcccttataaattgcattggatattttcaagacaatttagtcctgtactggggagtatccctgcaaaaattggtggggttctgatcgcttttcgaaaaattacttggaattataagcctaaaaaataaggttaattattttgaatattttttcaaaaaatcgcccttataaattagcattggaatattttcaagagaattgagtcctgtactggggagtatccctgcaaaaattggtagggttctgatcgcttttccaaaaattacttggaattaaatttttactaaaattataagcctaaaaaataaggttaattattttgaatattttttcaaaaaatcgcccttataaattagcattggaatattttcaagagaattgagtcctgtactggggagtatccctgcaaaaattggtagggttctgatcgcttttccaaaaattacttggaattaaatttttactaaaattataagcaaggttaattattttgaatattttttcaataaatcgcccatttccggcactatgccaagtttgggcgggacagacctaacggggagatataaagtatagggaatatcaaatctattcccgaaggattcatcctcccgaaactgtctgactgttcgaaaatttttttaaattaagcctaaaaaatttgtctaattattttaaatagtttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttgaatattttttcaaaaaatcgcccttataaattagcattggaatattttgcagagaatagagtcctgtactggggagtatccctgcgaaaattnngtgnnggtctgatcgcttttccaaaattacttggaattaa

SEQ ID NO: 27474 - DNA, 2166 bp, Heterodera glycines
  misc_feature (26)..(26): n is a, c, g, or t
  misc_feature (2091)..(2091): n is a, c, g, or t
  misc_feature (2116)..(2116): n is a, c, g, or t
  misc_feature (2143)..(2143): n is a, c, g, or t
atcaattataaatattagataaacantttgaacaaaacttagcacaaaactaaaaattaaaaagccaataaaaaaattgggttttagcaaatcccgataatcccgcgggatcccgaaaaaaatcttcgggattcatcgggattcggtcgggatcccgactcgggatccgtctcgatcgtttttccaaaatgttcgggattgatcgggatcgggattcagtcggtatcccgactcgggatccctccgaccccagttgtccggtctctactgcaaaagcccgcagcaatggacataaactcaaaccctatgtgttggtcaacagaaagcgaccggttccgcaaattatcaaccaatttgctggaaaattgttttgtttttcagaaaaaattagtgccaaacaatgttctcaaaattctatttatcccccatggggggtaaatggagactgggtgattattttttaaactcctcagaaagggggggggataattggagactgcggtattaatagagactgggctataattagagcatatacggtaagtttggcgttttataaattatttttgactctatagcactatgtgtccaatcgcattttttgagtccaatcaattgataaacctaagttttgggtcttggtcgtgcaaaccctagtctttatgatatcctttaaatgatcatagttgatattgtttaatattgatcaccgttattcatataatgaccccaagcaaattctccattgattggttcaatgaggtactgagaaacgagaatagtaaaacatttttatttataaaatatattataaattcagtaaaataaaagcataattatatttaaagaaaatttactggaatatcaggattttaaatattaatcaataaaataaaacattatatgggccatcgatctttcttcatgttaaaatagccaaaataaatagtataaaatgtttattaatataacaaaggacggtaaaccaaaaaacaaacttttaacacatagataaataaaataaaaatctaaataggcttaaagaaaataagtgaattacaattgaaaataatacaatataaatcatcaatgcacctaatccctctatgacataaattaatcacctttaaaatatataaagaaaaaaaactatgaaaattcaaaactcaaaatgataaactaaaaggctataaatgataattatcataatttagtctacccaggtttcttatgtcgtttaaccaatgaacttgggtcctctttgtgatatttcagaattaatcaagaaattcagctcatattgtttttcaagtatttaattttttttttgtaaatttataaaaaaatattttctgttattattatgaaattaaatatgctatttattagcaaaattaaataatttactaacttgaattattgatttttcgataactagctcgccgatatattgttattcctttttgaaattacatattttaattgtcgatttgcttgtaaacattaattttaaatttcttacctttgcttttatttctatatacaaaaattattacaaattaacagaattttttatctgattttgactaatatattaaaagaagattctccacttttaattttaaaaatgtcattaaatttacttattttgttttattaaattcttatgtttttgattacgtttaatggctcagtctttttcctttgattttgtttttttttgattttttgttttttttattttaattcttttgatatttttaaaaaaaacttctatttttttttgttttattaatttttaataacgaaaagtttaaaattttgtatttgttttattagattcaaagaaaactatttttcaaagttatttatatcttaattttttatttcttttattaacatttaaagctcctttctttgagatttgttattgtctttaattttttatcacaattaatttataatatttatgcaataagggatttaattcttactattcttcttatatattctaaatttttatcttccatagaatataaattggaaaaataatatttttgtacttaagatgtcatttactattttgtttanactgtcggttttttatatgatttanaattttattaattaatttctatagaanatatttcatttacacatacattc

SEQ ID NO: 27475 - DNA, 1238 bp, Heterodera glycines
tttcccgcagcgattggccaatttttgctgcgcggtgccaaactgaagaattgccgctgggtgttcggtgtcgtcgtctacacagggcacgactcgcgacttctgatgaactccaccagcgccccgctgaaaacgtcgcgcattgacgtgatgaccaaccagcgcattgtcatcctctttctcatgctggtgctgatcaccatcgtcaggtgaccgggcaatttggaatgagagtgccggatggaaccatccgattatgccaacaaatgcctacggaaaaattagaccaaacttagctaaaaagaagaatttttggtgaatttaacgacctttaggaaatgaaacgaaattgaatttttgtgtaaaatacactttaaattggctttggaactagttccgctttaaaaagctatcaaaaccttatatattattatgttacaacaatatggggtttttaaaaagggtctttatatatgtgctttgtgtgtgtttgtgcctccaatcagccttttgcagtgtcatcggtgccgaagtgtacaacaaatggtttttggacggccattggtacatcggcgccattggccattggtccttctggtggaacatgctcaccttcttcatcctctacaacaatctcatcccaatttcgttgcaagtgacgctggaaattgttcgcttcttccaggcctcgtacattaaccaggcattgactatttttgagtacattcaaaattttaaaacaaaaattgttcactaattaagtccaacctttttaggacatttttatgtatgacgaggcaagcgacgtatcggctacggcacgaacatcaaacctaaacgaggaattgggccaagtgcaattcctaatgactggtaatcacctcaagctttttgttagcccacaaagtcaattgcaacacctaaaatttacttataaatccaaaagaaaattctccgaatggcgctttttgaattatttccctttttaagagcgaaaggaatttaattttataaaacctaggctaggcggacaagggggggggggggtcaatttcgtaaatcgtacgcgggtccgaggcaatttcgtaaaatttttgcccaaaatcgaaaaatcactggttaagatgggaaaattttacgaaattgaaaaaaaacaaaattttgtgccaaaaaactcaaaatttttacgatttcaatgttctatgtcgttaaaattttacgaatattgaatttcgttt

SEQ ID NO: 27476 - DNA, 1151 bp, Heterodera glycines
ttataatttagaattttttcaaaaaagttttgcatttaactttttactaaacttaaatatttcaagtattaatgttctttatttattgtttttttaccatttttataattttagtctttgattttttgtcgaaaaatatctcagttttgatttctttattttctgtcggttgtaaaatctcatttaaaattataaaaatcttaattttttaatttcataattcataaattatttattacattaatctatttttttttatttttggatagataatttattctcaattgttcaatattatctgcatctaaaatttttacattatcaaattcggaatgcaatgttttattttacattttttgtatttgtttgaatggaaagcaaaaaggtttttttcattttcgataataaaaataaaagtttttttgttctcaaaaatttgaaaacattttaataaaaaatatacgaaacaattgaaattaaaatgcataatttttgaatttttcgaaaaatatttgtgttacttgtgtttatttaagtaattaaattattattataaaattaatcgaattttcttattctcatcaaatcagagatccgagattataaatatcatatcatatcctttttaaataatttcttttatttttttatgtaaaaaaattttattttattattttgcaaaaaatctcttggtttcgtattcttcttatgtatgtactcgctggtgacttttctcaatgttttttattttattattttcattttacttagtttaaaaaagttttcttaaatttttattttataagagataaataattgcgtttatgtaaaacattgtttttttgttaattggtataaaataagttatattaaaattattttgcttcttttatcaattattttcatgacggtttattttatttacagttttttatttcatttatttgtaaaattagggtttcttcaaaatcgtttaactgaaaaccatcaatccttcaataagagacatttgacatttttcgaaccccgaatgcggactcgaacaaaaattcaaaaacattttacaccacatttcacatttgttgtaaaaaactgtttttaagaaaaaatgattctgacattcatttcgaccaattcaatactccgagtaa

SEQ ID NO: 27477 - DNA, 1186 bp, Heterodera glycines
ccatgccgggatccaagtgaatggattaagacccggccccggcctgggagaaagccgttaaaaaactgaacaaaaaattgttcgtcaccgggccggtccgggttccggatcagtcacttttggtgcccgaaagtggtcagataggcttccggaaaatgaccaatcaatctctgagctttttttgtggaacgcccacactgagctttttgtggaacgcccacactgagcttttttgtggaacgactcaccacggttggatgagttgacgaatcatcgagttaacgaatcgtagtttttaattaattgacgaatcgcgaattgacatatcgttgagttgtcaaatcgtagttttttgctgaattgacgaatcctcgctgtgtttagccattcgtcttattcaattccataaaaattttcattattttaggccaaaatattttttcaatggccgcctcgaatggcacgacctcacaacagcctccatcacgttctgcaccactgcgagccactctccgtgagcggatttatttcttcccttccgttgttaatcaaccctttcccttccgacaggaatataaggtctccaccagtgaagagcaccagcagttgttctgcttgatccggaggatgctagagtacgacccggcaacatgcatcatgcgaagcactgcgcctgcgccacccatactttaagaaagaaggttcggccaaaatgcaacttttcggtggccttagcccaggcccgtactccgaaaaaaatttctggaggggcaatcaaagatctttttctatcttcggaacaattttttctatagctacaaatcaaaaactgatgaagaaaaaattgaaattgttcaaaaatttattgcaatgaaaaatgaatacaaacaaaaaagaaaatattcatcgaaagaatggaaacaaaattatgccgaaatttgtaagaaaattggagttaactatggaacaattgttaaaaattttcttctgttacttcgcgatttaacattagcaaaataaatattgtaaataaaaattaaataattaatttctactctactgttgtcattgaaattgcaaataaagtagggaataacaaaaatatttttgatcagtagggataaaattgtttatttaatagtgaatgaaattactttatttttatttcattacaatatatttaaaa

SEQ ID NO: 27478 - DNA, 1258 bp, Heterodera glycines
  misc_feature (1195)..(1195): n is a, c, g, or t
cggacctgggggcaaattatgaaattcaaaactatccacgttttatttctttcagtcactcgacgtagtgtaaattcgaaaaattgaaataagttttcaatccgaacagttcggttatttaatacaaaaaaaagttcattttccatttcaaaaaacaataagttcaagaatgcttgaggctgataaccatgcaataagggtacttccttcttttgctacccccccccccccctcgaaaaattttaaatttaaaaaattcatagatattttgttaaatctatgggaacgcactaacttccatgcgcagtgcacgagggatcggctcattgcgtcccaacattttgtaggcagcgatctgtgcactcaacaaacgcagttggtccggcccaattttgtccgcagattaatattgttattggctagaactgttattggcatttataaattgaatgaatattaatatatacgttatattgacaaggagtttcgttgctaaaaccattttctcccggccgaaggccgggagcgccctgaaagtagtggaagggtcttacaactttttgaggcgcatccgggaaaactatagagaaaaattcagcgcggacgactgagtcccggggaccgatttctcactttttcttgcgtttgttagcccataactttttttctaaaactcggatcaaaaaattcccgctgggagggacccaagttggagtgtcctcgacaactttgccagcgaaccctaagccctacgttgggctcccgaggctgtagccttggctaaaaattcagtaccaactttttccagttcagtccccgttgaataactcattaggctttgacctgagcgcagggtggccagcagacttattgtagagctcaatgagctcgatttttgcaatttttaaaatttggaaaattttcaaaatttttcgagttaggcctaaaaaacggttttcgggtttttgaattttaagaatttttaacgatttttcccagaaaaacgaagaccacttacaaaacatagtttttcgagctctatcgactggtaattttttcggaaaaatttcgatttttttccggaaatagaaaaaatttttggcctgagcgggacatttgagtcccgggcctataactcgtcagggatcggttttagccaaaaattgccttagaacatttttgtagagcattttanatgctatcgaatggtgtactatatgaagggaaattttcaaaaattttcgagctaggcccccta

SEQ ID NO: 27479 - DNA, 1957 bp, Heterodera glycines
tatttgtaaattctttgtgttcttcgaagcttggactctcaaaatgagtcattttaaacaaaaagcgacgaaaataactttcgaattttccttttcctatctatgcataaaaatgaaaattccaagttgaaatatttattctgcagaaatagaactaaactatatttgtttaaagaattcgctcgcctcgcctcccccaaattgggtaattaatcgcattttgttcggcggtttagcgaatcggaaaagtggaagcagaaaacgttcatttctcggggacaaactctgcgggctccgataacaaatcattcccgaaacgagaacaatcactcactcagagagttcaaaaacattttaattaaaaattgctgaaaaaagcgaacaatcaataaatggtgccaattgtgtgttttgtccgtttttgctaggctttgccttcgccccattgtctccgcctgtaccaaaatcggatgcggtggtcatctgatccggtgacgaacattggcatgcttggcgaatgcacaaaagctcgagtcggagctgtgtggcctagcgcaagcaaccgctcgcggtccgagttccgtgcatcccacgaacatagcgaacccgacttttcatcgggaagcattactgaaagggattggatataatggataatcgggatggaggagagagagaagagagtggaggggggggaagcaatgaaaaggggaaataagaacgggtaaaggaggagagaaaagagtgtcacgggaagtcgaagggtggaattgccaagttttgcagggaatggctactcaaatgagaagagatgcaactgaccatagtcttcggtgtggctaagtgcgcctgcatcggatgttcacgtgcgcctgtggtgcccgctgccggtgtaagcgatccacagcgattggtggacaattcccataatttgggcacactgtccattcctactgtgagaacgtactgaaacgaatgaaacagggcaattaatcggaattcccaatcgctaaaagccaagattaccacacaggtccggtaccatccgaattaattttcatacatttgatattttatcacatgacgaaaatggaccttaagaaactagtcgaaaatgtacggacggaaaaagtcatgtaatcgtaagaccgaccccaattaacagcaatgacactttagtaattaactgggaaaatttatgcataatgaagcaatacctttccattacgagtgaactgagcactgcaaatcggggctccgtcatgcgcgcgggtaaaagtctcaatgcatcgattggaaactccgtcccaaactaaaaaaaaaagtgaaataaaggacaaaaaagaagggggccgtgagggagaaggacaagggctgaaaacctaattctaaaaacctccatttttgggaccttttatcggcgaagaatggttttaatgagtcgactccctcgcccctctttccatatatgacctatgtctaataatcgaccttttacattcccatcacgacttcccgtgacaaacattcgcgcattttccgaatagcacacatccgtaatggaatcagaatgttggtccttcggtattgtagaaacaaagcattgctaaagaaacagattcgatgaagttttcagaatcatgtaaaaaatgttttctatgctatttaaaaacggaagaacatattgaaagcgattttaaacaaattaaaatctaaaaatatggatggtacctgtgtttcggcactataaagacgcaaggtcggatgccgagttgcgcatagaaaaaactctccgctcggatgaaaactgaccgcagtgatcggctcgacctccttccaaacatttcattgtaaaattctttcagaatatgacttaccgtgatcgttttcattgcccttttaaccgcagtttttgaataatcgaacattttcagcgtaaaatcgttgctgcccgaaa

SEQ ID NO: 27480 - DNA, 1054 bp, Heterodera glycines
  misc_feature (976)..(976): n is a, c, g, or t
  misc_feature (988)..(988): n is a, c, g, or t
attgatagggatctcaaaaatatgtacaaaaattggtcaaaatatgtacataaatatgtaaaaaaaatcccgaaatatgtaagaaatatgtataaaaacccaaaatatgtacgaaaatatgtaaataaaatttttttaaatggttattttttgggaaaaaaatcttcgtaaagtgttaaataggcataaaatggcataaaaatgacctaaatatgtttagaatcaccttttaacatttaaaaaattatttttggaggggtacatttaaaaaaaagtttttttttaaattttttcactagaaataaaattttcaaaaattctcaaaatatgtataaaaaataaataaatttgccaaaattttggattttttttttgaggatttccaaaaatttccgtaaaaaacccgcaaaatatggaaaaaaaaatcaaaatatgtaagaaaaagtccaaaatatgtaccagatatgtataaagtcccgaaatatgtaaaatatgtataaaacctcgaaatatgtaaaaatatgtaaataaaagtcccaacttttgttcgcaaacacaaaaaagaaagtgtttttcttactatttagagcatggagaagccaggaaaatatatgtatttacataaaattgagatccctaattatgaatgaacatggaaaaatgggcgggagtagatattggctgggttaaaactaaattaaaatgccttccaccatcacatcataaatataacggtgctatgacgttagtcaaaaaccatcataatgggcgttagtcaaaaaaccatcaaatgaaatattttttgatataactttgctcaaaagcaactaaatttttaattcttgatatcattagataggcctaagtgttttctattagcctacaaaatttcaaaaagtttcgttaagtttcaagaaagttatggccaaaaatgttcaaaaaaacttggttttttgagcttctcaggtcataactntttttaacttanagattttttagaaatttgcaggataatagaaacacttagggctatcgaaaatatctagattataaa

SEQ ID NO: 27481 - DNA, 1122 bp, Heterodera glycines
aatagggctccaatttatagttttttcactatttttttcctgagctccctatagcgtgaaatgcacgaaaaacatgtttttttcggctgttgttaagctacttttcgagttattagcaactattttctagttttttatttttagcaactaaaaaactataaaatttttttaaaaaaactattttcaactattttagcgttttgcccaaaatttgttaaaaaaatgcaataaaaagtaaaaatacacccctaagaatcgacttaaaaatttttttcaaaaaatacacccctaagaaatgaaaaatttctcaaaaaatcatctccaaaaataattaatttattttattgacgataatttttgattttgaaaattatgtatctaattaatgggttggcataatatttttgttttttgaagaaaattttcgattttacacccaccccccttaatttgaattttagaaactatttggccatttttagcaaaaccattttgggggtttttagaaactaaaaattaattattttggcactttttagcaactataaattggagtatgaatggtttatgaaagccccaactcgtactaggccaactcagtactgctggtagtaccctgactcgtactaattttccaactaattaagagggggggggggggggggtagaaataagtaaacccattatcatgccaaaaaaagttaaataatatttgtatttttatttcttcatataattaaaattagaattatattatttttaaattaattaccgttgcccattgaaatgaaggacaacaacagcagggcaccaagcaaaagcagaagaaagtgcgaaatttttgaacacaaaagcatgtttagtatttgtctagaaataattttaaatgaaagcaaattaaatttatttgtttatttttgttttttaatattttatgagttcggccaaatattatttaatgtgttcgataccgaaaattttgcgaaattcgagacccgaaaaattgggcacgagtcctgttcacgggaaaaaatgttattcctcacttctatgatcaacagagttcgagagtctcgaattttactagaagtaatcatggtttcttgggcctctatatttttt

SEQ ID NO: 27482 - DNA, 702 bp, Heterodera glycines
ccccctcgctgcgaactcccccacctcttttacaccccccccccccctaaaaatgtatgaatgccatttaattttttgtttaggaagttctctgtgcctctttttcgctctctcccccctctctccctctgacttatcatgtattgtatcaacaacacattgtcaaatggacagcatttcgcgcggggaacactgcgagaagttgctgggcgacttcaagaagaagacggcgacggagcccgctgtgaagcgtgccgagaagaagaagattggcattgagaagctttttttaaagcagtctacaaccagtttgttttttttctttttttttgtttcttgttacagatccatagccaggggatgggcacattttttgaaattttggcaattttccttcaattgcatttcaaactggagaaaaatcttgaaaatttttgagggttatctccctccgatttttttttttggctacggtcccgtcttgtttcggcacttttctgtaagggccaccggaataaaggggtggggttttgttttgattatatcgtaaaaacctgctcatgttgatttttgggtcgctaatcacgaatctgacatcaatttcaactagttccaccctttggaattttttcctggtttcataacagcaataatcgaaaaaaccagaagtggattttaaagatacttcaaattttttgggag

SEQ ID NO: 27483 - DNA, 2031 bp, Heterodera glycines
taaaatgaaattattgtttaaattttaccagaagccgaccattgatggggtgaaaaaagtcgcggtcttgagtttccaaaatgagaccgaaactgaaaaacccgagactgtgactcaagttgagaccgagactctcaaataagcaggaagatttctcgaattagcattttaaaaattaattttaagggtcaaaagcgaaagccgagacgaaaagcatcagaccaaggcaaatttattgtggatttattttactttttatcttgcaaaattaatgctgtttaagcagatgtaaactcattggagtcggggccagtggaagatgatgaagaggaggaggaagaagaagaggtgggaagggtaacgagtggaggctgctcgagaattgaattttctcgagtctcaagaagctgggcaaagaattggacgagagtcgagggtcgattgagactgacacctcaaaaacccatagaaatttcttggctcgaaaaccccagcactttcgagtgagctacaatatgatcaaattggtgccactattcccgactcagtaaaattccttggttttaaatgtcatgatggtatcttttctgcaacatattagtggtggtgagaacgaaaaatttctcgagactcgagccccaaaaaccccgggatttttctcgagttgagaccgagactctcaaataagcaggaagatttctcgaattagcatttaaaaaattaattttaaggatcaaaagcgaaagccgagacggaaagcatcagatcaaggcaaattatttgtggatttatttatttattttttatcatcaaaattaatgctgtttaagcagatgaagaaaactcattggagtcggggccagtggaagatgatgaagaggaggaggaagaagaggtggtcaggggaaggggagctcgctgaaacttagaaaaaaatataaaatgaaaattcagaaaatccctcgccgaaagagaacaaagaaaaagaagaagaagaaacggcttcattatgatgatgattacggcaattatgatgacgaggattacgatgattatgacgacgatgaagacgatatttacgaggacagcgactacggtacctatgaggatgactacgacagttatgaggacgattatgatgatgagccggccgatatggagccggactatgattcagaggaggaggaatacgactatgtggatgaaggcggtggtggcaacaatggcattggcactggcgtgtcaaggccgaaacgatgccgggacacgaccagagagtgcaggcacggatttaacagacttttgggggaatgataatcgaccggaaccagtttatgaatttacaaaatgctaggtgtatgataacctcccagtcggggctggtaaatcggagatttccccgaaaatggcttaaaaaattcgcgggaaattagcccaaaaatgccgggggccctcccaaccataatttgttgtttttaatgggaaagttgcaggacaaagcaaatgcgtctctactgttccgacgaggactatgaagaggacatgcaccaaagatgtccagtgacatgccgattctgtaaaggtattaaaggggaattgggtacagtaaccaacggatgattccgccagggttaatgtacggtactcgaaacgggaaccaatggtatgccatggtataccaatggtacaatcagcaggactccccgtcgggtgcactacgttccccctcccccgttttgtttcggccgaacagaagtgggaacacaagtcaaaaagaaaaaaatgccggaatgcgatttgtattaaaggcggtaaataacccctcaggggtttttatacggtattaaaggggattatagttacggtaaatggatccaacagattttcccgagattctggtcccgtttgttttgttgaaattccaattttaccagtggtcaattgtttaaatgtacggtatctatacggtagcaaaaattacaattaaacaatgcgtttttcagcgggagaaatgtggcaatagactatgaa

SEQ ID NO: 27484 - DNA, 387 bp, Heterodera glycines
ttgtcgaaatcacgcgcagacagtgaaaaaaaagcaaaatagtttactgtcgaaatcacctggcacgaatatggtgtataaaaaagtcatttttttattatgcctatcatttaatttcatttttacacatatgtaacaaagaattattaatagaatttacaaaaattagatttttgtttcggtgactttttttttaaatatacaatgatttgtttttgtcgtcatttgaactgaaaattataattaaagcctaaatatatggttgtatttgtagcattttttacgggctttcgaatggtctacataattactctaaacaatgttttacataaacactgtgttttattaaacgaattattcacaaattatgggtggtcaaaagtttat

SEQ ID NO: 27485 - DNA, 1733 bp, Heterodera glycines
  misc_feature (1650)..(1650): n is a, c, g, or t
  misc_feature (1659)..(1659): n is a, c, g, or t
  misc_feature (1685)..(1685): n is a, c, g, or t
  misc_feature (1696)..(1696): n is a, c, g, or t
  misc_feature (1706)..(1706): n is a, c, g, or t
  misc_feature (1710)..(1711): n is a, c, g, or t
  misc_feature (1717)..(1717): n is a, c, g, or t
gaaatgcctttgtcagaatttccccccccccccccgttaaaatttgagtaggaaatgaaccagcatctttcacgctcacccgacgaccgaaccccacagccgacctgatgaaatggactttgatcagataagtgccgttgggggggtcgaccctcctttcaaattttttgtcaccaatttgtgcaattttggaaatttctaaaatgtcctcataacggggttttgagcagtgttgttcttttcccaccaaaacagggactgacctttggtcattcggcgcccgaaaaccggaccacactgacgcggcatttccatcgaaatggcaacgacccgccccttcccagacacggcacacgggcctcactcccgcgacattgtccccgaaacggcatcaacccttccgacacggcatttcctaagaagcggcaacgaccgaccctcccgacgtaaaattgtcccgacagaccctccccctcacccttccatcccgaacaaacgaacaagtggaatttccaataatttttttggaggtttgtgaaaatgggaatgggacttgcatacaatattaaattttatttctttgcaatttaatgatttgttttttgttctagtgaaggtgtcatttccccgtttcgtatgggccacacactcggacgaggtgtttcgcgttcctgagggatatcaaccggaagaggaaataatgtttgataattattttttgctaaattatctgtaattttgtaatttgtttatctgtctgtttttgtttaaaatgttctcattcgtattgtggtccagccactgtcatatgttatatttatttagtgcttgtatgacgtattgcgattagacaattaacaaaaaagttatacatgaaatttgcgaaaaaactcgaaattttgaagtttttgttaataaaaattttttcaggcttgaaaatcttttcgctttttgtaaaggctaatagagcatgtgaagagcttcgaatgataccaacaatgtttgatttggatgacaaagaaaaaagttgtagtggaaaagcatgctggggccaaatcgtgacggccgaactgaacgcgtagatttattattgtcattagtcgtaatttcaaatgattaaattttctctttttgttgattacttttaacatttttttaaatttaatttttcaaattttagtttctaaattttaaaatttaaaaggaatttatgaaaatatttttcgttcattattcatcgttttctttcagctgtcatcgttttcccttttccatcctttcaattcaattcgatgtcaatcgatgaaattgagcggacaattcctttgccttcgtcccatctcttctctcattcgcaattcgtccgggctgagattcactcttttgaagaagcttttgtccacaacaaacgcttcaaagagttcgaaggattactcagaacgaatcacaaagttagaaaaagaaaaggaaaggaaaaaagaaaggaaaaagttacagacttacgaaagtgtcgaagcgaaattcgacctgcaaaaaatcgaaaaaatgagcactttgacgaatcgactgaacaaattggcggatcatttgggggaaattggccatttgcattttgaaaaggtatgccaatggggaaaatgggaggatganaatggcggngcagaacgatgcccaaaaatgcctanatttagtttanaaaatattanattnntgacgnataataggcgctagtt

SEQ ID NO: 27486 - DNA, 1110 bp, Heterodera glycines
ttggaaaatattatattaattttaaaatttaaaattgcataaaaacggcttgaatcgatttaataaaggcaaaaaatgatgaaaaaattcttataaaattttttataagaaaatttcaagaaaaaaatcattgaaaaattttttcgaaaaactgtaattaatttatcataaatttcaaaaatgaaaatttttcaattttttttatttacttttcttataaaagaaattttctaacaataagaattttttctttaaaaatttctaggtatgaaaaattttctttttaaatttctgcggcgttattcccctgattgtgaaccgtccgacgttttttaatgacgcattattatagaattttgaaaaaatagctatttttcttgaaattattttctaaaatttttagggaaatttctaagttttgtgttcacctccattcctcgtgccatcgtctttctccgccgattccattttttctgtccatcgcttcgcctcctccaccaattttcgcgcctcctccaatttggtcgggaaatcgtcgtccatttccatgctgaacagtgcctccgtcatgtccacgagggcatttgcggcgtgccgtatttgcttggagtccatgtcggtgtccgggttgtactcgatggcattgttgcgaatcaattgaatgtccttcgcaaaggcatcctttgaggcataaaggcccacgtcgatgttgcccatctgtcaatagaatatgcaaatataaatattttaattttttactcaataaaaatgcattgtttcaagtaaaaatttcaaaaatgggcaaatttaaatgaaaaattttaaaaaaaccagaggaaaagggacccttttggagcaaattttacaaaaaaaatgtctgccacgaaaacttttttccaggtgttttaggagtcgctgatcatagatcttccatccaatttgaccaattctgaattccttaattcgaattcgaaacaaaaaaaaatccgaaaaatttgaattttcgaccattgtttcgaagccggggttaaggcgttcagaattggtcgaaatagcgcaaacccaggagagcaatttcattaaaaacccgaaagagtaaccccaatggtt

SEQ ID NO: 27487 - DNA, 1329 bp, Heterodera glycines
aaaggtaaaaaagtctgctaatgatctcgtaaaactttttttttcataaaaattggagggtgatctcccaccaagaaattttatgttttaatgcctgaaagttattagtttcggggataaaatgttcaaaactaaatttaatttaaaaaaaaaattaaaaaattttttcattctttccttcagaaaatgttttttttttaaattttatttaaaagtatctatacaataaataaaatttaattttttttttatgatttttcattttaattgcatcaataccaaaaatttcattctctaaagtaaataaactacaagaaatcagaaaatttttttcaatttcaaatccatcttttaaatattcgtgagccgaattgtcgatgcaaaatttataaagaaatatggaaacatttacaatacaaattgatcccgctaaagagtcacagaaaacgggtctgggtcgttttcgtacgagcataatttcttggctataactttttttctttgcgaaacaaattcaacaatcatgttatcattcgatagcccaaattgttttctatcattctgaaaattttcaaatgatttcgttaaggttaaaaaagttatggccagaagaattcaaaaacatgtttgttcgaacatttttgccataacttttttgaaccttaacgaaatttttcgaaattttgaaggcaaatatcgtacacttataaatagtgctatagaatgatgccaagattgttggatttggttgccaaagaaaaatgttatagcccaaaaacttgtactcgtacaaaaacggcctggtccgacagaaaacagtcaaatttaaatcaaaaatgatttagacaaaatgccaagagaatgaaggagaaggaataaaatgtggggtccactgcgtttcgtagtccaaaaactgcgctggcgccgaaacgcgcggcgccgaaacgcgtgtgtcccaaaatgtgcaccacgaatcttagaaaagcataaagaatcccataaaatgctgaaaaaagctcgaaaaaagtcagttccaatgaatctagtgaaatgttttttttcatctgtcaaattcattacgccaagttttgctcattgtggcgtaatgtctttcaaatgtttctcgtttttcttcagttttcgcttgacaattgccttctcgggacagttaaaaatggcacaaccaatgcaagaagaagcatacgcgcatgtgcaagccaagtcaattggggcacaaacggcacaaccgagtgccaaatgcgtcaaataaaatgtggcacacaacagacagcatactaaaattatatttgtcaatatattttttttcag

SEQ ID NO: 27488 - DNA, 1129 bp, Heterodera glycines
  misc_feature (12)..(12): n is a, c, g, or t
tttgaaattttntgggcaatttcaactgttaaaaagaccacattgaataacattttcataactttctttttacaaaaaaaaaattttccaaattttatgaaaaaccaaaaattttcttaataaatttcattaaaagtcaacgtttttcttcagcgtcgcctagtacaaaaagctaaattttttttctaaaatgtagctcaaaatagcaaaattttgtcattttttcgtgtaaatctgttcacaaaccaaactcaaattttcaaaaattttccccggcggcgcctgtcggcactgccggaccccccccccctcaatgtcctcaaaatcattttgaaaaaatgcaccttaaaatttttttgaagagtaaaaaagttcgatttacaatggcttgagatttctatgctaaaataaaggactataaaaacgccatcaggcaattttttcttattctttcaactgccatattaatacaacaaaaattagaatcattttgttcgaaccgggttcgtggctcgaattgggtcgaaatggatgtcaaaatctgaagctccgacttataaatctccaagacatatttttttttaaatccactcgtacgaaaacgacccccgtacgaaaacggtcgtacgaaaacgacccccgtacgaaaacggtcgtacgaaaacgaccccgtacgaaaacggtcgtacgaaaacgacctggcccgtaaagcctaatcccatgcaattggacaacgggtgaggcaaacatcgtaaatttttctcaagtcatttggttgatcagctcaaatggcacaacggagtcaatcggaatttggccaccgcttggccatccgacgcattggcactttcattgggcggaaaagcgaggagaatgtcatcatcaaacaagacaaccgcgaagtgatggacaatcattgagcagtgacgggaccaattgacgtaaacggcgaaaaacgatggtgttcaaaagcgggtccactgcgtttcggcgctcgcgtttcggcgctcgtgtttcggcgctcgcgtttcggcgccagctcgtttcggcgcccgcgtttcggcgccaaaaaaaattataaaaattcaaatacttgttaaaatcaacaaatcaaaaaaaataacacttt

SEQ ID NO: 27489 - DNA, 1180 bp, Heterodera glycines
  misc_feature (1116)..(1116): n is a, c, g, or t
  misc_feature (1128)..(1128): n is a, c, g, or t
  misc_feature (1130)..(1131): n is a, c, g, or t
ttagtcatgggattacacacatgcacatgtggtgtagtcgttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgatcccttgttttgcaataatctgaattttgaggtctatatctgaattttagtgttctatgtcctgaatttgaaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctacaaaaaaccattaaatgttgacactttaaaaaaatacatacctatttgttttttcaaatttactttaaaagtaaatttactttataaagtaaataaaaccacaagatacaccaagaaaaactaaaattttcagaaatgcgtttttggttaagccgtaaaaacaaaggagatgatgcagtaaacgatactgatttggaattggaattctctaataaacttgatgatttggaaaatgataataaagcagaggggatcatcggagacggtaataaatggataatcacttgaataataaaatgaaaaaaaattccgcagaaaaaaatacagcagaaagcaaaagtttggaaaatgcncctcattcgcancnncaaatcaaagaggtctgcaaatctcacaagaacagcgattatttcatta

SEQ ID NO: 27490 - DNA, 1321 bp, Heterodera glycines
ccaatcccgcagcgggatccgcaaatttgattttttgtgcgggattatgcgggattttatgatttttttgaaaatttttctaagacagaatgccaaatatttttaaataaattaaataataaatttaattaaagttaactcatttttcatcgcaaatttcattcaaaatttgtgaaattttcccggcggcgcctatcggtaccgcccgataggcttttacttaataatcctgtagaaattgagtaaaaaactgcgtcatttggtcaattttagacaaaatctgttaacaaatcgcattaaatttcataaaatttctcgcagatgtcgataggcaccaggtatggcacggaaagacttccgatttccgacatttttggggtcggaattccgacttccgaaatttttgatgaaaagtcggaaatttttttaattttttttttcaaaaaactagtaagttttgtacaatttctgttaaaagtttttgaaaaaatcgcgctgtaaaaaacgtgtaaatagtcactccttttcccaaaaatgttctaaaataatgaaaaatgacaaaaagagattttgataaaataattgaataattttttcaagcgaatatactaaaaacatttgtgaaataccttttacttggttaagaattaaaaaatttagcctattaaaatatttagaaattttttattatattgtatattttttgaaaaatttccgatttccgacgtttttggggtcggaaatccgatttccgacacttccgaaaatttttggagcctcggaatgccatccctgataaggaccgccggacccgctgttcctagttttttgaaaaattgcaccgcaaaaaagtggttttgaaaagaaaaaaatagtcaaatttatgaaccgttaataatttgatttccgatcaactttttaccgtcggatccaatcgaaaaatcttagtcgacccatcagccccttttaatacatcccgccagcccctaaaaatttatttttcagcattttttgatttttggaaattttttgaatttaattgaaattttttcgaattttccaaaatcccgcaatcccgcaaattttaaatgcgggatttgcgggattaatcccgcgggatcccgtcccgcaaaaaattttgagttccagtcccgcagcgggatccgcaaatttgaaatttccggtctctagtaacaacactaattcaaataaaggaatcaacaaatgaaagtgagagaggcatttctcatcaaatccgaatcccattgggtgagatcgttgagcatttcttaatatatattaataatttttcgtgctttca

SEQ ID NO: 27491 - DNA, 1504 bp, Heterodera glycines
agggcgcggagcaccctttgaggacgcgaaagcggccgaaaagtccgcccacaaaattatgaatgcctcctcgcgatgcctgtagaccgaaaatcccttggcgtccgcgcatgcactagcaacgaagtcctttgcgcgaagcgctcatgtaatgcatattcttttcatctctcacaagtatactgtctacaccgagcaattactgtgcaaagccaactgcctgcaccggacccccgtcaattcccacacgctagtttatatatatatagagaaaaagggggactcgtcttaaaaaacaaaatctcccggccgaaggccgggagcgccccgaaagtagtggaagggtcttacaactttttgaggcgcatctgggaaaaatacgggtttttctctctggtggccaactgagtcccggcggctaatttctcacttttgcttgcgtttgaaggcccataactttttttctaaaactcgaatcaaaaaatgcccgctgcgagggcaccccgccaaagtgtcctctacatgctggtattttttatttttttaatagagccaccccctggcctgcagaaaatggcaactgaagcgtgctcaaaaagtacacttcagtaccaggcgaataccgcgtcggcgtttgatctgagggaaagttgcccagcagacttattgtagagttttggaagctcgattttctgaaatttaaaaatttcgaaaattttcaaaatttttcgagctaggcctaaaaaacggttttcgggtttttgaattttaggattttttaacgaattttcctggcaaaacggagaccacttccaaaacatagtttttcgagctctatcgactggtatttttttcggaaaaatttcgattttttcccggaaatagaaaaattttttggcctcagcgggacatttgagtcccgggcccataactcgtcaggagttgattttagcgaaaaattgtctaagaacatttttgtagagaattttaagctctatcgaacggtgtgctatatgcccggaaaatttcaaaaattttcgagctaggccccctagaaattttcgaaaatttttttaggcttgaaaagggtggtgaaaaatatttttctggggtattttgaggtgctgagcacgaatttgacttttgtttttcgtttcatgatttttggaattttttaaaaattctttattttttggcaattttttggcccacgggaatttgggtcaatgtttgaaaaatcataactcaatgaaggactggtcaatttaagtgaattaaagctttaaaaatagcaaaaaatcaggagaattttatgagatttatttggttttataatgttcaaaagaaaaaaagttattccagaatttctggaaaaattcgaattttcagaaaaaaattcataactcggttctgaaaagatatttgggaaaagtaaaatactacaaaaatccgcaatttttttctctataatatagattttatttgacaggtttatctctttttt

SEQ ID NO: 27492 - DNA, 765 bp, Heterodera glycines
aggcacagaaattcaccgcttttcgtggctaattttcaattccatgaaattttcaggtcgatgtcagcggcttccgccccgaggagatcaacgtggaggtgattggtaatgaaatcatcgtcaatggggaacatcgcgagcagaacgacagtgagttttgccattgttcgagtaattttatcggggttttggattttggtgagacaaatgtcagggcttgagtgttaatggattcatttaaaatgcttttcggaaccatatttagccaatttaggcttacatttagcgaatcagagaaatatcgagaaacttctttcaatttggaaaatttatatccgcatttctgccatttatggccatatttttgcaaactcttgattttttacgtcccaaaatacctttgaatggatttttcgaaacgcaaaaatattttttttcgggtcgggcatattccgaatttatgattgatttaaatgcaataaatgtctagtcataatgctgtttttcgatgattcattgccccctccaactcaggcgaatcggtccaccgtcagttctcgcgccgtgtgctcatcccggagggcatccaaaaggagagcatcaagtgcgagctggacggcggtcgcttgtgcatctgcggaatgaaaacggctggcgaaggcggacgtaccatcccaattgagatgaaaaagaaagcggccgtggaacatcagccgcaagagagaaaaaaagagggggacaaatgagacgacggaccgatcgatc

SEQ ID NO: 27493 - DNA, 1313 bp, Heterodera glycines
  misc_feature (38)..(39): n is a, c, g, or t
  misc_feature (44)..(44): n is a, c, g, or t
  misc_feature (47)..(47): n is a, c, g, or t
  misc_feature (56)..(57): n is a, c, g, or t
atcaggaaaatttaaaaagttaaaaaaattatgttaannaactnggnaaatttggnngtttaaatgcgcgattcccagcaaaatttttttgtgcgatccgcgattctcgacccgcggcttccgaggccaagctgagaaggcgcaagaaaagcgaacacttcgagccaaacatcggcggagatgaagctgaaaaaaaggaatttaaattttatatttttttttcgttttttacatttcttttttgttggggcgtcgtcgttttttgacgttgtcccaaaagaaccaaagaatggtgccacagccgaccaaatttctgtgatttttctcaaaattccgcaaaatcgtgcgccgcctttcttttagctgtttctgatgagtgccaccattgccgtcagcttcatcatttggttgcattcctttgaacatgatgctgcgaatgggggccaatttgagctggtgaattcgtgcactcgtgaacggttgacaggccgaagaattgggaaggacgaccaatttttgattgaacggtgtccaatcgttggcaaaagtgcggaccaacgggacgaaagtggccgagaagaagcatggaagacggagggcgaaggaagaagcattgattgttggaaaatgctaacttttggcactcctttctttgaatggaacactttttcgtagcacatttcaatgttgtatgtgccaaaattggacgcagatatggttggcaagaaacaataagcattaaaaaagttgttttttcataaattttcgtaaatatttaaaaatcacacacagtccaaggggtgcgtagagggccgggggaggcagggtgaaaaacgaaaatttgttttctcggcggacacctctcacctctttccccgttgaaaagttagaattttttggacaaaatcactactacatcgtcggacccactttccaatgctttttttcttgaattcattgttgcgtgctgagaatgagttaaaaattggaaaacattggcaacaactcatgacaactcatacaaaagacaatttaattttaaaaaattaaaaagaaatctttcctattaaaaaatattgtaaaatgttaaaatgaaagatgaaactagtctattctttgataggtcccttgttgtacgagttgtcatgtcaaaattggatagtcctaagaatcctctattagcatgcaaaatttcaaaaaattccgtctggtttcaaaaaatttatagccaaaaatgtttagaaaaccaactttttaaaattttctggccataaccttttttaaacataatgaaattttttgaagctttgcag

SEQ ID NO: 27494 - DNA, 1643 bp, Heterodera glycines
ctttttgggggcttggaaattccgcttcccgaaaacctcagaaatcagaaaaatttgaaacttcacaaaaattcaaacagttaatagatttacatgtattttttccgaagatctccgatttatttttaaaaagaatttgtttttaattccctaaggaacaacccctggtgaaactaagtgtgctgatgcaaaccccctcctctccgttccccccatcaattcaccggtttggcgcaatgcgataggtcgaacagctggaccggggcaacaacggcgtcgtcgtcgaagttggcatcgtttgtggggcggtaccaccaccagcagaagtggcacagcatccaccgcaactgtgccgttgtcgctgctgctgctgttcatcgacggcaccgttttttatagttaatgtcgccgtcgggtcgatggcaccgccggcaccggaaatgattggacatgacgaagacggcgttgtggcggtggaggacgactcgctgacactcttcagcttcatcaagttaactcgcgtttccaacacgagtcgaatcatgccgtcgtatttgatgtcaaagtcgcaccaaatgccccattcgttgaccgtcgggcgggtgcacccgcacaatttggggccgtgatggtgcccaggtccaacttggacagctccagcgtctcgatgaaatagggcaactgcaacttttacaatttgtacgaagaccattgactaaattgaccgaaaaacaaacaaaatttcaatgaaaatgagtaatttttttactaaattgatacctttttggcataaatttacatttttgggcccctcaaaatcacccaaaaaatcggaatctggaaaaacaacgcacatgaatggtggccaactttgtctgaattttgttccgaaccgcaccgcaccagtaattgtcacggcaaaagtcgtaaaacaccctggaaatttgaagttaatcacgaactccaaatttcgaattttcagaatttaaaaattgctaaaatttttcataatcacagtttaactattaactattttttgtattgtaataccgagaggcgatcaggttgaccaacaggatgaactcgttgttgctgtactgctcccgctcctcctgctctgttgtcttcgtcgcttctccgttttgttttttgtgttggccattgttggcgttgcggttattgtgccgcgttgtcgtccagccgaggtccatccgaacaacaccgccactatcagcagtgggctgctcatcacctccgacaccaccgtaataaggggacgaggacgacgacgaattggtgacacccgaagcagcggcacagccaagtccggcaatcatcgtggccaactgcctacggtagggggaggttgaaacaaaaatatgggttatggtacaaaaaacatgaattttgcgatgccagaaagatggcacagtgaatatttgaaaaaaaaactaagaaaaaccaatttttgaaaattaaacaatttcctcaaaaatgcctaccgcatcgctagttcttacggtatattatttatagtcttactacggtaggggaagacaaaaacactcacttcgcaaattgcgcattttggagagtgtaggcgacgcgcgcgtcggacaatttggcagccaatcgttccagcg

SEQ ID NO: 27495 - DNA, 1852 bp, Heterodera glycines
aattgcaaacggaaataatggaacgcaatttgagcagacgctagccgaaagagaaatggaatcatttttaaaagttttaaaggaaagcgaagaaacgctgagggatttattggctcaaatcgaattggaccatttggtgccaaattcggcggagaaattagtcgaattgaaagacggaaagctaattgaaagcccatcattggaaaacattcaaaagcaaacagagcaatttgtgaacaatggccaacattcgcaagaagcaattgatatggcaaaagatgcgctgtcatcaatgaacacaattaaaaatgggcaacttttttttcatctttccattgaaaatttgaaaataattacagtggagaaaaagcagaagaaaatgccaaaaattttggctttattatcgcgaattaaaatctcaggaaaaaagaaaaagacatgaacaaagttggcacacaataagcatttttaatttgctaatattattaattaacattcgtaaatgcagttaaattgaaattttaaagtttaaaaaatttgcaatttctacctattttcaaagaattaataaagtttcgtcgtttttttaaataattgtttcaattaatccattccaaaatgtaaaggaatttaattttctgtacatttacaaattgtgcatttatcttttgagaacacattcataaaaatgaatatttcaattttttaggtcatcgttttgccgtacgaagttttgttaaccccataaatttttgtgaacaaatccgcaacagaatgctcatttattctttgccatttattcaataaaatttttttttcatttttatctattacaaaaatcactggattcagagcccaacgttaaactttaaaataagagttaatatttctaaaatttcaccagtacttttgggtaaaattcgtcataagcctaagtttaaaataggaatgggaatttaagtcaaatgatttttttctgctggttcaaaatacctttaaaatgaattaaaaagcattttaattttatttgaaacttctgaaaagcatggcttttttctattttggcatttatattacatttttgcatttttatattttttcatatttgaaacaaagtgctgaataatcgagtcactggaaaaaaaagtatttaacttaataaatttccatccctattatcattccacaaattgaaaaaaaagcactgttaattactaagaccgggcccggttaattgtcgcttcggtccgggtagagaatattgattatttatttgaatttgcgcgccatacagtaagctaagaaagactaatgattatttgattatcttcccccccccccgtcaattttcccatcgttttgcatcattcattttcatttggctttcattttgcatctctgctgtttcgcatttcttttgatccacttaatcgaaattttatttacgagtcgaaaagattattttgggttttccgaatctgacattaattccgacctatgtcgaaccccgaacccggatccgggtaaaaagtcgaaaattcaaattttataattctcatttttgggcttaaatgacatatgtatatagggaaggaagtaaactaaaagtcaaaaaccctctaataaaagatcatttcaaccatttctagaccaacactgagaaattcgaaaatttgaaatagaaccgaaagaattgtatagaaatggcattttctaaatcaaatatttaagagattttaaactggtaaaatgtcgatttctttgaatgctacaaacaacgatttcacaccagcagcagatgagggtaaagagaaaattaaaataaatattgaaaattaattaaattaaataa

SEQ ID NO: 27496 - DNA, 1226 bp, Heterodera glycines
  misc_feature (31)..(32): n is a, c, g, or t
  misc_feature (44)..(44): n is a, c, g, or t
  misc_feature (77)..(77): n is a, c, g, or t
agtgcaggaaattattaaattttaaaaattnnttagttgctttntaaatatgccaaaaaatgtaggcttaacttttntagtgaaaattcgatcactcatattttttgctaattgagcagaagcgtaccaaactttgcagggatactccccggtaaaggactaacttacactgaaatgagcgccgaactagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcattccctatagtctgtactttaattctgcgttggagttttgctccccataaatgtttgagtaccccaaacggacacttgaaaaaatcgatttttttgttttcggggcagtccccccgaaccgatgcgcccagatttatggggagaccgaatccttcgggaataacttccctataatctggactttaattctggggtggagttttggtccccctaaatggttgagtacccccaacggacacttgaaaaaatcgatttttttgttttcggggcagtcccccccaaccgatgcgcccaaaattatggggagaccgaatccttccggaataacttccccataagctggactttaattctggggtggaattttggtccccctaaatggttgaggacccccaaaggacacttggaaaaatcgattttttttttttttggggagtcccccccaaa

SEQ ID NO: 27497 - DNA, 1688 bp, Heterodera glycines
gctcgtctactccatgctgaatttgataccatcaagcgggggcgaaggcagactccctgctgtgcaaatggcgccattcacacagagcaaatgagctccgaattgaacgaacttcaaagcccccctcgtgtttacttggaaggcttggtggatgctgttgacgagagggttcgagaggcatttctgaacaacatgatggcgttcaacaacctgttcgcctttgcatctacacatggcgaaaaggccccacctgagcaaatggggggccgcctggacacgtgcaaatacaacggttaagaatcaacttatacatttttaataaaaaaatttaggggaattttcgttcctgttcagcgacctaattgccccgggggtccgtcgcccgtcgtttgctcaggtttatacattgacgccggaagacgctttgaatgtccgtgaaggggcattacacaccgcagttgcgccgcacatcagacgcacaatcatccagagacttgaggcgctgatgcgggcaaacccatttggtcagacattccagacggtgggtacgaagattgaggcagctcgagcagcaacgggagaacttccgcattttcgagtacacctacaatgaatcaatttttgattaaattaaaaaaatttattaaagattgccctgttgacggatcggcacttaaagggggttccgcttcaaggacgcactgatattactgttattgaacgagcggatgcaccgactgccaaacaagtggctgtaatttgggtagaagaggatgggctaccaccacagatcagcggtaataacaaacgatccaaaaatagtctcatcataaaataattaagctttctgggtgtccgacaaagccgggaagatgcgcgagctgaagagtggcatgccgcaaatcgacccgtgctgcttcccactactccacccacttggcacacttggatggcggtggtttatgaagaagcgtgggtccgaggttataacgagaaagcctatcaaaatcaaaaataattaaaattctcaagaacgcccatcatgaaatgcagcaacaagaggaaccggatttggaccaaatttccgacgacgaattgggcgacgaagttccaatcgatgacattgtgggtacgcagaagaatgatgaggaaattgacgaaatgccggagctcgaactggaattggacaacgatgttgccgaggaacaggaggaacctgatatgaatgctgtgggttcgtctactgcacagccaaatcccggacgcaatgaaaatgaggacgtcatctttgaccatgaagtggagactcgtggaggccggaccaacatctctgaacgacagttctaccgctaccgcatggcacttcgggggtccggcaagaacaccttccattggttgtggttcgcgcgacgactcgccgagtacttcaccatctctgtgctcaaccggatcgagcgaaacgaccttgaacatctgaaggcaatccaggtcaagaagaactaccggcagcttctagcccgtgaatatatcgccgccatggagaagggggtccgacagcaaggaccaaatgccaagctcggccgtgttttcctcatgccacagaccttcgccgggtctcggcagtattaccaagggaagtacgccgacttgatgacaatggttcgacacctgggggctccgacttggta

SEQ ID NO: 27498 - DNA, 914 bp, Heterodera glycines
  misc_feature (35)..(35): n is a, c, g, or t
  misc_feature (870)..(870): n is a, c, g, or t
cttacgtctacctcgtactattttcatattatttntgttgtttttcacattgattccaatctattaaattgtgatttttcgatttttaataaattatcatagtacaaataacgcactctctgaacagcaactggcgcttttcgaggaaaatagcactgaactcgagagcttttacagaaatgaatcatctaaacatttattgtgcgctattgaataaatttctgttaaacatttcatagtgtaaatgaaagttcccgatgatctaaaaacaggacatgtacaaacacaacagatattcctccgcccatctccacccattgttggcaattgtgctcgactgcagcacttcatgatagagcaaacacagcaaattccaccgattgattttggggttttcgtctttcattgaaggcatggcactgcctcctccatcggccaccagttgaaagtgctgctgggcagccttagtgccgagaaaccgggaaatccgtattgccgccgttgcctaagtgtggtattcagaacaattatttaccccccccccccctaaaaaaataatttaaaagtttcggcgattttttgaaaaattttttgagataataattcctcattcatttttgaaaaaattgctagaaagaatttccaaatttttttaatgaaatttctaataaaattttgatgttttgaaacctttttgaaattaaaaatatattggcaacccaccagatagaaagagacttttcgctttctattgccagccataaagtaaagacgtgcagcatgttcgagtagtatagcgtcaaacaaatcggaattcaactgaagagatgccccaacactaatcatttgctgagccgcctcctcaaagangtcgagccgacataaaatctgcgaaaagaatggaattaattatt

SEQ ID NO: 27499 - DNA, 997 bp, Heterodera glycines
cgctgtcccaatgaatgaaattgaagtaaagcatactgccccaatagggactccaacagaggacgaaaaacaccgaaatggcaattgtgtaaccggcgatgcgattgacgggcaactgaaagaggcgcaaaagggggcataggaggaaaagcgaagggcggcggaacggacctttgaagttgttgggaaagagcgagaacggcggaaaagccgacgcatcatcaaagcgtaaaagacggtgatcagaaggatgggcagaaagaaccttcggggcgagggggtaaatgcacggcaaaaaaaagggggggggaagcagtacccgacgatgaacatgtaggagatgaacacggctaaacaaacagacggacaaaagtaaatcgatcaaaagcattcattggcactcacaaagcatcgtcccctccaaatggtccatgcacttgaaaatgcgaaccctcgccagtcggtaggggttttcgagtagtacttccttcagcacaagctccttgcttgacgattttacgagcagcggggagagaaggacgaaagtgagcaaagtgagcagacaaagttggaccaaaaccatccgacgcctaacggagggggggggggggatttacaaagggttcaaattggaaaaaagggaaattacgtcgtttttttgtgggggtggcaaacccgaagaaagcgatcttaaacacaattattatggactgacattgagcagagacactgcaattttgttaccaaaggccattgcggcgagcacaaaagtgctcaacgccctgccgacatgttccaacgccctgtacaccttgcaaagcgcggtgccaaacatccaaaaaccgagcagcttaaacaggggaagagaatgggtagagagagggcgagagagagggagagagagtgagagagatagagagagagagagatgggggggggggaaagatatgagaggatattaagtaaaaatataagaaacaaataaataaacggacag

SEQ ID NO: 27500 - DNA, 1066 bp, Heterodera glycines
cgggtgttaagtttggttatcaattgcgtgtcattgtgccttcttggtcgtctgtatacacaacgcgaacatcgaattgaggtgggcatatatctatattttttgaaatttattgcaaaagcgaaaaatgatacataattaatatttaaaaattaaaaaaaattatgaatgaaaaatgaggcattttctcagtggaaattttgaatattttctgagaatttaaaaaaaaattaaatttttccagttccattgactgtgaaatcattttacaaatagaattctgaattctgatcacattagtccaaaaatttgaccgaactatctctgatcaatttacaaaaattgattcgattttcattaaaataaataaataaaaattttgattattagatttatgcataaatctttcaaattctgtgtggatttcaaggcgaaaaagcagctgaaacgcattcactatctgttagtcatttcgctggtctccactctgacggtggccatccccaatggcatttcgttgacctcggcatggtttggccggttgaacatcgctttatccgatccggcaaattggatgattgcggccaaatgttccacgaatttctttgtttatttgtttcttaaagcggtgagcagtgaaaaaaaaagcattcaaaatttttcaagaatggaaaaatttacatgaaaatttaatttctaaaaattgaatcaaaaaagggtaaatgcacttaggcattattattaacaattatttaaatttaatggaacaattctttaaaatgttaaatttaaaatttaaagcaataataattaatttaccgttaaaatttaataattattttcttgttttttttaaataaattgaacacataattgaagggctatcgacagcgcatttacgaaattttgggctgtgtgagcattgatcaacggttggaaaggcgatttggcacaacgagctatgcagctggtggcattggcctaaatgttggcaaaattgctgtgatagaaccgctcccatcacatcaaaaggtggtggcaggtggcacgcccttaaggggggggg

SEQ ID NO: 27501 - DNA, 1451 bp, Heterodera glycines
  misc_feature (37)..(37): n is a, c, g, or t
  misc_feature (54)..(54): n is a, c, g, or t
  misc_feature (70)..(70): n is a, c, g, or t
  misc_feature (77)..(77): n is a, c, g, or t
  misc_feature (79)..(79): n is a, c, g, or t
  misc_feature (94)..(94): n is a, c, g, or t
  misc_feature (108)..(108): n is a, c, g, or t
  misc_feature (171)..(171): n is a, c, g, or t
  misc_feature (223)..(223): n is a, c, g, or t
ttgaaaaatgggcatagatgcttttttatgataatanttagttatttttttcanaaaattctcccaaatncgccgananattttcaattttttnttcaaaatttatanggcgtttaatgtaaaaaaataaatttcggggggagcagggaaacgttgtgcatccgcttcccncatatcaattaaaaaacatttttttttttttgcattcagatcttccaccctnttgttgtccttttgccaagtggacgaattgcgaggcccaaccgctgcagcaattgtcgctgttgagcccaacgagcagcagctgaacacgccggcacaggccatggtcaacacggcacggctcacctttgaggaggccatcttccccgaagtgccgttgaccgccctccaattgttggcatttgtcatcaaggcaagacacaattgtggcacttttgttcactgctcaacaaatttctctaaatttacataaatgtccattttcttcgattaaaaaaaaagagtttgccaagcaatttcctagcatttaaatttttttcaatgataaaaaacaatgtttgctctctttaaggaaatttttcataaaaatccaaaataaaagccaaaatttaaatttttgtacatactttttgagaatttagaaaaaaatttaaaagaaatttaaaaaagagagattttattgaaattattgtttaattggtcaatttttgcttaatcctttccaaattaaggagtccgtcgatgttggcagaggaattcgtcgccttttctcctcctccttcgaccctttgtgtgcactcattgggcaaacattgcgaaccgtacgcattgatccgttgctgtgccctccgttggcgccattccatgccaaacaaattgctgaagcactgcgactggctgaatgtaatgtgaaaaaataggcaattaattatgggaaaattcggacataactaattaaaacgaattaaaactgaaataaaattcgaaattaatcccgataaatgttggaattttgtgcaaatgaatcgaatgtagtactttttgaagtgttaattccatgtcatcgaaaatcgtttttccaactattagagcgtttttttgataaatcaaaaaaattcctaaaaagatttgactcgagaaaaaaaaactgttttatatcattttaatagtctaatctgtcctccacaaaatggcatccaaaatttttttgtcacctttcaaaagtgccgaaatttttttattttaattttttttataattctttcatcaaaatggccattactggtttttccagctttaaccctatatttattgcctagaaattttttgatttattaaaaacggaagataattatgttccaatcccaatattaagcccttcaatagcctttcaattaaaaaaaaaaacaggaaccttttttgtttagcgttggcaaatgacgacgact

SEQ ID NO: 27502 - DNA, 772 bp, Heterodera glycines
gtcattaaaaaatcagactttgacgcttctcaccaaaataattaaaaaatttggcgttatgtctccattttctcactattttattaactatttagagattttttatcactaaaagtcgcggctctagtcattaaaaatctttgaaaaataatccccccgtctccattaaaggccctgtctccaattatgtccccccttctgaagaggttgaaaaataatccccccggggccttaattagagaatatacggaatatctaagaaatcagaacaaattttggtcgctaccccaaaatcagaacatttctgacaaatcagaacatttttattttatcagatttggaccctttgttgtgtcatttattcaacaacaacaaatacaatcaattacaaatgaataataaataaataagtcagaggttaagagagagagagacaaattgtgtgggggtgaaatgcaaatgataaatgagaatgaatgaagtccgaagcgaggaaggaggagggaagagagcggtatttatgggcgatgaaagtgatgacgtgtcaattgaacataatgccaagaaaatatgaaatggcaataacacaacggcgcgccaatgattcgtctactcgacgattcgtctactcagccaaaaagtgacgattcgtctactcagacaaaaagccatgattcgtctattcaacgattcgtctactcgacaattcgtctacccagccaaaaagtgacgattcgtctactcagcaaaaaagtaacgattcgtctactaa

SEQ ID NO: 27503 - DNA, 890 bp, Heterodera glycines
  misc_feature (859)..(859): n is a, c, g, or t
gggtcaggggttcggaatcggttgaaatggatgtcggatttgtgatcagtgtttccgaaaacctctagaaacatgtttttatgattttttgaaagttgaaaaaaattcataaaaaagggggggtaccatctaaactattaccgatatcaatacaaaatatgaaaaaattaaaatgctatttaaagattttcgtaaaattttcttgtttagttttgcctttcatcaaattgatgttaaaaatttcagatgaaagatgaaagttattaaaaagaaaaataatttttttatttcatttgtacttaaaaataaatatttaaatattagtaaatataattttcatttttcctatttgttaattttttaaattataaaaacattttgaaaacaaattcagctgttcaacgcattgttgacctgcatgttggtgttgatatgctcaaaattttggacaattatgctgagggtttttcgggtgtgctgaaagatttaagtgccaaaaatggtcaagcaacaacattcaatgccatgttcacgacggcatatttgaacattttgtccagtttaagcaacaaatgctatgtgtccattgaggaaggaccttttggacgaatcggctcaattataatcgtaagaataatttattttataaattatttattttgcattttaattttttggagagttaaaaaattgtttttttccgagtccattaacattttttttttgaaaattttacccaattttattattttaaaacataaaaacccattaataatttcttggaatttaacacaaatttattatttgaaaacataaaaattaattacaaacactaagaaattctcaatttttcttccanaaatttaaagaaattaaattattttaaattt

SEQ ID NO: 27504 - DNA, 1026 bp, Heterodera glycines
  misc_feature (8)..(8): n is a, c, g, or t
  misc_feature (967)..(967): n is a, c, g, or t
tcataaanagtcgattgggactcataaaagtcgattggacccttccagtgcattagagccattaatgttttattaagaaatattgttttttcatgattttgcttttgtggattgttattaatatttttttacatttggcctttttcgccaaagagatttttttattatcaattaacgttaaatttaaacattaaaaagaaacctaatttattctgtacctataaaatgtcagaactgaaagacgcaccgacgcattggtcgggaatggacgaaaatcgggaggaggaaatgatgcgcgagataatgacgaacggacccatccaaattagtgtaaatgcatatgatgatatttacaactatggtgaaagcagcaatcgaatcaatgtttacgtggtaagacaatattttatgtgaattgaaggaaaggtctacatacagaaatggcaaaaaaaaagcaacctattatacagttaattgtatagttcaaaaaaaaaacccaggtcattaattccgccccgtttttatagtcaaaacgccattgtaagccagctggatatttgtgtgggggtcatttttcacgaggtttttttcacacatatgattttgggaatttgaagacttccattaaatttttattgccataatttttgaatgggaaggtctaataccgacacggttttttgagagaatgaaaaaatgtaatctaagggtttaagatatggggaataaaatggttatacgtataattgccaataaaatgttaaaaaatctggtcagttgatgcggtaaattagattcgtgagcataggtatttaaaaaaagaaacaatgctaaaaaatgcattatcattagggctatatttcatagttttttcatccctatgatatgaaacggaaacatgttttttattttggcgttttgcccacattttaaaacaaaaatgcaataaaaacgaaatacactctanaattttattatttatttattgacaaatttctaaaaactatgtattcacccttttttttt

SEQ ID NO: 27505 - DNA, 2319 bp, Heterodera glycines
gttagatgcttgacatcaaacgccgcatctgtgggccattgcaatacgcaccaattgagacaagtgcaggtgttggatttgtgtgcactgatgttgaggcagctctggaggcgcgtctttcatctgccaaggacaatctgatcagatttggcgacgaaatctacataaagctgagcggcgaccatggccagagttgtacgaagattaccgtctcattcagccaggctgctcggtcaaattctccatcaaacaatttcgtctgtgccgttttccctaccaaggatagccgcgaaaacttggagcgctatggaatcacactttgggaacaaattgacggaataggcacattggcgggcaaacgagtcaagtggtaaatttgaaaatttgttttttaccattttttgaattcaaacggtttatgggcggagacttcagttttatttggtcaatgatcgggcattgtggttctgcagtgacaacatttccgtctccaatttgcagttgcagaagtgatcatttggtgtaggagggcgaaatttgtgaactccggacaattgatcaaactgtgcagttcacggagcaattcaccagagccatagtgaatggcgaaaaggcaaacgcagcggtcagatcggcgatgatggggatcacgaaaccaccgcttctcctgtccattggatttgaccggattatccccgcgccatttcacgttttccaggggattggaaatgccttaattcgggaactcgaacagcaggaaggatgtgtcgaaattgctcaacacttttttcggagattcggcgcgcggagggagcaatttcgtaaacgagacatgactgggaattcaattagaaaaatccttgtccatgcttctgaaatggaacatctcttttcgacggattggccaattacgatttgcagaacccttgtgcacctcgggaaaattcaaaaattttcaaaagtcccttttttctcttttcacaaacttaaattcgaaattcaggcagagccattgtcaccgaatgacctggatgagctagaggagcgtgtcaacgattttaaatcttttttgtctgcccaggagcgaatgcgcgggtttctctcaaagaagccgaaagcacatcttttgttgagccattttgttcccttcgctcgcgagcacaagtttcttggccttttagatgaacagggttgtggtgaaaaatgttttctatcccattaatctgaattttaaggtgatgaggcgctccattccgtttggcgccgacttgagcaactgtggaagtgtatgccggacgcagaccaaattttgcagcaattggagcaccattttgtcaacaattggctcctcgacacgggcaaaattgatgaaatgaagcaggtctgtatgtttggagggggtgattgcgttaaacttgttttattttaaaatttatatataataattcagagacaaagtgatcagagggaagagcatgatgagctcgatcaatctgaagaagaaattgacgaaatttcgcttatcatctcattgattgatggtgatttagcaaaaagaaattggtgatcgacgggagacggacgaagaaagcaatggagaagaacaacaattcgattttgaataaaaacagttggatgaaaggtttttctttgtttttacagaaaataaaatttaaaaaaaattcttggcttctttaaaagttgttttatcatttcacatatatttatttgctttaaaaacctcaaaatacagctataacatgcatgggattcgaacctgggaccccccttttggtgactaactcacagaccactaagacgaaaaatccagcatacttgtacttggagcccaaaattgggccgctgtgtgatatgttttgccaaaaaatttttaaacagatttttgtttcttgaaaaatttatacgtttggattttttaattccaatttattaggtcgtataaaaattttgttgtcctaactcgatttgagttggcataaatttttgaattctcacacttttcttaaacataattaattggtgtcattcgataaagccaaatgagtcgcaatgttttgtggttacgcatttttcggaaaattatttcttacaatttttgtaggattttaggctaataagggtacttactacattggatagagcgaagttatgtgtaaaaacaaaaacaaaagttatgaggcctcaaaaattgaaattttcccgtttggattcgaaaaaagccattgtaaaacacacaaaaaattgaaaacaacaaaattaagtaaactatttttaaaaaaagcaaaaaaacgaaccccg

SEQ ID NO: 27506 - DNA, 1735 bp, Heterodera glycines
agggaatgggcctgagttcaaagagaatttacacaaaaacggccaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaagaagagtccggcaataaaatcaaaattgacgagccggctcaatatgccaagatgaactttcgtggtgcaacggaagcatatgccattgttcattcaatgccatttgcccgtctttcgcatcatgttgtcaaattggcaattcatttgccaaaccaacagcccattgtatatagggctttccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggcctcctatcggccgaattgttcctgtacccccatcggacccggaaaggttcgcgctctattcacttatgcgtcactttcctggagacccagaccatcttaagatggttaatgggttactttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaaaagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctg

SEQ ID NO: 27507 - DNA, 1848 bp, Heterodera glycines
  misc_feature (1004)..(1004): n is a, c, g, or t
ccggtataatttgccaatttgcttcatttttgcaatatccttccacataattagttgtttctgttccgctgtttctgttactgcttgaactacattagaaacattttttcctttttcagtccccgtcgaatgattttcttcttttttggacccaacttttgaagactcccccgcaggtaagttccaacttttcatctcaacaaaaaattcttttatggttttttcggtgaataatgtcttcatattttctgttaatgtctcgacactatgccacttgatatctaaaattgcatttattaaaaaaaaacaaaaataattttaattttcgtatttcaaatttttagggtgctaacattcaattatctctcttttaaatgtcatgtcgagcaccgctttgaactctctccggtgtaatttttcaatccattcccgaattttggttacattttccagtttctcttcactcttcattgcttcgtccacgacagtgtctttccattttttgaaaaagtttttcgttgattttttcaaagaatttttcatgaaaattttgctttgctcataaattttatccaatttattgccgaaggcgattaattgttccttatccatgttaaagatcggatcatataactcattaaacacataattgcgcagttttacccaaatttctaactgattggctttggccaattcccgtttcaaccacctggcgaacacgaacaaatcggtgccaagtgtgatgcttattaaccagagcggagcctcatttttttgctgatcaaaaaacaccttcgcataatttagacaaatacgtcgatcgtccaaaaactctgaccattagagatagagagagagagagagagagcgaaaaaaaggaagcgatattgataaaaagaaattgtgagcacacagaaatcgaatagataatagagaaattattgaaaattgtttactccaagagggagaaaagagagagagaatgaatgaaagagaaatagatntaggaagagatttttgggcacagaaacagaataaacggttttaactttgttgaaatagagaagatattcagtgtgagagagagagagagagagagagagaaataaggaagagagaatgaaagattgtgagagaggactaaagaaagagagttagagagagctcgagagggaagagagagaaaaagaaggaagagataaaagagagaaaatatcctgttaaatttttgacgacttgccgtctttttctgtgtaaatgtgctcaagcggtccgccgggcacaaacagtcgctcaattcgctgccggtcgccaattagcagtgccaaccgtgtcttcacgcacggcaccaacagaaagtcgcccagtattttcggcgcttttcttttgacagtgttcaatgactcttgcatccattgtgccatctggtcaccgcgcacaaattgttccagcgttcgatgctgttcgtccgcttccgtgcactcgtccaagccgcgccaacgcttcaccaatttttcgttgattttgtgtgcatttttggcactgatcggtgccataaatgcgtgtagtttgatcaatgtacataaatgtactgcatattccgggttactgtatgccaaagttttcactgccaacacgtgtgcccagatggtcttcaatgtgctagcactgatgttcaaatcactaattttttctgatagcatgttcaatgaattgatcaattggcttattgtccaatacagtaacgctttttggtgagacttactcatgctatggttgatcagcaatgttttgagacgaacagcatagtgttggataaataagtatgtctgaaaatgaaatggttat

SEQ ID NO: 27508 - DNA, 949 bp, Heterodera glycines
caatattcattggcatacccttttttatcaatgttttaaaaatattaatcactggttaaacccttttttatcagtgctcccaaatgaatattcattgttaaaccctttttttgaaactgtttaaaaatagtaatcacttgcaaaccctttttttaaaaatgccaaaaaatcacacccggtgaatttgtaggaactgtaggacaatgcgtgccaaatgtgcaaactgcaccagcacataggggatgaacgccatcaacggaatgtacaggtcgggcgcattcgcatcctgacagggcaacacgggcgcatcgccctcacatttgttggcccaattctatgaaaataagggtttttgaaaaaaaaattaaaaacccgcctaaaatgctaaatgtatagaatttcatttgtatgttgccaaaaattttaaaagaataaatgagaaatcaatttaatttttttttaatttcctaattttaaaaaggtaaaagttttaaagaattaaaaaagggacaaaaaattctcacccgatgaaagaacgggaacagaatgagggccaactttcgccgcacataattggtgtccaccgtaaaataatacttttggttgaacgacgtggacgaaagatattgggtgaactgcaaattgggcgggaaaatttatttgaaattaaagtttgccccccccctgacttatacaaattttgttactttaaaagtgcgccttattctggttgaaaatgcaaaaaccggggacacaggaacatttccggtacaccccaaaacacagccgggaataaattttaaaaaaaataattctaactttgaaatttttcaagaaaaaaatctttcaattataaaattttttcgttgaaaattccatgagaaaagattctgcaaaaattttttcaacgatattttaaaatgtgcagttgacaattttcttattaaaa

SEQ ID NO: 27509 - DNA, 652 bp, Heterodera glycines
tgtatgttaaaagtatcatgtaaaggaaataagtaccaaaaataaaactatggactaattggtgcaccatttatattttcaacaaaattttctactcattcttttttctgaaatatgaatttagaaattctgtcattttcttaaccataacaaagtggtttctgattgtgagaagacaaatttggaggggggaaaaaagcatacaatgacattaaatttaattcaaaattcgtcaattttcgaaaaaaaaaaatttattttttatttggcggcaaaagtgacgcaccgtcggaagaatttcgtaggcgagctgttcccgcttaaatgccggcataagtctgtggcgcactgcgtcaacgtcttcgcggtcgcccacgccaacaatcagcaaatccaactgaagcggaaacaaagggcggatcaatgaacgacaaatcgtttttttttgaaaggatagcttggagaaatttcattattttttttaataacaataattatatatgaattttcatgacataacaacaagaaccaagggcgtagctaggggggtaatgtaatttatgaaaaactcatgaaaattgagttttcccttcctattcactatttttggaggagtgcgccttcctttaaaaattttagaaatttttggcgc

SEQ ID NO: 27510 - DNA, 1247 bp, Heterodera glycines
atatattaaaatgaccggtttttgagagactgggtccctttttagtcgtttttgaaaatgccaatccggtccagtccggcgaatttttgcagttgaattttttaattctaagatttgctacaatagtaaaacgataataggtctttttttggtttctgtttttaaaatgggtcttatatggcaattgatctattaaaaatgtctaaaaatacagcattgacaaatttctcttacccgaactcgaacagaaagtcgaaattcaagtttcatttcattgtttttttgttagttggtcccgaacccgggtgagaaaaatataaatgaaatcagaggcaattaattcagagttacataaaattgatcatttgggaaaaatgaatcgaatttgaaattcgttaattttatcttttggtgaattaattgtttgtttactttaaaaaaaatctattgaaaattttgtttaaacttttcaagtagtgaaaatgactttctttagcagttacattatttgctgcatgcttttgatcacaatttgcttattctcgtgaggaaaagcattcgggtgattggtctagtggtatgattctcgctttgggtgcgagaggtcctgggttcaattcccagatcaccccaaaatttttagaaaattttaaagtttaataatttaaattacatataaattcattatcactttcatttacatacactaagaggttaattttcgttaaattttataaattttaatataatattttaaattttgagagagagaattttaacatttacttagctgtaattcttctgagactttacgaaaattttctgaactttaaaattcgccagctcatcaatgcaaacaaatttcaaatttcatttatgcaattaaaactagagatcggaccggtcggtttttttcggttttttccattttccgcttttcggtttccgagaaatttttgagtttttcggtttttttcggtttcagttttttttggtttttaaaccgaaaccgaccgaccgaatttatcaaaaaccgaaacaaccgaccgactttttttaatgcgatttgttaacagattttgtccaaaatgaccaaatttttgcaatttcgagccatttttttaagaaaattaaggatttttaattttggtaaacttatatttttataaattttgggtttttgtccaattccgtttcatatgcgtgttccagtgggttgtgctcttggttctgtctaatttttgctt

SEQ ID NO: 27511 - DNA, 921 bp, Heterodera glycines
aaatttgtttcggggtcattaattctgcgccgcaaatgtcattttgactgggcgccgcaagtgtcggcgccgcaaatgtcgttttgactgggcgccgcaaatgtatcgccgcaagaaaacgacaaaaaattattcattttctggataattaagtattttagtgccagtagatatttgtaacggctccaatgagaataaataccaaccatttcatcatttgccgcgtactttccgttttatgaaggatgacaaattttgactcgaactgtggcgggtcttctttccctgacaaatcatttgtttcttttgtgggcccaaaattggcgaccattggcaaataatcgtacatcccttggcaaaaattgtgattagtaattagttataagttttaaatcaaatattctattaaaataagtactcggatgtgtcgcaatgtttttgccgtgccaagtagcttaaggttaacaacaatttttcaaaaaacaaaacaattaaaattttgtccatttttacactcactggttagtaattggactgggccaattttgccattttgaatttgtgttaaaattggctccaaattgtcactgctaaataaaactgatgtatccacccaaccgaccgtgtcatattccgacaaaacttccttagaattgcagtggttttttgattttttaaatttaatttaccgccatggccaaaattttccacgcgaaacttttcgggtggcgcactcgtccttcaaccgtttgagaaaaatcgaaaattcgccattccaattcacagaccgagttcagctcagccatcttcaaaccaattaaaattaaccttcaattttaatttttcgcaatagttttaaaattacaaaaccactcaataatttgattaaaaaaacaaaaattaattattgaaatataaatt

SEQ ID NO: 27512 - DNA, 866 bp, Heterodera glycines
  misc_feature (28)..(28): n is a, c, g, or t
cctcggctcttttggttcccggtgcttnggtgcgttcacgtcgcgggtaccattagtaggcataattgccgaagcgaaaaccaaattatttttggagaaaaaattcaaattattaaaaatatatatttatatgtttttgaagtatgacgaataattgaaattttatatattaaaccaaatattttatttaaatttaagttagtataatttatgtgattaaaagtagatttttcaaatggggtgggaaaccattccaaattcccccaagaaatcatacaaataatttattgtggaagcaggagaaaatgagcaaaattcaaaaagtttcgttcacccaaaaaaaattttttatataaatttcaaacatttttaaaacttgaaaatttaacggaaaattttgccgatatttttttcatttttattaaacacggagagagagagagagaaaaaatgagacagagagaaatgacaacagataataattttaaaaaagaagtgaaaatttattaaattagcatttaatattatttattaaatttttaaaataggctataaaaacttatttaaagatttcttatgagatttaataactatttttataatttttactttatttttatgcgtattgttcaatttttgtaaaattttacattatttttttaaataattttttgagaaaaatcaaataatttacttatataagttattaatctttttctttatgcctgcctatttagtgaatacatcaataccattatttattaataattttagcattttggtgttccgaaccattaaatcaaagcttttatagttgaataacattaaaactctataaaattctgtttatatattaggttctttat

SEQ ID NO: 27513 - DNA, 1559 bp, Heterodera glycines
  misc_feature (14)..(15): n is a, c, g, or t
  misc_feature (1464)..(1464): n is a, c, g, or t
  misc_feature (1472)..(1472): n is a, c, g, or t
  misc_feature (1502)..(1502): n is a, c, g, or t
  misc_feature (1539)..(1539): n is a, c, g, or t
tttaattattgtgnnatatcaggagatcattttttaaattatatctaaattctttaaaattaggggtctttcgggtcaatttatttgaaaatttttaaacattaattaatttatattttttaaaatttaaggttctaccattccatgacaaatatttgggaagttatatgaaagaggtgcgtcaggaaagagaaatgagcaaaatctaacattttttgatgagatcatttttgctagttaacataaaaaaaactattgtttattttgtgataaatttaatatttaacttttctcaacaatttgaatatttaagaataaattttgcaaaatggaaaaaaaaagttaaaataatgaaaaacccagaatttcggaaaaaaaactttaaaactaataagcgttaaaatattttcaggttaagtttgtcctttatcgggaaatatgcctgtaaaatttggtgcgattttatcaattatatataaaggggtaagttcgatacaaaaatttaaaaatataagcctaaaaaataggcatatcactaatttttattcatcaccctttttgagaatataagcatccgagtgccttattaattaacatataaataaaatttggtgcgtttcagagcattttctgaaaaaatatttatgaattgattgtgcaaaataattttttttttaaataatggaaaactcataattttgaaatttttttagaaccaataagcgttaaaatatttgaaggatatgggataaaaaagtttaaaattggttgattcttttccttttagtatccctgcaaagttttgttgtgctaatatttttaacatatttactttgaatatttaataaattaatgaaaaaaaaatttaattttttaaaacgattttttaaaattttttttagtaaacttttaaaaaatgaaatcaaaaacccagtgaacacactcaaaaattgcattttcaacgccttcttggcatatcgtccagcccagagccgaacacggaagacagcgcgaagcctttgccaccaccggtgccgccagcttcgccgccgttggcactgctgccgctaccaccaccacttctgccgaagagttgtgccagtgcgttgccggtgtcttcgccggcaacgccgtcgtcggcacccgccgtttttgtgccttttgtgccattcattgatcccaaaatgttttcgagcccaaatgagcgtaaccaatccggcatttggggcaatttgcctgcaattaatttaaattgactagaattaatttttatgccacagcttaaagttcattgttagtctataatgttgatcagaatttgtaaagaatagtacaatttcaaatcatgataaatggctgatgggaatactaattattttcaatgcccaatcgaaatcaagtactgcccagcaattagttggatttatgcttaaatctgaatcctgttcaaacagattgtgagcncaatttanaaccaaagcataatcagtggatcattattnttaaagagtttgatcatttcgatctagaatccttgtncaacaagttttgcctaaatt

SEQ ID NO: 27514 - DNA, 1032 bp, Heterodera glycines
tttaagaaaaaattttcgggaccaataatctagaggattgccataacacccatggcatacccgtgtcacagtcaatgtattccttcgcgagaccgaagtcgattatgtgcaaaatgtgctgtttccgagtggaactccttccgataagaaaattctcaggcttcacatcacgataaatcaagtgttttgagtggacgtattctattcttctcaacttaaaacataaatgtatagaaaggttgtgtaaaacatgggcaccaattgcattgcggtcatacaaacggttttcagcgtaaattttctgtcacaaagatcgaaaagatcctccaacgaatggccaagcaattccatcacaagcgcattgtacttgccgcagggaccaaaataatgcacttgcggtagcccctctacaatttttcggtttcatttgtaatgtcgttggctctattccagtttacgcctccaatcatgaccaaaaagaacaaataatggcattaagaaacaataaaattcagtcttttatagtatatttagttacataaaactccctacttcaagcttaagcctaagaaacaagccggtaatgattgaacgtgtaaacttgaatagaaccatataatcattccaaattcaattcagtatttgtgaatttccttctaaaaatacccaaaacattatcactcggcttaccgcaaaaaaggtcaaaaatcgttttactattagctccccttgagggaacctgtttggccaagcaatttgtagaaacgatattccagatgaagctgtggcgccttgcttttcataggctccaattttatggccacatgttcgttgttgtaaagatttttgccaagtcggagctcgccaaaattaccacaaccaatttttttgccaaccttaagtgtagtagtaatttattatattatcataagattaaccgataatccaaaaagaatagggtaatactgacttttactggtcccataaataaaaaataaaaaggctgtttttctacggttcttctttcccccc

SEQ ID NO: 27515 - DNA, 837 bp, Heterodera glycines
tgtgcccccccccccccatcagatcgctgctctctgtgctcctctgtccccttctcctttccctcctccgtccttcttccacttgtttgctttgtccgttgcatattccggcccggcccaaaccgcttgatcagttccgattgccctccattcagaaaatagtgcacacagccgacactttcgaatggctctgtcagaatgggtcaaagtattgcagtggcaatggccaacaatttttgtttcgtaagatttcgctgttcattcaaaggttggccacggtgtccgctcaatgccgtgccgatgtgtcccatttgttctgttccctgacccgactggtccaatccttgaaaacggaatgcccgggagctgacgagggaatggcacaatgtgccgagtgccgtaggaaaacggacattctctaccgggagaacaaatgggtgctgacatgtaagcaaaaggagtactgaagaaaaaatatttgagtactttagggatcgactcgttggggaagatgccctcgggcataaggtggggctaattagggagggcctcaaattagtgggacagaacaaacacactcactttggcacagtgatggcaattaccattggcttggcgactatgagcagtgccttcgattgcgggagtaagcagcttttgtcctttttcaatgtttattaagcccatctctctgattaagcgacggtctcttcaatggccaatactgtctgctcgagttccgcgttcccgacggagtgttgctgaactcggaacattgtgaggacggctcggagccgttggaggtggtgttggacatttgtctgtcggccaattgcg

SEQ ID NO: 27516 - DNA, 1583 bp, Heterodera glycines
tgttgttattattgttgttttggttctgttcggtgccctccgtttcccaaccggcactttcgaattggcccaacgtgccaaaatggacacttccgtcaaccatttgcccgtgccatgtgctgctttccattggctaaatgcccattaccaattcttttctcctatttctaattttatttttttttccatttttcccacttcttccgcagattctgctgcttcttctccgcttcgctccctttgcttttcctccgctgatcgctggtgtgaggactgagacagagacaactgatcggacgccgtggtcgtcggatcggagtcgaacaattcggggtatttctgaggaatttaaattttatagggaattggagggaaatgggcacggaaacaaaagcaatactcgcaaaagtccatattttttaagatctgtccttattttgagtcgacatttaattattttttggaaaatgtgataattgcgcacataaatcatcgattaaatcctcaaattttgcttgttgatattggcatgccgaactcttcctcaattgaacttttgaattataaattaaacatttcacttgaaatagacagtgtaatttcggataattaatttggggtttcctttactaattaaaagaaaaacttaaaatatgcaaatgttcaaataagcaatggataaagaataacattctctgattttgacttttcacctcctcaaatgcgctgaattggcccacaattgcctcgccgttgcacaaattttggtccccacaaaggcaataggccacttcgaccccattaaggtcgaccacgtcgcactcctccgccaattggtacggtttgcgcgggaaagtgacgtggtgcgcactgtccgcgatgcattccttcaccacagtgaaagtgcctaaaaaaggggggggggaagcaatgaaaaacattttaaacaaaatttaattgccaaaaagtgccgcaccattcgccgttttgtgtcgcgtcgtgcgacaaaatattttctcgtcctttggaaagcgtttggcgtacccatcgcagctgaacggaaaggacgttttgcactcgccgaactcgtccaagccattctcagcacaaatgtaacagttcagagctaaaaatgcttattataacctttgctcacagtaaatggaaaatattcgaataaattattttttaaataatttcaaattaccatttgcaccgagaaaagacgcggagaaaaagaaaattgctgtttttgttataagaccggatgtaatcatttatttaatcttagtaaaacaaaacaaatgattaaattaactattgaaatacgatttcaaatgtttattttgaaaagtcattcaaaaaacttcaatctcgcaaaatcgttttccttcggtgctttggattttcggatttgctcaatctcttttttttggctttgaccgtccgcccgaaaaacgcgggcgaggcgcacttttcgtcgtgtaattgggtggatcgtcgccacaggggatgaaatgaaatgaaatcgaatggaatgaggttggaaatccatcggtcagaaatccctcgaggcattcgcg

SEQ ID NO: 27517 - DNA, 1647 bp, Heterodera glycines
  misc_feature (64)..(64): n is a, c, g, or t
tcttttttttccatttccaggcagattctgaccacccttcgctgaagagagagttgaaaagttntgctgaaaaaactacgaaaacaaaaatgtctggacgaattaaaaaaagcaatcattgctgagggcaaatacgtcaaatgtgtggtgtacaaaatgtaattttttgaatttacgtatttataaaaaattgaatgggggcacagacactgacaaaattcaaaaactacgcaaattcacaaaatttcctgtttgcttaaattaacccttttgacacgttaagtgcactagatgaaggaattcctcttaattgtttgcatttaagccaccaaatgttagggttttttttataaaattcattgcttttcatgccaaactttggctcatgcttttttgctaaaatttcttgtttttttaagtccagagaagcagcaaacaccctatggtggacagatgaagtcatttccgcatttcatttgctgtaaaatttgcagatttcctggtaattattgtttgtacaaatttttgttaaatcaattttttaaccccttccaatttttcaaatttttctaaaagcagttgggctggattgatgagagggtgtatctactaaatcattcacttttccatctcaaaaaatgccaaaatttccaaatactggagaggtgttggcaaaaaaaaaaatgataaataatctttctggcaattttgctaaaatgtctaaaagtcgcttttcttcataaaattactactagatttgctaactcatcaccaacttcgtccggttgctcaatgtttgcatcccttcaacaaagcccagaaaatggtcgacatctgtgtgaacccttaccattaccagatcattcaaaagccgcgtaattttttgcttaaattcgtcgttaagcacaaaaacggacggtataactgcgtcccggccaaatttaagaaaccagagcccatcatcgaaacaaaatcttatgaatttggcgtcattcgatataattaacgagctctattagcttatccgaaagtacaagattcgccgatatataaataaatgctttcggatgatggcaaacttatatataattttgaccaactgaaataacttgaggttttcttaaactttcatgggacacagttgaagccaacaccatgtgaggggtgttaccaaactgaaacaaaggacaggcccaactttgcctcaagggccatgacaatttgtcttagataagtcttaaaatatgagaacaattggtattttggagtagatcttcaactgtttttaaacttttttgcatattgaaccgcacgcaaaaaggagaatgataacaatttgtattcaaattttcaaaaagtatgaaatttgtttccattttcgtgtgaaaattgaacgatccttgaaaattttaggcattcatcccaaggttgtcgtaaagcgaaatatgacagccgaaaatggggacgacttaagcggcatgcaagacgcagttcacaatgcgaaagggcttgacgactcaggatatgtaataccattttttccgtaaatttattcttcaattggatttgtaattaaaaactcaggtgccgaacataacgctcaatgactttgaaatcgacacctcaaataacaaggaaatttgaagg

SEQ ID NO: 27518 - DNA, 465 bp, Heterodera glycines
  misc_feature (13)..(13): n is a, c, g, or t
  misc_feature (415)..(415): n is a, c, g, or t
caaatgcacacantcgtctgtaccagaaaaagctgtcagaagaagcccacaatgttgaaggcctaaatttggtgcaggtcattgatgaaaggatggtcagtagcctttatttgtggttactagagttcgacctggacactggatccaggcctggatttttcctggatccaggtccaggtccaggtcattttttgacaacctggatttttcctggacctggatttttgtccaggaaatccaggtccaggtcaaatatgaaaaaaaatccaggtccaggcaaaacaggaaaaaacctggattttcctggacaaaattttagaatttattatttcaagtgaccgatattttttcaagttttcaaaaaatgattaaatatatttaaaaacaaattattattgtaaattagatatttttnaatgttcccaagcaattaattgaatttttcaaacattttttttgattttt

SEQ ID NO: 27519 - DNA, 838 bp, Heterodera glycines
  misc_feature (824)..(824): n is a, c, g, or t
ttgcctttctcctattcagggcaaatcgtaataattcaggacattttatatttttcatattgcctttctccaattcaggacaaatcgtaataattcaggacattttatatttgcctttctccaattcagggcaaatcgtaataattcaggacattttatatttttcattttgcctttctccaattcaggacaaatcgtaataattcagggcattttatatttgcctttctccaattcagggcaaatcgtaataattcaggacattttatatttttcatattgcctttctccaattcaggacaaatcgtaataattcaggacattttatatttttcattttgcctttctccaattcagggcaaatcgtaataattcaggacactttatatttttcatattgcctttctccaattcaggacaaatcgtaataattcaggacattttatatttttcatattgcctttctccaattcaggacaaatcgtaataattcaggacattttatatttgcctttctccaattcagggcaaatcgtaataattcaggacattttatatttttcattttgcctttctccaattcaggacaaatcgtaataattcagggcattttatatttgcctttctccaattcaggacaaatcgtaataattcagggcattttgtatttttcatattgcctttctccaattcaggacaaatcgtaataattcaggacattttatatttgcctttctccaattcaggacaaatcgtaataattcagggcattttgtatttttcatattgcctttctccaatcacgacaaatcgtaataattcangacattttatattt

SEQ ID NO: 27520 - DNA, 1199 bp, Heterodera glycines
  misc_feature (74)..(75): n is a, c, g, or t
  misc_feature (102)..(102): n is a, c, g, or t
  misc_feature (988)..(988): n is a, c, g, or t
cgcatcgttcggggggactgccccgaaaacaaaaaatcgatttttcaagtgtccgttgggggtactcaacattnnatggggagcaaaaatccaacgcagaanttaagtacaggctatagggaagctattccggaaggattcggtctccacataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcnggtcggggggactgccccgaaaaaaaaaaatcgattttttcaagtgtccgtttggggtactcaaacaattattggggagcaaaaatcccaacgcaggaattaaagtacagggctatagtgaaagctattcccggaagggattcggtctccccataaatctgggcgcatccggttcggggggactgcccccgaaaacaaaaaaacgattttt

SEQ ID NO: 27521 - DNA, 1887 bp, Heterodera glycines
tctagagtccaaaaaaagaataaccgaatataaaaaataaataataaaaattaattaacagtttggaaaacgattttgaattcaaccgcaaaaaagcattcattcaaatggccgaaagtgttcgcgtggtggtccgatgtcgcccgcttaaccaaagggagcttcgaattaattcaaacgtggatttaaaaatttttttcataaaagtataaataattatttatcacagatttgcgtggaaatggtgccctcaattggccaggtctgctgaccctttaaatcctaagccttttatcacttttcaaaaattatctaattattagacattattaaaactaccatttttacaaaaacaaaatttttggagagtatatttttcaaagaaaatttgctttttaagctgtttatttttcatttttattgaaaaaatcaatttttttattcattccagacgaagggatgttaaggaaaaaattgacaaatcataaaatattcatcccacatagtaattatttggtttttattactattatttatttccaatccatttaaattctttgtttattgagttaattaaaaaaggatagtgagaagtgtctttaaaacccaattttaatttaatttaattccatttttccatcacacagtgcattttgcaaacagaaggttcatcggttccaaaagcattcacattcgatggcgtttatttcatcgattctactgcggaacagctttacaacgacattgtgtatccgctggtcgaagttggtgacaattggataatgtttaaaaattagttgatcatcttaaaatgataaattattttatccattgaaggtgtgaaaatggtttttttatttaaatttttccaaggtttttgctaattaaatgatccaataaaataagcataaattatagagcgtgatcgaaggctacaacggcacagtgttcgcctatggccaaacggggtccggcaaaaccttttccatgcagggcgaccaacaattggacgccgcacagcgcggcgtaattccgcgggcatttgagcacattttcgaggccattgccaccactgaacacaccaaattccttgtccatgtttcctatttggaagtcagtcacgaaacttcaaataattaataaccaaaataaatgaaaattttgaaaaaattttaagatttacaacgaggaaattcgcgatttgttgggcgacaaatgtcagaaattggatgtcaaagaacacccggaacaagtggatttgggggggggggtttgaatttattaatttttattccgactttaattcccatttagggcgtttacgtggccggcctttccctgcacgtgtgccatgacgtgagcgactgcgaacggctgatgacgaccgggttcaacaacagacacgtgggtgccacattgatgaacaaggactcgagcaggtgcgaagagtcggcgggacattttttagggaaaataaaaataattaataatatgtaaataaatgctttttgtaatttttagcaataaatcattttttattcgttaaggtctcactcaattttctcaatgtatgttgaagcattggatgagaatggaaacatccgaatgggaaaacttaatctcgtggatttggcgggcagcgaaagacaggcgaaaacgggcgccaccggcgaacggttcaaaggtgggaaaccaaaacaaataatgtgactaattaaaaggatcattagcataggataatttagaagcgaccaaaatcaatctgtcgttgtccgcattgggaaatgtgatttccgctgttggtggacggcaaatccacgcacattccctacagagactcgaagctgacccgtcttctgcaggtacagcaattagcagaataaatgg

SEQ ID NO: 27522 - DNA, 1318 bp, Heterodera glycines
aggggggcaatgaaattcgcacattaataggtcctatctgttgctcttttcccattttaggcgcgtaatctttgctacatggtggccaagcgagaaaagctgaagaagcagtgcctgaagcagtttgagatgcagatgaaactgaccgcttcgaatgtctttggacgggtgccgcccgtctcggcacgctgcatggaacggattctatcggaatggcgcgaggcggccgattttaaaccgacctcggcaccagtggaggaggaggacaacaccaacaaaactcgtggtcgaaaacgaaaatgaagccgaaattatgcatttgcgaaaatggggatatgaaaatttgtcatttttgtggaaagtttttggtttatttgttgtcattctgccttttgttctcagtgttagggacggtcccagggttcgccggagggtcgaaggcattttttcttgctttgattttcaaaaagaaattttggagaagagaaccaacatttgaagggggcggggatcgtactctccgcctgtgactgtcctcgagtttttgttgttttgcgtgacatttttacaaaaagttctctgccaattttcactttatataccagttcacccaatgattttttgatttaaaccgatttgtgcattaaaattctatcttggaatgaaatcacttttttatattctgttatcgaagtacgcaatacccaatagggaaaatattgatcatagtccccaaactcaaaaatgcttaaaaacggtcagaatcgatgttaaaaggttcgaaataggttggaaaaatagaattaggggcgcgcttgccctggcgacgagaaggcgggtcaatccccgcctactgcacgaaatggacgggactggactcaaccgaagcaaaaagaatgagggacgtacttggagacggtcggggcgaatcccgattcatcaatccgctaaaattgatcattcctaattttacccccttttcatccaatttctcatttgcatttttgctccatttcgtaccattcactttttgcccgtttctttgtcccatttttgcccaatcgcatccctttacaattctctcttcggctggctcatcttcggccaacttcaaatttcctttcacaatttcccatctttcacatctgccaatttacattcaatttttgtgcgcccattttctttgttcgcaatttcgcttctggaattttctgcccattttttgtccctctcacaatttgtccacgtgcattgccttttgcccgcccccttcgaaaattgtctatttaagcgcccccggccaaggggtcgtgctctt

SEQ ID NO: 27523 - DNA, 1062 bp, Heterodera glycines
gtaaccctggcaccagcgggtctcacaagcgcttttaagtgaatttcgtagattcgatgatgtcataatttgttgattgatatgcaatagaaattattttattcgaaaataattattcatcttttttattaaatgaattttgttgagtcgttgtataaaaaccaggaaatggaaattgttaaacaaacaattacacataactttgctcaacccaaaactaaatttttaattcttgatatcattggatagccctaacaattcctattagcctgcagtttggtgagaattagcatttgggatgtgaggtgagtttcagaatactttatgaaataatatttatgaattaattttgcaaaaaaaaaattattggaatagttagaattttttaaatttttttaaaaccaataagcattgaaatatttgcaggttaagttagtcctgtaccggggagtatacctctaaaatttggtgcgattttattaattatagaaagggttaagttagataaaaaatttgaaatataagccaaaaatattagacatatttaaaaaactcataaaaaatttttttaataaaattaatgagccatttttcaaatatgtgttattagagtgccttattaacgtgtaaataaaatttttcgtttcaaaactgtttctgaaaaaatatttatgaattaattttgcaaaataaaataaaataatggaaaactcagaatttacaaaaaaaactttaaaacaaataaatgttgaaatattttcagtttaagtttgtttccaatgttgagcactattttcgcacaaattttggcatttttttttattaatttgcagaaattattcgccaaatttttctcttgccaaatgggcccaattaaccttgaatgacaatccgtcagtgaagatcagacaattcgtcagtaatagagacaatctgtcagtggacaattcgtcaattaaatgtcaaaaaggtgggaagcgcaccactttgacgccagccgttttggcgccatacgctattacatttttatttgcccatgaattaaagagcgtggtatgattc

SEQ ID NO: 27524 - DNA, 1805 bp, Heterodera glycines
ccgaaagtcttatctcttcttcaaataatgagctcttgtagaccaaggaggggggagaactccaaaaaccattttctaaaattctgaaaacatcttgttttttttcaaaaaattcacatgaagctaacaaaatgccgtaatagatgagtttaaaagtcttatcaatgaccgctggcaagtgaaaaatttcgtattttgggcttcgctggctcaaaaatgttcaaaaaattgaaacaaaaggtgaagcattgctccgaatgacttctcttaattgaataaatgcctttaagactttttgtggttgtcgcctgaacaattgcggaaaatgggcgacaacactaataataataataatgaccaacaaattgacggttccaaacaaccggacatttacacattggcattgattttcactgaagtataaattaaatgcattaaattttgggttcaatttcacctgcagaaggcggcaccatcggatcatttcatctttttaaaactaaaaaaacatttagatcgttttccatagaaaaattagtgtttacaaacatactttggacacttttgttttgctgtaccatataagatggaattgtgaagcctttatagagtattaattttaattattaatcactaattaatgggtatttgtatggagaaaaagaaaaaattattgtctaaagcaagcactaaattaatttcataataaatcatttgttaccttaattaactttgtgtcccaatttcggatggtgaatatgtgcccgtgttgggaggagagtgaccaatacggcgccaatgagcacggggaaaacgtgcggcgagcagcggatgaacacgcagcagcagcagcagcggtgttcaacaggcgcagggaaacagcgcagcagcacgcggcacgacagccgagggaacggaacgcggaggaaattgcttatttggtgaagcggggcggcactgtgccattgagaccgaccatacgccccgcgctggacgaactgaagcccgaattggtagggcgcggtggataaatgtaaatgtaaagttggaattggaattgcactaggaaattttttgggactgcttcatctcccattttttcgcttattttcattgtctctattttgaaatttttaattcgagattccaattgcttaaagaaatattattcaaatcagcttcatctgatccgcgattgttgggtggaggcgccgaatgaacggccaaccattgagaaagtgcggcaaaagttgcggcaaatgaatgccggcagaagcatcaatctgatggaccatgtgttcggcatgttggagcagtacgccaacaaattggaggaggatgtgcatgaacggacgcgcgagttggaggaagaaaagcgcaaatcggaaatactcctctaccgtatgatgccacggtaattaagtcaaaagtgattaaaaaaattcctttttttctcacgggccctctccctccctattacaaccccctgttttattgcccttactgtaaagccgatcaaaaaccaaaacgtaattaagccaagttgcggaccggcttaagcttggccagtcggttgagcccgagcatttcgagtgcgttacggtgttcttctcggacattgtcaaattcgcggaactgtccaaccaaatgcgaccgctgcaggtggtcaacctgatgaacgaactgtacaccatttttgacgcgatcatcgacgaacacgacatgtacaaagtggaatcaattggcgaggaatttttttaaaattaaaaacagacaaatgaaatgtttgaattttggggctaggc

SEQ ID NO: 27525 - DNA, 1890 bp, Heterodera glycines
tctttttcatccgagtaattttcttcatttttttcattgaaattttcattttgatttttgacattttcttcgaaatttgcaaatttttctttgcatttttcggccaggtcgaaaatttcgctgacattttctacttcgcccacaaatgtatcaattcgcatcacattgtacgctgctccttaatcagcaattttattgtaaacagattgatgttaatcaaaacttaattacatcattatctgtcgttaattttttttattgttacattttttatttggcaaattattgaatatgatggcctaacatttcccctatttaagatgttcaatgtgataacgttctttattccgtaggggtaaatgattacatggtgaaatacccgaaacgtaacgggagaggggagtttggtcgggatccgtcgggatcagggctgggcgaaacttcggcttcggcttcgaaaacttcgggttttttgagcttcgaacttcgtgcttcggcttcggctattttacccgaagtttcgggaaaaatacacctctaaagattgagttttcaatgtgaaaatgcaccactagtgattgacttttggtaaacttaaaattaatatatatttaaactatttgcttatttgtatttcgcatgcttggtcgagtggtagttctttcggctcttttcattatgtttcctttgggtcagttcccatcaaagtagttgcttttcttctaatttttcaaaaatattcatttttttcgacagaaatttaataaaatttaacaattaaaatcgcaaaatttttttcatttttggactaaatctgttaacaatgcactaaaaatttcaaaaatttcaccggcggcgcctatcggcaccgtcggagctccaaatttcctttattttttaaatcgactcaaaaccgtgaatattctaagaagtataaaaatttacaaaatatattgctcaaaaagttaattacatttatttatcgaaaagggttggttggtctctagaaactagagaccggcgcgggacgggatcccgcgcgggattttgcgggatcccagtccgcaatcccgcattttttgaaaaatttccgatttcttgcaccgcaaaagtggttttgaaaagaaaaaaaattcaaatttatgaaccgaaccgtttaataattgttagctaatgattattgggattaaaattttaaattgcttttaaatcggctcggcagtgcggagaggatcgatccccaggcgcgccaagccatgtatgaagagcccggagggccacggcttttccaaaccgtgggatgtttaaaccgactgttggacacggcgccccgtcatttttggaagccgagttagacaggcggcgtttttgggaaaatataaatattaaataatcaatagaaaaacaattattccaaataataatcgattctatgattcacaaactattagtcgtcagataaattttttaatcttcttaataactaatgataataggactttcacaattctaatagcctgactaaatgggcatttgctctgtttaccattcagtttatttactataataataaaatggttatcccaattatatgttatcgtttagatttttccctaattccaattctttccaattttcttttccatttttctttacaccaaaagcggcgagtcgtaaacacttttgcctttccaaattccgccttcgttttcgctggccaatttcgtcttcaatatgtgcgcctctccgctgaattgttgcagcaccgttccgtcctcaatgttgccaagcaaacagccgaaaatgcccaattcgggcgttaccgcgacattcaaaaggggcgccgagtcgggaaaaatgaaatgattctaaaatttaaaatcaacaaaa

SEQ ID NO: 27526 - DNA, 893 bp, Heterodera glycines
ctggcgacatgcttttgtttgcagatgcatttccaatctttaaaatctctgccgccgatcgtcgcattcattcccacgccgactctctccctcccaactcccaatgagttcgggtgattaagcgaaggtggaaagtttcttaccataatttgctcgttcacctgcgcacaaaacacaaatcattcatttattcgttcagccgcgacggcttttgcgaatcaatgggagggagggaaaggaggagagaagggaaagtgattaagcatgggatgatggaatatgacggacgaagcttactgatgggacggatggtaatgataatggaatggtgggaagaaaggaaagaattaattggtaaagtaaattgggagggggagggaaaggaaaagaaaagggaaaagtgtaagcgaagcaaaaggagaaaaagaaacaaaggaagagaagagaagggaggcaaaaagaaaaagatgggagaaaaataaagaaaatgaaaaagtgaccaaagttatgagcgattgtcagaaaaaacaacaacattcagatcgacaatttatccataaagaaaagacacgggaatatgctgatcgattgcaagaaaaacaaaataccaaattttcaaaaacaaataccaaattttcaatggtttatcgtatcgtcactcttttctcaaatggtggcggcgccgttgtccaaatggaattcgttacgacgtttctttttgtggctgatgaaaccgaccatcacaatgataatgagcagaacggtggggacggccaaaagaatgagcaccaaacgaaggactgaaagggaacatggaaatggcaatggaataagttgagtcacacaaatttcgcatctgctacgttttcagccccattttccaatgatcggat

SEQ ID NO: 27527 - DNA, 998 bp, Heterodera glycines
ggagcgcatgcgcggcgccaatgcgaagcgaatgcgttgatgatacggtaggagttcgtgcactacagtaatggcaccatgacgaattagttaattgtattaatttatatgtaagtgctgctgtactgaattaattatggatgtgatacagggagatgaagcagaattcgaatttaaaatattacaaacatacaagggacctgtggcaagaaaagtcttgaaacattgtcaaaaaatgttcaaacccgagttttgtgccaaatatctcttaaaaaaaaaagtttttaaagcacgaaccttaggcctaaatatctctaaaaatcttaaaaatcctaactttaggtccagtaccttcaataatttttaaaaatacgtcctaatcaaattacggcttacaaagagaaaaaaaatttagtttttttttagttttgtcggtttaaacacaaataaattcactgaagccaaaagagtataagggaccgaaaaagcattcccccaggggatagtggaggaggggggggggggaaatgcccatttgtcatttttggacacattgcaaatgaattataaagtgtctcgggcagcggattagaagaaggaatataggcagtctttcttggttttgtgagacatctttgagtaaaaaatggaaatattttatgctccagtaattccaatgctcaaaaaaattttgagaactcgaatcggaattccggggccaaaggctctcttaagtcgaaagtcgaaactctggggacaaattattttggaattagggaattcctggggttcaaagttcaaagttcaaaataataatgataatgttaaaaaaaagtatgaaaaattcaaatacctgaataaaattattttattcatttaataatgtttcattaatttaaaaattaaaaataatggggggaaatggacaaattaaagaccaacatttcaacattttatgctgatttaatgttagaattttagttcaacgctattttatc

SEQ ID NO: 27528 - DNA, 934 bp, Heterodera glycines
tcagtggacgatcagtcccaaagccatttgtccatttcagtcccgggtctgtaactcttcagggatgttttccgcaaagaaattctttcggattcttccattacagacttagggctatcgattggtatatatttcgaccattttcggctctgggccatatgatcaaatttacccacggcagaaatcgggacaggttcgtgactgaacagtaaccatatttctaaaaggtacctaattaaattttttttatttcttaggcctagtactgtctttgctttcccctggtaatttatttatttatgaataaaaaaaagttatcagaagggcaaaaccacttactctgacgactgttcagataatatgtcgtagagtaagtgataaatatatggatgaccaaaaataaaatcaaaatatattaataaaatgaggtcaattgagatcgacagtataaatgccaaatcacttttaaaaaattaattctgtttttgcttttccggttattaccctaatgaatttctaagttttgttttaaattgattcaaagaatttgtttttattagttctttatcgagtttattccacaattttgttaccctcccagcaaagggaatgaattttttgcatagcttatattttgtgctaaatctgtaaaaggggatgttatagcgtgttgatggattaaaaatagaaaatagtttcagatctgttcggccataaacaattttatgcgccatgaacagatcaaacagctttcgcctattctcaagtgttggcagttgcaggtattctaatcgattttggtatggaattggcggaaggctacacttaaaaaatactcttttggtgaaatatttttgacttaaaacgaattttaaaaatctttatttaaatttgaacgaaaattgaaaaataaaagttgaagccggagcagtaa

SEQ ID NO: 27529 - DNA, 603 bp, Heterodera glycines
ccccccccagatattgaaaaatggtgcaaaatgaactcattgaaaggggaggcgcgcacctccctcacgtgcgttgtgccggtcatccaccttttccccacatgcgttgcgccggtcatcccccttcttgccccccccccctcagcgcacgtccaccagttgtgtctaacgcatctctctctctctgtagtgtactctattttgtcatcgtttctataccttttcccttcatagcgccacgaaaggcgcaatttcaaaaggagtgtcgtccgacggaagaattaaatgaattacaaataaattaataatattgcacaaaaagcaaaaaaatccgaaaattgaagaaaagatctaacgaaaaatagtaaaatagctgataaaaaagaaatcaaatcgataaattaaaaaacattcaaaattacgaaaaatatacatatatatttaaagcaaaaagggctgacaagaaagaagaaaaataaattaaaatcatatattttaaaaaagcattcaaaattatttaagtggctttgcaacttttttcggtgccgtccaatgccaagcacaggaaaattgtgaaattagtcacatgactacagcaaaaaa

SEQ ID NO: 27530 - DNA, 1508 bp, Heterodera glycines
tcgaaaaaagcggtgcggtggccataaatccggatttgaaggattcgtaaaaaatcctcaagcaatatcacttgtcaaaagctatgaaaaaaaggaaataaagacacttgatgaactacatgaacaacttatgcataaaggcatacagatttctctatgcactttgaaacgctgcctgcataagataaaacgatgatgatcggcgtcagaaaagctgtcacggccccaattgccagcggaattgaaataattccgcgctcttttcgcgattttttgctgctttccgttgaagaattttccccaaaattcggggtgcatataagaacaagcagaaatgtaattttaaagggaaacattttggtggtttttgaatttggtggggaattgcaagcttttctcgggtatttaaacgaaattttttcatcaatttttcattaaattcttgaatttcatccatttctggctttttgtgttcccaggccgttcctctgcggctttaaatattgtgtattgaatttcttgtcggtcttcagccgctttatctttccaaattccatggtcatatgcttttaaaaaatttaatgtttgttttcccacccatttttagcatttcttttttttcgccgcattttttcgtatcttattacggaactcaaacaatgacgtatttctaatggaagccaaaattttgcaaaaaatttaaaaaatgttaaaattattcactgtaattttaaattattaaaaaataatttaaatttaatctattttaattgaataataattattttaattaattattatcattgatacttttttaggatcgcccacattgatacttttttaggaacgccccattgatacttttttaggaacgcccacattgatacttttttaggaacgccccattgatacttttttaggatcgtctcagcacgttctcttttttccagttttttttaaattttcaaatttttacggttaggaagaattggttggctcaaagcatttggcgaaatgtgcagaagaaaatccaaaaattggtccatgtcaatgcccaattcgttcaaagtgaccgatcgctgctgcttctccctcatctccacactgagcatccgatcgatcaccggggagaagcagcgaagccaagaagcggacaaagtcacctgaaaaagtggatgaagcaataacagaatttcaaataaattaattagtgaaaatggctaattttaaaaaattcttaaagcaattatttaacagggatcgaatttaggtgcaagcctaaaaatatttgctgaaaattggacgaaaaaggacaaagattgttcaaaacaggcatttctctctaaatatgtttaaattgtgtcttaaatatttgttatacaattttttttcaaatttttaagcaaatatgaagaaattttgggaaattatacccttaatttggaaaaatttatgtccatatttatgcaattttatgtccatatttcgcgatttttggcccatatttt

SEQ ID NO: 27531 - DNA, 1545 bp, Heterodera glycines
  misc_feature (32)..(32): n is a, c, g, or t
  misc_feature (1479)..(1479): n is a, c, g, or t
  misc_feature (1486)..(1486): n is a, c, g, or t
cgttccaatttccgccaagggatccgaaaatntaaaaaaatgtagcacttataaatttatataatatcatgtatcattcaatagcattaattgttctctatcaaaatactgtagtaaaatttttttagaaaaaattaaaaaaagttatggccgcaaaaattctgacccaatttacgccaaagacaattttttttataaatattcgcttatctcgccaattaaataattaatcaacccaaaattttgcgaatttttgtgctgattttctctatgctgcttaattctcaaataaattgtgagaaaaaggtccggcggcggctctaacctggtttaaaaatttattacttacattgaagaatttttaaacggggtttttttatcgtctcaaaaatggaaaaattgaatattagtttattttttattttaattaactatttaatgaacatggtctgctgcaaatgtgacaaccattaaacagttgtgttattgtgtggatgccaaagagagatgccatcaccgcataacattttccgctctttttcttcccattttctccttttccttttgagtatttaattcgctttttcatttctcatttttcagtttgtcagacctttcacaactgccattccatttttctttgcccccatttgcgattttccccgatttgttcacaatttttgaatttttctttcttcagtccgattgggttttttctctcaaaatgtttcctctcccctattcatcaaattttctgtactttggtcgctcataaaattcagcgatgcctccctctagggctatgcgagaagtgatttttaccgggaaccgaaaccgagaaatgaccccgcgaaacgatacaagaattgattcaaatgtctttttttaaatcagaaacacataaaaagagggaacgggccaactgcgtcccaaaataattttaatattttttggaattccattgaataatgttttaaaaatagaaaaatacgaaattttgaaaataaaattaatctggactttatgttggccctatcctcgtttcggaacccaggaaaatccaagcccaggtcaagctctatttttcctcaatttgtacccgagaccgagaagcggaaaacccgagaaatttcccgagtcgggaaccgagactctcgcacagccctaacagataagcacgaaaattttccgtttggtttggggcttctatgtacaatacctattcttacctatttgggagtttttctgcctattacctaggtccctattttatacctatttcggcatttttgtcaccttttaaggattttagaaaattccattaacaaaaattcaaaaaattaaaaaaaacacatcccctaagaatcgacctgaaaaaaattcaaaaaatgaaccccaaattgtaagaattggaaaattttctcaaaaattcatcaaacaaatttatttattattttttggcaaaatatttttaattanaaatgtncatattttctatgaaaatatcagaaatatttattataaaatattgttttcttacctaaa

SEQ ID NO: 27532 - DNA, 1334 bp, Heterodera glycines
agttaatagtaggaatattaaagaaatgaaaaatgctctagacagaatataatatataattcgtgaataaataaaagtgcaattgatcgaattgatcaactatgcatgtggatattatttctctctctagacagaatataatattgtaatttgattgggaaatattaaataataacgaaattataattatggccagcaatataattaatagattaaaatagttatattattaattaattaaaatcattattcggtactgaaatgacccgcctcttctgatcaccactcatttgcctttttgaaacggaccaatttttgcgaatttggaataatttattaagaaaaatcaatactttttggtgtccggaagtgcctataccgcaggaaagtttttcggaatttttaatgaattttattaagaaaatttgttcaaaatttcaaatattttcaatattttcctccttcgtggatgaattaacttttaaatttttacaacgctcggggtccccggccccccgactatgtgtcggggggggggggggcaaaatgtcggggccggcgaccgtcatggaaaaacatgtcgggggtcggggaataggcccaaaaatgtcggggccggggagctcggggtcggggagcaaccctaggtcaaaggttttggaaacttttggaaattttgacagatttttaaaaaatttgcaatattatgcactcataaaaaactgccttatcattagggctcggaattttatgcacataaaatcgcaaaatatgagcataaaatatgcaccaaaaatcgcgaaatatgcacataaaaagtgaaaaatatgcacataaatttttccaaattgagggcaaaattttcccaaattcttcaaattcactaaatttaagctaaaaatctcgaaaatagttaaatatggtatgaaaaattatcatagaatcaaaaatacaaaataaaagtaaaatttatttattttgaagaaattgagtaaaaaatcgaaaattttccattttttacattttttggcataaatttcaaattttgaaaaaattgtatttttactaatattttcgagaaaattttgctaaaatatgaatttttggggaaattttccggtcattgaggtaaaaaggccaatttagctgatgggggccgttctaatagaagttttttggaaaaatgctcaaatatgcacataaaatatgcacgaaatgccttttagcaataaataaaaagttttaatgatggagaaaggatattttcattggcattttatgcaatttatggagtgccaacgttttatgattctctaaaattcacgaccattttg

SEQ ID NO: 27533 - DNA, 1789 bp, Heterodera glycines
tagtgtattatatggccggaaattttcaaaaattttcgagctaggccccctagaaattttcggaaattttttttgggttgaaaaagagggtgaaaaatttttttctgggtatttttaaggtgctgagtacgaatatgatgtctattttaagtttcagaatttttggaattttttaaaaattcgaaaatatttggcaattttttggccctcgggattttggcctaatatttgaaaattcataacaaatcgaagggttgatcaattttacagcaataaagccttaaaaatagagaaaaatcaggagaattttatgggatttatttgggatttctatcttaaaaagaaaaaaagttattccagaatttctgaaaattttagatttttcagaaaaaaattcataacccccttctgaaaagaaatttttgaaaattaaaatactacaaaaatccgcaatttttttctttataatataaattttattttacatttttatcactttcttacgaattgttacaaaaataaaaccgattttgggattatggaccaaaggggtgagcataggattttttagttgaaaaattttttcaccaaaaatcttcaaaaaatatgtctttaggggttatttggcccgctgatcacgaatacgtaatcagattttacttttgacatggttaagacctcagaatccttgtgtgattggggattctgaggcacccttatgaggaggggggggggcggcaggttcggacccggacggtgtacattatttttctatgcatttttgggttattttcactgtttataattaatttgaagatttgttttaaattatttaaatttatttttttttaattaaagaaattattttttgttttattattattaacaaaattattttaattaaatttaatttttcttttgaaaaatagatttatttttaagcaaaattagatttaaaaatttggatgcataataattcatttcaaaataaagtaaaataaattattccgtttattaattaaaaaataaacttttacattttttattattttgtttttttaaaatttttaaataaacctaattctataaaattatatttaaaattatgaaattatttttgtacatctcataacaagttagacttttgtacctcttctaatcactgttgtacctttctaatcacttttgtacctcttttaatcactgttgtacctcttttaatcacttttgtacctcttctaatcactgttgtacctcttctaatcacttttgtacctcttataatcactgttgtacctcttctaatcacttttgtacctcttttaatcactgttgtacctttactaatcactgatgtacctcttcaaatcacttttgtaccctttttatcacagttgtacctcttctgatcactattgaacctcttctaacaccgttgtaacgggcgcgaggcgcccgtccgatctcaacaaatttaaaaaacgggcgcgaagcgcccgtcagagcaaaacaacatttgaaaaacgggcgcgaagcgcccgtactatgccgcgaagcggccgaaaaggcccaactaaatttaaaaacgggcgcgaagcgaccgtctgaggccgcgaagcggcctaaaaatcccagataatcttttaaaaattccaaatctcttcacaacgcaatagcatatctaggtagcgaagctcccaaagcgcgaagcgctttttcccagctaaatagccgacggatcacgcacccgctagttaatatatacgttatattgacaaggagtttcgtt

SEQ ID NO: 27534 - DNA, 1611 bp, Heterodera glycines
tggacgtggggagagagtgcgtcggcatcgacggcgatttttaactgagtcgagacctgctgccgccgatagctgcccgaccaaacggagcggcaacgacgacgacgaggcccagtgggggggggggggtaatttggtagttatgagacgggggtggggcgagcgggaaaaagtgtggggaggcggccctcccccttcccctgtcgtcgtcgtcgtcgtttcttggccgtcgccatcgccgcgtcgttctcgacgggccaactcttccgccgccaccaattccaatgggtgagaagaattgaagcaaaaaattagagaaatattagggggacagaccatttgtgctgaaactatgggaggggtgtgggagagtagggaaatagtgtgggaaagcgagagaaaaagaaaaaggggacagttggagagaaagcaaacagaagagagagcatttggaagaagaagaaaaagcgcacgctcgagaaggggaaaattggcgagaaaacggcgagcggcggactttgagagaataaatcaatgaaaagcaaaaggaagaaaaatcgaaaaataaatgagagagggaagaaggggagagtgagggggacgagagagaaacagagaaggacaaaacaatgtgagaaggagggaggagaaaaaggggaaggaagaaatagtaggaggaagagaaagaggaaaaaggaaatagtaaaaggatgagaagtagaagaaagaagagagaataatgaagggggaggaacagaaaagagaggataaagagaagagaagagagagagagagaaatgatgagggaaaataacaaaactaacagcagcaaggagagaaacagagatgagaggaaacattgggaggataggagggaaaagagtaaatgaaagacagagaaaggaataggaaaaacggaagtgatgaggaagaaaaagaagaggaagagaaggagaggaaaaagagcaaacaaaaacagaaattgaaaagaaaacgccaaaaatcaatgccaatcggaatatgttttccgtccgattttcggctcgacttttttggccctccaaatttttgtcaccacagcgactcaaaactgagcaccaaaaaagcccggcttttaacgcatgaaaaatttatatgtttttggcattttagaagccgaaaagcgaaaagagagaaaagtcaaagggacacaaacaaagcaaagccaacgaagggaaaaagggacaaaaggaggagagaagaggagaggagggcacagtgccgaaatcgacgggacacccaaaacaaacattggcatcctttccggatgatcttggcacttatgagagaagggtgcctaattatacattttgtatgggcataaaaagtaaattatggtcaatattttccaacgaaggtacggtattaaaaatcagtttaaataatgtaaattaattaaggttcaaaacttgtttttcatgcgtttcaggcttccttaagcctaggaaaaaaggatttagattaaattgaaaaccttactgatatcagtgatcgaccaaaaaaaaacacttttgaatttacattataaagtgagagcctacgtgatcggcatctccgatcatttaaattatt

SEQ ID NO: 27535 - DNA, 1059 bp, Heterodera glycines
tttcttaacattttattgttgcataacatttcttagcattttcatcgtcctttcctcctttttggcatttttttatggaaaagcatttcttcttggcattttcttgacattttcttggaaggtacggctcggccgcttcgcggcctcggatcattctcttggcattttcttatggcataacatttagcattctccttatcttttcttgtttctgggcattttcttatggcacaacatttttagcattctccttttttcttgttttttggcattttcttatggcacaacatttttagcattctccttttttcttgttttttggcattttcttatggcacaacattcatagcatttcctcatcttttgtttcttggccttggcctttcttattacataacatttcttagcattttcctcgtcctttcctccttttggcagtttcttatggccaagcttttcttagcattttctttttttcttggcattttattggaaggtacgggctcggccgcttcgcggcctcggaccaatcttttggcatttttatggcacaaaatttttagcttttcctcccttttgacatttttttaaagtcaagcatcattttcttatggtcaaacatttattcttagcattttcctcgtattttcctttttcttgacattttcttggaaggtacgactcggccgcttcgcgaacatgacgcacattattgtgtcacactaaagtcacagaacaaacgctaatgtttaaaaacattacgaacattattgtgtcacactaaaatcacagaacattcattcattcatcatttatacgcataagcgtgacgccgaaaaataagaaataatgaaacaatatcaaataaaacaaacaattggtcacttttggagctggggtggcaaagaaatcaacaaattcagataagatctttcaagaagtttggcaaactcattagaatttagtaatctcgtctctttaggcaaaagtctatagagacgagaggttcgaataaataacgaattaatgtagcattggttgagcaataagctgttctta

SEQ ID NO: 27536 - DNA, 778 bp, Heterodera glycines
tttaaatattgacactctgaaattaaataaattggcaatgaacctattacattatttgaaatccaatataaagggcaaatgaactcttaattaaataaacagatcctttcattctttgacaattactatattaaaagataaaatttttaattcaaaattagtaaaatagataattaaaaataataattagctccactgactcaaaaaattttttaagaataaaaagaaaaaaattcatattaaaaaaattttcaagcattttttaaatttttatacttaatgataaaatgttaaaaatgacgactaattttgggcgtttcgtaaaatccgccattttagcgatttttttcgacaaaacatggcataactttgcttaaatgcaaccaaattttacattcttgataccatacgatagccaagctttttctctattagccttcaaaatttaaaaaaaaatttggtcatctttgtaaaaacttgtatgagaatatgtactatttctgccataacctatgctaaatttaataattttatgacttccattttttgattctaaaaaatggctaatttagacaatttcgaaaataatacggtaattcattggtaaaatgttattttaaatttacagtaaattttcagttttatttgaccttcaaagatgcccatcccagcttgtcactgattggatgtgcaacaatttttggaatcaccgcttcatttggaatcctgtttcatttttcagtgatttttgtcacaatcaaaacaaagtgataattaa

SEQ ID NO: 27537 - DNA, 989 bp, Heterodera glycines
  misc_feature (871)..(871): n is a, c, g, or t
  misc_feature (947)..(947): n is a, c, g, or t
tccctcatgaagaggaggccgatcggaatcggacaaagccgttaggctctccaccgccacggaagagagacagaagagatgtgaacaacaccactcctccccaatcccccgtgctgtttgatgagcacggaaagcgactcgggtctcccccgttgtacgatccgaatgctggcgaagagcaacacatgagtgatgatgatgatgacatgcgagcacaaaaagggacactaattattgatccaaaaagcccgtctcctatagcgacacccccagttccggcggttaaaccgctaacaacaacaacaacaacaacaccgactcctccagccgtaaaaccggtaacaacaacaacaccggccccccagtcgtctgcaaagccatcagcacaacagcaaaagccaacacctgtcctgccaaaaccatctgcccctcagacgtcagaaccaaaaatagcgacgacaacgacacctggccctccaaaaacagcaataacaaaacctacaacgctaccgccaccgtcatctcctccaacagttcctctacagcgaaagccaacaacaacaacaacccctcaaacatcaacaccaacaacaacagcaacaccgactcccacacaaccaataacaaccgtccatacaccgaaaaatacaaaaacaacaacaacaacaccgatccctcaaacaacaacaaaaaccacaacccaggtctctccaacgccaaaaataccatcgcctaagccgcctgctgttaaacttcctcctcccacttctacaacacatccgcctcagccagagccaacaacaacaacaactgctcctaccaaaactttcacttcctctcctacgacgggggctgttattggattaccttncaaagaaaaacaaattccgaccgtcgacgaacctgtctcggctgcgttaactctagaaagagtagatttaccaganaacagcttcatagttgaaatagactcactccaatatgtgccc

SEQ ID NO: 27538 - DNA, 1105 bp, Heterodera glycines
aagcggctgatcaagcaaagtgatctgatcagaaaaggagggatcagaaaatcggagggagagatttgataaagattcataattaatttattagacagaaattttttgggttatcaattaaaataatggcaaaataaatgattaactgaaataaatctggaggattaattttagaatttacttagaacttaaattgattagctatacaaattatcggctttgttgaattttattaatttaaaccaatttaagattttttcatttttaatgtagaataccattttaaatttcaacgaaccaaaatagaaaattagtaataatatttggtttatgcttttttctactgctttttgcttattatcatcaaatcaaatctttttctccttcacaagtcttttatcgcatcaattagcaagtcagcaatttcgtcgaccttaaaaatttgagaagaaaatacataaaaaaatttattgaaataaatttaccactaaatcttttccaccaccggcagatgccttttcttaacacatttaaaattaaaatttttctcattatttaattttcgtaatgtttaaaacagcaaataaaaatgcaaaaaaatgcaccggaaaaattcatttttttaaaaatgttcacctgatttttctgccggtcgattcgcttttgacatttccaataagtccgaaattgtgtcaatttcttcagctgctgaagaagcgcccaattccttgtcagacctttgtaaaaaaattgtttgataatttaaataaattaaacaaaatttgaattattttatatttttgattggattaatacctgaacacgttgaatttcgggtttttcgggaagtacaggttgaaaatggtgtaatgggcagcttttgctgatggctggatgttgttggacgggatgataattgcttgttcttcaactgttactgctgctgatgggcgaggaggtgaaagatgaagcgattgaggcgatggcacgaaactgaaaaacaaatttaaaaattatttccacagaaaattttctttttattttaatactaattgcctgctaattgctcgtcgcttgcgtgccactttctttttccctttgccat

SEQ ID NO: 27539 - DNA, 1218 bp, Heterodera glycines
  misc_feature (63)..(63): n is a, c, g, or t
  misc_feature (105)..(105): n is a, c, g, or t
tcaaagtcatgacatgcagatgcggtacagtcaagacactgcatacgagacagcaatcaaganagtgcttctagagggaggggcaaaagggcgggattgttcttnaaaaaacatccgaaccttttcacagttctctgcactcgcattttgtgaattgatgacgttgtggcacgttttaatgacctggcagaaaggttcattcaccggtttgcgacactcaacggcaccaggattttcttgaataccttgaaaacgcttggattggtcgtcagcgtcgcactccgtcatttcgctcgatttttggaattgcaaagacattactgaactccatctgccaaggacaacaaatggcgtggaaagctggcatgcccgactgcagaagacttttgcctctccccatagcaaaaatgaacagacggtaaagaaagattttaaaaattttcattttccctattttccatgtttcagttggatttgtggcgacgtttggatggacattctgccatcttttgaccatgcccaactcggactcaaaatggcattgctttccgaccgtttcgacatcttagtggacaaacattttgatgggaaaacgacgaaattgacaattcggagaacaatcgaattgaaaaggaggaagggccaaaagcgaaaatatatgccaatggttatcgtgtgcaatttccgttccacgaccgtccgctgcccaacaaaatccgctttaatcacattcggattaagtaattcgaacattttgtaacattttgggatgtttttacccgcgaaatttggcctatttttgcgaaaagcattcgtcattttggctttcacgatggcgatgatttggacaaattgcgtcgccgcatttcaccgacacttctcactgatcttgatcaattgaattcgatcaattccggttatctgtgccccgatggaattgctgacgatggacccaatgcaactgctggccaagctttgaccaaatggttacacactccgagcaaaaatggacagccgaagcaattgcatctcaataattattttggtccacagaatctcgaatcggtcaacaacttcaaagaggtgtgtctcgccagaatttcccgtcaattatttttgtgtttaccaattttttatttagacatttcgccatgccaccacttctgtcacttacaaaatttgttttggtgttttcttgtcgctaatcgagccatttga

SEQ ID NO: 27540 - DNA, 2069 bp, Heterodera glycines
tccacaaattgtttttgtcgttttccaaccattttcttcagtttctcatttggccttcacttttgctttttcccgtgttttctccatttcttgattgcttttccatttcttccgcgttttacaaatttctcttttttggcgtgtccatggtcagcacaatttccatcgctttgcttccaatttctttgattttgtccgctcttttctccaatttttcactcaattcctgtgagttttctttgtcgtcaattagcctaatgagtttgctacatttcgggttccaaccgtttaatcagttcttccatttgttctcttgcgattttcttcaccggtgttatcaattcatttgattaccgaaacaaatcttccgctctttgcagatagtccttccgtaatatattacgtggacctatttcctagatcatgtcgcggtatattttatcgtaatgaggcgaatgccttctgcctcagataaatgaattacatcttggtatgttcataatccggtagtatggtgcaccattaatgccatttttatctctaagaatttgtggattcatctttgttaattcctgacctcatggaaggttcacaaattcgatgaaaaggtacgtttttctttccttttgcatttccataactttcctatttcagtggtgtcgtctccaaattcgcaaggcaaagatagcggaattgctgacaagagtgcagaattacataacgtcaggtcaggaagaggcacatgcattgcgacgcatcacggaaaaagatttccatgagtaagtgaaaattcgaatatcaaaatggcaactgaattcagtctgacccatgtgcaaactaacgaagagctgatggacattcatgcacatttccagctttattacggtcaccaaatgtgccgggtccaagaatgggaacgactcaacgcgataagtgagcaaagcgtggacactgagttggcttcacgctttaaacggagcgcaaaaattgaccaataccaagtgagttggaggttgttccaatttggataggatatcaatttcttaattgtcacaatgattcgtcaagttgtgcattcaatgcggtttgtcagcatttgctgaacagtttggtctgacgccagaggaatttgcagaaaatatgactgaatatgttaaacatgaagtgcggcaagtagacaaattgccgaacgatgctgcgctggagttcgtcaaagagtatttaacacaatcgctttaccatgaaatcatttatttcacagggagtttcttcaatttccatcgcccgaaaaagtcatccaaggcgccatttatttgttagctcagcaattcagtagagaactagcggtgcgaaaaaaattacgacaaatttaccgacaaaatttactcatttctgttcatccgactctgaagggaaaggacgaaattgacgaaaatcattctctctatgggcgccattatattaaggacaagccggtgaaagagctaaaggatgacgagtacttgagcttcgttagggtttgtacaacaaaaaaattacaatattatttatttttattttttaattaggaaattcagaaacaaaaaatatagccccaaatatctttgagagaaaatcggaattttgaaattggttgggtaatcccgaccgtatgcttccataaaatgacattaatttgtcttttgataggctcaaaaggacggccttatcgaaatcgatttacacattacttcgaatgaggaatcggagaacaaatgtttgcgtgcgtgcatggaaaacgatggctgtgcgacttttaagcgtaacgaaaattcggaaattgtggaagaatggaacaaacttcggaaccttgttcttacgatttgcgtcaacaaaatgttaattcctgtgctcagaagggagtcgcatgaaaatttgattgaggaggccaaagaatttgtaattatggtaaattttattattttctgttccctcttctatgggtgttctcttttcagaaagcggctgagcgattgcatggtctaatagagactgagtcttacaagccacagtttagctatgataatcag

SEQ ID NO: 27541 - DNA, 947 bp, Heterodera glycines
  misc_feature (861)..(861): n is a, c, g, or t
  misc_feature (866)..(866): n is a, c, g, or t
  misc_feature (880)..(880): n is a, c, g, or t
  misc_feature (935)..(935): n is a, c, g, or t
gaacggcactgctcggcatagtgacagagaaccatctgccaaacaaacaattggccaagaaaagctgaaagactgaccaaagtggccaagtgaatggcgggcgacagcaattcgatcattggcacattttcattctccgaaagccaaccgtagcaattgcgcaccagcagcagagacttcagaccgaacagcacaattgtgatacccttatatttgttttccaaatttgccaattcatttaaatccgcacttttctcattttcgtcagaatgccatgcggcagcgaatggtcgcagtgcgtttcgcgctgctcgcgccgtgcggcggataattggacccacaaaatgggcaaagtgaggaggaggaaaagcggcggaatttgggagaggaccgcgtcttgcagacattgggtgagcaccgggaaaagcacaacggattcgacgcccgaagcggtggcatttggttgggtctgatcagagcagagatcagtcaccaaaagagtgaagcattggtcacccgcccctaattacccataatgaatcactgcaaaattcgtttggccatcgaaatccctcctcccctccgttttcgtcataagcgtagaaatcgccactaccgaaagacatttttaaacgaatttgttaagggaaataatttacttttttatgagaaaagatttaataatgaaaaaagggacacagacggaacagcgattagaaacaaattaagaggcatttaggaggaacaattagggaaaagtgatgataagaaaagggagggaaaggagcagagagagggaagggaatgtttttattttgataatgtattctgtgatttcatttacaattgtgcgtagttcgngcagngatgcgatcgccanaacccaaaaaccgggcgcgcgagttgaaaaacccggtaaaaacccggcaaaattntcaaaaaacccg

SEQ ID NO: 27542 - DNA, 2034 bp, Heterodera glycines
  misc_feature (7)..(7): n is a, c, g, or t
atcaccntttctagaaaaattcattgggacttgacacttattttaggacgaagtcgaggaggagcagggaatgacgacagccaaccattcggatgacactgctggcaattcaggcgcaaacagttcactgtcagaaagttgtgctgctgacccaacggacggagcagtgaagacagaacacgaaacggcaataaaacaggaaatggttgggcaaagccacgcatccgacgaatcatcggaggaggagggggaggacagtgcggacgattcatcgcaggacagtgacagtgactgaccacggacggactgatttgagacagaaagtccgcggacttgtgattgatatttgaccgatcaaaatgttgttgtgttctctgatgttttgtcgatctttctttttttgtttcactgataccgatactccattctccgtttaatttctgtttttcattgtttctttgttcctttatatttttatgacattgttcttgtcttattcgtattatcaaaaattgcttatcaatgcgcattttcagtggtcgtttgctctgaaaattgttatttttttaaacaaataaattttgtttttaatgcttaatttattttcaaattgtaaaagttaattaattaattctccaattttttctctgtttccatttcacttttcattattcggtttttaaccctttaagcgtgccattgaaatgaacgaactttccacgctcgcttggtacccggctgccgaatttttggaatttgaacgaatcaacaaagcgtattcgttcaacgtcccagccttttctgtggacacttcgacaacggatgggccgaagtacacacaaattatgaacgcactgtcggaacaattgcaacagcacgtggccaaggcgaatttgctgatttctctcaacgagaaaatcccacaattcgatgttgaagttgaggtcggttttaaaaccgaaaattgaaatgtaggattttatgagatgacggacagataacgaaactaaaatcaaacattaaaaataatataaaactgttttaaacgcgttttccctttatttcgagcattttttgagtttcaaaaagcatttgcgcaaatgtcaacaaaaaccttttgttaaggaaatgatgcgcattgcaattggccgtacgcaattgctgctgaacaaacggatgaagcaatttcgggaacatttgagccgtcatttggtacgaaaagagagagcgacggcatttacggcacgacaaattgaattgtcatttttacagaaaccaattcctggccaaaaagtgaccaaattgaacgatttgcacgctctttgggtgcttatcgacatgcaattggatgacatccgatccattttcaactccatcgagcagttccgtcttcgctgttgggctgtcgctgaaccaaaggccgccgcgactgccgcttcttctggcaattaattaatcctcagtctttcatcatcgcatatttttgtttttaaagtgccttcaatttttgaaatgtattgaactttttactagtacaaatggaatggaatataaatttatggttttatttgatttgatttgatcaattgatgaaatgagttggtccgaaggcgactttccttccctttccctccattcattaatttaatccgatgatttttgccatatttttgtgctgtccgtatgaatccgatcagcataagcaccgtcgagtacaggccacagaatgaggacgaagcgcgaaaggaagtgccaagcggcggtggagcggcctttggcactgttgctgatcagcggagggcacagctgttgccgaaaggcattgatcaatggtcgacaacagaagtgccgtcttttgccatcgccaactccgacacggcagccgatgcttctgcggcggctgcgtccgtcgcccctgtaccaatttctccgtcgttcaaaacgtttgttgcccgaagcaatacgcgaagtgcgggcggagtgatcaaatcaaagcgcgtttttaaggtgattagcagcatacagaaaaagggg

SEQ ID NO: 27543 - DNA, 906 bp, Heterodera glycines
  misc_feature (598)..(598): n is a, c, g, or t
tcaacaaaatttttctttttgttaaattgattttaaattaataaaaagtcgtttctatggattttcggggtcgtagaacccgaatatgatgtccgttttgacccatttcgaactccgaacccggattcgaacaattatcaaaattcaattttttttttcattttttctcctaaaaattattatcatcgcaagaaatcatatttatattgccgttgtcgttctgcatgtccactttgtttgttctcgcattgataccgcaaaaaaatgacctgtaactcttgaccaaataaatgagggaaaaatatgatttcttgcgatgataataatttttaggagaaaaaatgaaaaaaaaaattgaattttgataattgttcgaatccgggttcggagttcgaaatgggtcgaaacggacatcatattcgggttctacgaccccgaaaacccataaaaacgactttttattaatttaaaatcaatttaacagagaaaaattttgttgccacaaaacccgaaagtaccgtcgaaacattttttattttctttagccgcaaaagggaattttttgaacttttatttaaggctcccaagtgcggtcggnggtcttcgcgtggccgttttcgcgtgagtagctgtttaggactgaaattggtcggatttgtgcaaaacatccatgtttcgaatctgaacccgcattcggacaaatttcttaactttttaatttttttatttcttgcggctaatatcttctacaataatttgtcagtttggtcggatgtgcgtcaaacggaaataagtaaaatttttataaaaatataacaaaaaataacaaaatttcagaacaaactaaggccgctttttccataattccggaaaaccaccagtgagaaaaatgataaatgttttcgg

SEQ ID NO: 27544 - DNA, 1470 bp, Heterodera glycines
taatgatatttattttattaaaaatgagtaaattttcgcattaatccaacgaaaagccaaactcattaaatgatgaaatactaggtaaatgaaataataataaattggtaaaaatattgtttttcttgtcgcattattttaaaataaattttaaagagagaacttggataaattttgaaattttttatatccaacgtaagaaattaaaaaaaacggcgaagaatttacaagattgtacttggaaatggtttttgcatctgaatataaaaaatgtccattttatggtaaaagtttaaaattttttgcattcggcttacggttttgattaagttttcatgttcacttggatttcacaaattttccccgttacgaacttgggtaattgcaatcttgtacttggaaagtgaattggacaatttagaaagttttatgtgtcaaaattatttaaaattaaacaaaaatatttttaaaataaaatgaaaaatagggaagaatgcaaaaactgttgaattcatatgctttgaggcgaagataatgcggatgagtaacagcacaaaatcaaacggtgaagaagcaaaaaaagacgtctctcatctttcctcgccattagtcaccattatcattacacatttttattatttattgtcatttttaaaagttaatacgacaaaaatgtttctcatccattttaacgctcaatttgttcacttttaatccacgacttcgcaattttttgatggaaaatgcattaatggggagagaagaatgtgtcaatgcaccacttcacgaagaatcaattaccatttttgatgtaccatatttttgtaaatttataagtatattcatgttttattttttaaataataaaaggaaagggatggatttcacatattagggatgaaaccccggcgccggaaatcggctcgggttaccaaatcggccagggttcggagttttttgggttgggaaaactcaggccgggattgccaaatcggtcagggttcggagttttttgggttggaaaagtagggtcgggttttttcaatttttttcttcctgctataaagtgaaaacatattttattaattatttaaaacaaaactttaaaatctttaggttaatatgagtcgtcatcagagtaaatggacttacccttcagacggcatatttttatttgagaataaatacataaaaataaaatattaggacattaggaggggaaggagatcggctgacctctcaatacaaacgaagtccgggggagggagaattggcacacaaaaatatagtccattaaacacaaattgacgaatttttatccgttatgaattggggggacacaaattctggtccacttcctcctcctcctccttcaacatttgcttgttctgctcgtcctcctccgtttcctccgctgtgccgtgcccttccttttccctccctcctccccctcatcattcgcctcctcct

SEQ ID NO: 27545 - DNA, 1232 bp, Heterodera glycines
ctctctgttttcagatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggaggcggagcaattgcgcatcatttttgagtgagtttttcaaaaaatgctgccgcaaaaaatgttttttttttcaattttattgccctgtcgagtagaatatttcttcccccccctcagaaaactcggcactccgtccgtctctgtttggcccgccgatgcaattgtccctcattctttctacgccgaaaactctccgcacataacacctccgtttgccaatcagatgccccaatatttgcccgcctccggtgttgagttgctcacggcaattttgcaatttaatccgcacgaacggccgactgcggttgaatgtctgcagcacaaatactttgtctgatcactgatcgcgggaaatgttcatttccgctttgttttccgcccatcccttactaattaatgatttgactttatcccccattgatgaccgatcacagccaatggccttgcttcacttttttttagttttgccatacatttaatcacacatttttaaaccaaaaattttgtaaagctatttgatttgtaatattaaattctctgtattatgaattaaatatagtgatatgaaacaacacgttgcatgccagccttcaaggctgttattcgtgcgtgaaagtccaagtgccaaatgcattgcaaaaactagataaggactaagcaaataggcaaataggcactcgagaacgcatgggaacgatggcgagataagaagttggagaagtaaatttactaataatattcaacagttttaaagtacaatttctttttatgtaaatcatttattaaagcacaattaatcattttattttgcttagaagtaccatacgtaaaaagcgataaatactgtattaaatagtttaaccaaaaatgaagcacattttaattttatgaatccactgacgaaaatattcactgccgaattggaacactgacgaaaaaaatgggaaaacagtgaaataaataaaaatagtacactgacgaaaacgttcactgacgaaaatgtttactgacgaaaatattaaccacg

SEQ ID NO: 27546 - DNA, 1817 bp, Heterodera glycines
aaatttaaaaaatattgaaaataatttttggattcagggaacaaaattttgttgtgcacaaagaatataacgtaaattacttaatttacattaaaaaattaaaaatatttattcattcaattcgtccaattagtgctttttgcctataattattaattactaattaattgtggacaagcctagtctatttaaaagcaaatgattgtgtttaattggaaatcattggaatatttttgtagcagcaaatttcacactgaaaatgtcttcttcgtccaccatttttgttgttctgctggtaattgccatctgctgctgttcattaacaattgccatgccagcagcggtcaatgaaattgataggtattattttattttgattttggcattcaatttatctccctaatggctgtgggcgaccaattctggcactttttggttggctgtgcataaccaattccggcacttttagcgcagggatttcgtattccgcaaatttctagaaaaattcaagcaaaagatttgaatgcttcaaaagtgcaaaaaatatttattaattttgaaaattggtggtttcgaaatggattttattttttatatattaaattttaagtgttccacttcggcaaaagcgtggctatggctatggctctggtggctatggctctggtggctatggctctggtggctatggctctggtggctatggctctggtggctatggctctggtggctatggctctggtggctatggctctggtggctatggctctggtggctatggctctggtggctatggctctggtggctatggctctggtggctatggctctggtggttatggctctggtggctatggctctggtggctatggctctggtggctatggatatggtggctatggccacggcggtggaataggcggtggtagaatgggcatgggcagcggcagcgggatgggcatgggcagcggcagcggaatgggcagcggcagcggcagcggaatgggcagcggcagcggaatgggcatgggcagcggcagcggaatgggcagcggaatgggcatgggcagcggcagcggaatgggcagcggcagcggcatgggcagcggcagcggaatgggcagcggaatgggcatgggcagcggcagcggaatgggcagcggcagcggaatgggcatgggcagcggcagcggaatgggcagcgtcagcggaatgggcatgggcagcggcagcggaatgggcagcggcagcggaatgggcatgggcagcggcagcggaatgggcatgggcagcggcagcggaatgggtatggggggcggcagcggcagcggaatgggcatgggcagcggcagcggcagcggcagcggaatgggcatgggcagcggcagcggaatgggcatgggcagcggcagcggaatgggcatgggtggacgctgatccgcgaagtgatgaaaaaaagattatttaaaatgacccaacattttttcatcgtatttaatggatcaaaaaaacccaaaaataaattgaaatatttgcgactgttaatatttccaattataaaaaaaatttattttcattaaattaatttatttgattaaaaaataatgacattactaatcggatggtcaatgaaaaaataatggaacaaaaattttaaaaaatgttcaaaattattaaatagtacaaggaatttgaaaattttttattacattcaaaaaaaaaaaattaaacgtttatgccaattaaaagtatatgcttggtcaatgacaaaggacccagagacaaaggtcccacaaaaactaattacaattaaaataa

SEQ ID NO: 27547 - DNA, 1627 bp, Heterodera glycines
gggccaaagcagttgggagaaacggcagcaaacattgcgtgaaggggtggtgaacgcggggaaagcggccggggaaaccgtcggtaagccaagcaaagcacagcagagcaattctgatgttaattggaatgttttgtacagttacggccgcttctaatgtcaaagaagcagccgtaaatgtcgcaagtgccgcggggcaaaaagtccgaggcgcggcagagacagtggaggagggcgtagcggaagcagccaaagggacgggcaacgaaattggtgggggaagaaagtgcagcactaaggggggggggcttatcaccaccattcactgatcagagcgagacttactaattaatgattgatgtttagggaaggaattggaggaggcggggcacgcccttcaaacggaggaaaagcgaccggcggcggaggaaatggccaaggcacagtgaaagagggcgaaatgccaatgctgcgaagtgattaatgacttatcactgtccttctcactcatcaaatccatggccaattcattcctctttctcctcattaacattttgaatttccctcctttctcattcttttgaaattgatcttttaatgctttaccaattattattattaatattttttccttattgtgctaaaatgtcgctattttccttggaccagggaacggatggatttatatgtgctaaaagtcaaaaaatattttactgatgcaaaatcccaaaatatttttaagggctaaaaagtcactattttatttcgaaattgggcggttaaatgtgtttttggtgctcctctcgaaaacaaataaatccttccactccctaaagataatgaaaaattaattttatttgttaatatggagaaaaaaacaaaattgtttaattttaatgaaataaaatattttaatgtatgagaaacagaagcaaaagaagaagtacatatgtaccaggggtgcaatttttaggctctaaaaactgccaaagtaattagtttttagtttgctaaaaatgggtaaatagttgctaaaaactttcaaatttaaatgacgaaatttattcaaaaaagtaaaaaaattaggccaaatcagtagggatgtcaattttatgtaaatacaacatatttttttcctggattctccatggtctaaatagtaggaaaaaactttcgtttctgtgtttgcgaacaaaaatcggaacttttatttacatatttcgtgattttatacatatttggtacatttttttgacatccctacaaatcagtattgagctaaataatttttaaaatcacaaattcttgtcaagaaataaataggtaagtaaattttggattgatttttgaaaagtttttatttgttacgggtgcatttttgtaaattttcgggtcgattcttagggtttatttctaagaatatttttgagttattagaattattttctagtttttttacatatttttagcaaataaaaactataaaatttttgaaaaaaactatttttatttttgcttgtaaattaaaatttgttatgaaaaatgcatttaaatgcgatttgctaacagattttgtccaaaaaaatgaacaaattttgcgatttttagccaggagacgccttttttt

SEQ ID NO: 27548 - DNA, 597 bp, Heterodera glycines
tttcattttgagagttcttagcaaaaactgcagcaatccctcccctcccttcttctttcactgcgcaattcgcttcctattttcagcgacaattgggcgagtgatcacgcgaattggtcgaattggttgggaaagtggcgaagtagggaaaagaggtgcgatttgtaaaaataataagtgaaacggggattttgggaggtggatgattgttgggtgatttgatcggatggattgtgatcggcagagagagagagagagagatcggatgggaagtgatcggatgaaatttactaaagcgattgagtgacccgtcagttcagtcgattgtgcgctccgtcgttccaatcagtccgaaaacccgacaatttattttgtgtttgtaatgtgcaaaaagaatgaaaaaagcattatggtaaaaaaggaagggaagaacagccgaagagtgcgaggaaggagggaaatgacgaagaaattgcggaggacaatcgaatgacaaacgaaacgaacgaatgactctcgacgatgcctttccaactcaatttataggccggggacggggggggggcaaaccgcgcgggtcccaacttttcacccccc

SEQ ID NO: 27549 - DNA, 993 bp, Heterodera glycines
cggacattcttcattcatcccattcttccttccccccatttttatgtgttcttcccccccccccccaatcccatcattctccggcgcgacagaaaacaacaaaatatgtatgtatgtgttgaaaatctattgattttcaaaaaaaaaaattttgtgttacattggcggatggaattgaccaaaaaatgtgtgtgtcggccggcaaaactggtcattagtcatcattagggttccatattttattttccctggactgtgtgggagtaggcctgaaacgcacgaaaagcatatatttttaatctggcataatttactatattcatattttccgtatttgcgcaatttatttatccattccatagttttacatttttctttaaaaaacctctattagaacggtccgtcagctaaaaataaattttatggaggtcgagaagggcctaaattaattttggaactatatttttaaatttacttccgacatacatacatatatatttattctcataaaaaacatcgacaattttttgccaattaaaaaaaataacaattatggatgcccagaggggccaaaaatcattttttttttttcatggcacccccgttgataacggccaacaacgattaagaattaacgcagcccctgtgaccaattttttgggcagaaatcgaacattttttcacattattcccataataaatcccaccgagagcagaggagagagctctttttgccccatttactgataaaaaatttttgtcaaattcggctgctctgctgactgttggctgcacaactcgcggagtttttctccgccattttaattatttatttatttatgtttttctcccgtcattcaattcgttttgtgctttttgtgttgccgccgccgcccaatttcttcaaatattatgtatttataaaagattttgaaacaaattggttattggttttttaattaaaatttttattttttaccaacccctcctgat

SEQ ID NO: 27550 - DNA, 959 bp, Heterodera glycines
ctaaataaaatcaaaaaaccaagactataaaaaactaaaaattgctgattttatgcactaatacatatgtacatattgcatatttctttgttgttttccacgatcatgtctgactctgattacgtgatcgtccggaatggcgtggcacttccatcattcattcgttttcattcatttctctgtcccaattcccaatgcccttttcccatttcccatcgattgatggaatcatttctttttcttcattttgccatttacagatttaaaatacactcactttgttttttgttgaccaacgacgccaagctgtacacggaacagcagcaacagcgtcaaatggacgctcagcagcagcagttctgttccagcacatcctcctcgtccgcctccaacttcatgccctcctcctccgcagtgtctccggcacgttcttctactgttggtgctgcctcagttgttcatcaccaccatcatttccatacgccgcttccctcatttgcggaacatccgcttcaccatccgcaacagcagttgggcctcgtcaacgagcgctacacgtcgcccatgccaaacagcaacaacatcaacaacaatgcgttcgatggcactgacaatagtgggattggcattggcatttttgccaaccgcactctgtccgcctctgctggcatggcgaggccgccgccaccgcatcagctgaggcgtgcctcatccgcatcgatggacgcaggcggcaaatggaaaggcggcgccatcaacaataatatcgccgcaaggcctgccagtttgcaacaccatgaattgttgatgatgggcggcggtggcaccggcgtcattgatccgcagaaaaagcaccggttgacaccgttggcacgcaacttcgagccgaccgccccgcgctggcggaggaggacatgatgataccggacaagcatgaaacatctgcaggacgatgatga

SEQ ID NO: 27551 - DNA, 1102 bp, Heterodera glycines
  misc_feature (610)..(610): n is a, c, g, or t
tggcggtcagtcagatacctaaaaaatgacgatgggtagagaggaaaagcagaagcagaatcgcctaggcttttcgttttctgttttttttttgttgggcgatgagagaattgagaaaatgttttggggaaggacgcaggacgaaaacgacgacgacgatggatggattggagaagaaatggttggtgtggctctgctctggcgttgtgtgtgcttggcgtgttttcagaagaggaataaaattgtgaggaagcgaaaaatggggggaaagacagtggcgaaaaagtgggcgggtcagaacgatggcagagaagtgggaggcagtgaaaatagtgtgccaaatcgagagaaaggggtgcgcaacagttgcgacgaaatagtgtggggcctgggcgacgctcggacgagcgatgtgcgagcacgcggggacctccgccgagcgctcacatcgccaaacggccgccaatttgatgcctgaccatggcgcaaacatgcgcaaaatgcgcacgcttaccatggccaaatgtgggcggatgagtgcgcaacttgtagccaagaatttgtgctacgaaaaatgatgtaaaatttggcgaaaatggtccaggctagnccgggaaaaagagcaaaaaacaaacacattgcgccaacattcaccaagttcggttcgtttaggcgtcgtttttcgttgtacagtaattttggacaaaagtatactgtagcattgttgtagagcagaaaatgggcaatccaatgagctccaactttgcacacattttatcatgccaaggcgcgtaaaaacggaaaacattgtgcgcgtggaactaagtgcactcagtccagccagtgaaaggcacggtttttcgggcataaaatgccgtaaaaaatggttttttgctcagaaaaggtaaaattgatattgaggagtgttaatatgtgtgaaaatttaggcctatttatgtgtaaaaccgtgaaattctttgaaaattattattgtttaatagtaaaggtggtaagaagctcaatgatgggaggtgagagagaagagagaggatgaggacttctctcttaaacggttaacgcgattttaattgaaatttttcat

SEQ ID NO: 27552 - DNA, 1937 bp, Heterodera glycines
  misc_feature (1908)..(1909): n is a, c, g, or t
  misc_feature (1926)..(1927): n is a, c, g, or t
cttcccctcctctctcccccctcgcttcctccctctccttttaaggctctctctcttccctctcttccccttcccctcctctctctctctctcttccctctcttcccctcctctctcccccctcgcttcctccctctcttcctctctctctctctcttccctctcttccccttcccctcctctctctctctctctctcttccctctcttccccttcccctcctctctcccccctcgcttcctccctctctttctctctctctctctcttccctctcttccccttcccctcctctctctctctctctcttccctctcttccccttcccctcctctctccccccgacggttcctcccaatcttcctctctctctctctccatcttttggtgccacgacccccccttccctttcaagtcaaacgaaataatgggcattttcgccgaggtgaaaggcagaaaagattgaaatggcccacctaaaagaattgatatatgcggaaattgatcaaggatgagtctccggccttctcacattgatgctgcgtatccatcgcaattgcagtcgtcgtcctcgccaccgtcgccactggcccaaacaaaaatggagccgagaccgaaacgaccctttggaaaggcacaatagcaaatacatatatgtatagagtagcaaaacgggattcacttttactaattgtgtcctcattatcttttgtctctcttgacatttccactttatctccccttatcccttatcattatccccttcttatcttcccaccccacctcattcactccctttacaatggctcgcattgtcgcgtttcttgggccgtccaccgttttcctgaaatgccatttttcagtgtccccgtctctctgtctcttcacccgtcgtctgttggtccccaactcgctgagtaaatgtgaattttgttcggctcgtggcccatcgaattggccttcaaagggaaagcctaggtacgtttgctccccattcgatctgacttcgatcagatcggtcatgtacggctggtcaagcattcgtatccctgccactttgctgtcataggcaacgccgaccccgcaaattccgttgtcgcgagcagctgaaatctctcccgcacagcgcgtgccgtgagagttgaacctgcgacgaatggcacaatccgtcggatgccctccacccccccccccctccaccaaccaatcgtcggtgtaccgcgggtacgggtaagggtcgttggagctgaagtcgtaactcgcctcggcattgaagttgaagcggagatcggcatgcatgtaatcgaccttcagcagaagtgatcaacacattcgatcagttgatggacataaacccttccccaacattcgctcatccttttcccaccccatcgtccattatcgccgttgtaatgtttttgccggtgtatccgagagcccacgccttctccacgttcagatcaagccgcggtttcccatttgattggccgtcgttcttctgaaatgtgactgatcagtggaggggggggggcaaagcgaagggcaaatgactgaccaaataccattggaaagggtacaaagggtcggtgggcgattgaactgaaatgggagaagtgcccacccttaacatggcgtccttccccgcccacctgaagtgaagtcgagctgtttttgaagacggtcagccagcggacggtagccgcgttttaagcgcttataaccttcgaattttattcggattttgttggctttttgtttgaatttgtcaataatactgaccagtcatttgttccacataagcaatctgagaagaaaggggaaagtgaaactgaagcgaaagggaattcgttcattcgaattacgtctttatcctgtgagagtttggcgttgtgtccgaccgatcgacganngtccgcgcgtgggaaanngtgacctgca

SEQ ID NO: 27553 - DNA, 1299 bp, Heterodera glycines
  misc_feature (21)..(21): n is a, c, g, or t
gctcatttacttgccatgttntattttttattggcattttgtgccatcgttcatttttggcagaccaattaaagacaaatcgcgcactttaaaagacacaaacagatcattcattcatttgttttccctcctcaaatagcccccgtttattttgcttcgttttcgtttcggtgtccacactttgtgattgatgggacggaatggtcgtccaaattattttcgttttccccgcggaaaaagggcatagattttttactaataaatttcccacgacatttgagaccaaaaaaacaaacaagggatattattgcgcatcattaattagttaattagggagggagcaaaaggcaaaatttggtgaaaagtgcaacaattcgcaaaaagcgaatgtgcgtgaatatttcaaagaaatcaaacgcagaggccagcgaggggagaggggtcgcaaaatttggaaatttacgaaaattaagattttttgtcgatccccctccctcttttaatgtatgaaagaaaaaatggcaaaatgtttacactgtccaaagtgaacacgctgagcacgcgtccgtccggctgaacggtgccaaagttgtcacagatttgctggtgcaatcgctggtcaagccgaggaacacaacgcaaaagctaaacaaaaggcacaaaaattcaatttctaattttttggatgtctcttattgttagagttctcgaaaattagaaaaattcgcgacgagaatttgaaaatttgggtttgaagagaggttttgtgggatttggagaaccctgttttgcccttgtacctttcccttgccgatcagcacaaccaaagcgtacagattggccaacggttcgaccaaatcgcactcctcgggcggcacgccatgggccaggcacagatgaagcacagcgtagtccaaacggaacaattgctgacgaagtgccgactcatcggacggagggacggccagcaaagcgatgccgtgatgaatgttggagtagggcaaggaaaaatggaggagccgggtgagcagttcagcaagttgggcacaataggacagagcggcgacggagtcggacggaaaatggcgacgatttgcggcggaggaagcggcagagaggggcgactgaatgttggcacaggcggacactttggcgagaaattggacacgttcgagacatgagcacaaattaagctgaaagaggggccaaattggaaccaaatcgggaagacgattttgatgaacatctccaagagatttggccatgaagagtaacccccgaaataaaaaatccattttt

SEQ ID NO: 27554 - DNA, 1475 bp, Heterodera glycines
  misc_feature (1402)..(1402): n is a, c, g, or t
  misc_feature (1411)..(1412): n is a, c, g, or t
  misc_feature (1426)..(1426): n is a, c, g, or t
  misc_feature (1453)..(1453): n is a, c, g, or t
ttatatttgcacatgctttggcgtaaagtgaaggtctcacacacatacataaagctaacattcgggggcctgggaatggttgcgcatcagtgggaacggtaaaaacccggtttggtgtaccgttttttcgacataaaatctccataataatttttttggtttgaaaagaaaccaaggtccctaaaatgtggaaaacatttttgattacctacctatgtgaccaatttgattatggttttctatgttcacatacatatatgtgtatgtattcccataaaattggtaagtcttctaggaccccaagggcgtggccaataccttcacttccggatcgggccagtatcgtctgtccagttgcgtctgagccaagtttagaccaccataacttttttctttgttgaccaaatccaacagttggtatcattcgaaagctcttaacaagctctatcggctatacaaaaatcaaaaagacattacgacatataaataagttataacattaaaatatgcaaaaattaaatcttgttgccaatgatctaggcgattgccccctacgtgctctaatttagacaattttgaaaaaatttcataaaaatgcgaaaaaacagacatcgatcgcgatgttcttttttggatttgtgtaaaaaaatgcaggtatatgaaaaacacagttgccaggttactctttttttcactatatagtattctaaaagagaacatagagctgtattaattagataaactcttttccgaagggaaaattttgaaatttacaaaaaaatcaaatttccgattaacttttgacgtccaatcaatgaccatcctgtttttggccataactttttgttactttgtcaaaataaacattcttggtatcaaactaaagcttagaagaaagcaaaagttggcacaagaaagcagtcacaatgagaaaacaccaaagtgcgcgaaaagccattttttgtatgcgacaaagtaaaatcaccttcaaaattgagatttaagttaaaaaaataggggaaaatataacaacaaaaaaacggcttaataaccatagagttcttagagtttacaacttgcgaaaaattgaagggaaacacaaatttttcatttttgtttctggattttttttaattgggcaaaatgccaaaataaaataaaactaaaatttttgaatttttagaacgcaaaaaggaaaaccgtaaagcagagaattaggaaaggtggccaaacatgaacaatcgcttctagggattgcatttcatcaatattgaacaaaattggacatattttttaaaattttaaacggcataaattagacattttttaaccacatgattttctgcctgcctacttaagttaatgtcaattaacattttaattaatgatcaaatgtatttgntggcgttgnntgtgggcgctcttnttaaaaacagtaattaccataaaactntgaaaaatcgctaaataaattt

SEQ ID NO: 27555 - DNA, 1233 bp, Heterodera glycines
  misc_feature (55)..(55): n is a, c, g, or t
aaagtcaaatcgaaaagggagaagggacagaagagccatttgaagagaagaattntggaaaagcaaattgaggcaaggatttgttgggagagatcgtcggacgtactcacttcgttcttcgtccgattttcgtccgtttgtccgttcttcgttcggttatgtcggcttttcctttggccttccgctgattcgttccgttattaatccgtgcgtttgttggccctttctttctctgcttttgtctggtcattcctttgttgtcaaattcggtgtcattatttttaatttgtttttattgtgccatttgttcgtttgttgatgccactttttgtttggccatctgtctttttccttccttcctttattattattttttatttatttatttatttatcatccctttccattatataaacacttattattgtgatgcttttcctcccattccttcttctctcccctcttttcttcttttctcctttctgctattttctgttttgtgctttattttattttaattttatttaattttattttatttgattttaattggaatgtaatgacaaaaaatgcgctcaaatggtcgaggggcaaaagaatgaattacaaaatgcgcagaattgcggggaggggagagaaattcagaaaagagagggcaaagtttgtgtcccattgttgtcgccaatttggaggccaaattgtcgcgagagagtgaagggtcaaacactttcattttttgtacactgtgcaccccgggggcatttgggcgcaattcgtaattgaatcaaatttcacactgatcaaacgcaacaaaaaacgaatagtcactgaagaaataaagaaaattgttttttatggcagaaaattcccatcatttttaaattgaatttctaatattttaaattgctatttaaatgccaaatacgaacaaataaaaatgccgttatgggttccgttaaatttctccaggttttttatggtggggcgggggcggggtccaattttccatggtttttgtttctccttttctttggccttttccatgtccaattttgtttcacgttttccacatctctcatcagtttatcactttgctttcggtgttccagttacgaaaataattcaccaatcacccaattcatccatcactgatcagctgaacagaaagcacattttgaggaggaagagaaggaaagactgggcgggggagggcaacaaaatggggggggggga

SEQ ID NO: 27556 - DNA, 1987 bp, Heterodera glycines
ttcgattgactgtttgggtgggatttcaaggacgagttgagaataaaattcctttttaggttccatattgtgaatatttatatgctgcactttcgcgtttgccgtcaattaataatttagagccaaaaataggtgaaattttggccgcggaagtcaatgggagatgggaaagagttgaaatgatcagaccatcgttagccgaccccaatttttgggtattagattgaaatttaaaaagagtaaaaaatgccgaaggttgtgctggttgtcgacgaagggtatttccacgccgtacatcacaaccagctgaggcctctcactgaagtcagttaaagccttcacagcaaattcaaacaaaatcattttagacagtgaccgctttcaacaaaatttttctggcaaaatgtaaggtaaagcgtgttaatttttatggacctgcagattgtgaacatttagcttgaaatcggcacggatggccaaggccgtggttggagtgcggaggtgcagcactttgtcagcgagtcattgcggaaggtggccatgcgaagtgattgccgggtggagttgctgctgcaaaagggtggaagttggcaatacgcggagggagggaagattccgacatgtacagcgaaattgctaatcgacggtgccgattttgcagcacaaatggcactgatgggaattggccattcgaaagcaatggaatgaaaacgcaaaacgaacgacgaaaagcattggggaaaaacaatttataataatccaacttaattaaattacattttattttgtgataaatgtgtataatcgcattctaatcacattcgaatgtgtgcaactcgaggcccagtgacggaacggatggctttttggatggtccgtctctcagctggttgaaaataataaaataccgcaataaattttaaaaagaagaaagtttacccgtccttttctcattctttagcttggcataaagtgcagaaatgtttcgtctgatcagagccctttcaattgttctcaatgatgaagctaaaaaacatgtttaattttttggatgcccctcccctttttgaaaaaatcaaaattagttttatattgaaatatctcctgagattttcggtctctgaatatgaattagacatcattccgcacccctaaaatggactcgaatggaaagtcaaaattttacatttatctcaacattggtttaaatcagggttactcttgaaaatttcccgaaataagtacatcgctggtcaaaaaaagattttatggtaaaaataaagacattttttaaaacacgcttacaaaactttaaatcgcattttttattcaacaaactcaagcattagcaacatatttctcgccgccaactatttttctgagcaattccggtatagaaacgataaatttatattccgaagaattttgatcaaaattcacttttacttgcatcaggcttttcactgtttctacttcaagcaaatttctcgtattttttttcgcggtttttgagtcaattttaaaaaatagagaattttggggctccgtcggtgccgataggcgccgccgggaaaaaattttaaaatttaaatgcaatttttaacagattttgtcaaaaaaatatccaaatttttgcggttattttatgattttaaatgttaaaattatgaatgaattcccatcgataaaggaatcattttgaaaaattaaaagaaaaaaaaattgcttgtagggaaactgatccaaagatagaatgagcaacataaccaagagcacaacccactgaatcacgcatatgaaaacgaaattgaattcaaatagtaaatttctttaaaaaattatcatttaaaatctaaatttctctgaaaccaaaaaataagcctaaaataaggacaaaccttacaagtaaaaacattcaaaatttgtaagatttggaccctcaaaataatggcaaatcttacaaataaggacgaagggtaactctggt

SEQ ID NO: 27557 - DNA, 1876 bp, Heterodera glycines
catggaattccggacagtagaataggtcctgacgaaaacgggcggtatttgatcagcaaagttcatgccgtttatgtacaccaaaacaatagaagagcctattttttgtcctttcacggttatttaatgttttttaagaaatgaatttttgattaatcatagttatgaaataaaaatatattttgagaattaatcaattataaaataaattatatacgttttaatgaaaataattttataataaaacatcacttttattctgtctactctcgcccctgagactcctggggtcgcttcgttgtcacaacgaaatgacccttggaatttcagggtgaaatcgggttcaccctgggttcatatctgaaccttgggcgcccatcaccctcacatctctctttatttaaataatatattatataattaaaccttgtatagaatttaaatttattaaaaatcaataaaaatatattttgagaaataataaattataaaataaattttatacgttttaatgaaaataattttataataaaacatctcttttattctgtctactctcgcccctgagactcctggggtcgcttcgttgtcacaacgaaatgacccttggagtttcagggtgaaatcgggttccccctgggttcatacctgaaccttgggcgcccatcgccatcatgtctcttttatatttaatattaatactataattaagattttgtatatgaatttattcaaaaaacaacaaataatttattcataaaattaataataattttattgtgtaaaggtttattagagcaaatttgtatttttctagggtggcccggatatgaagaatggacgatttcagaagattgcgaaaatttggagcaaactaatgagtttacggaattggtaacagttgaagctatcttcgacttgatgctaaatagaccgattgcgcgtcatttagctaaaatcgtcgaagcctgcccaaaatatgatcacggtagaaacaaatcggaatgaaacctattaaaatgattgggttgcttctttagttcgccaaaaacatgggctcaaaaacacaaagatcaaaaagcttgacatttcgttcgtatctaatacggaagatcgaatcaagaggaaggccgttaacggattacaaaaatttatcgataatgtatttaaatcctaatttattttggattgaactgttgttaaataaaaaacacaaagatcgaagccgagtaaaaagagggataaccgtcacaaaaaaaaccaaactttgatgagtgagatctgttaatggtatgataataataacaataataattattcgattaatcattttaattttgggaagtaaatttcattattgtggagcatttttatataacaagattatgttagccatttgtaagctatatatttatgtttgataaaatcagtttttaaataaatattatgacaaaaaattttagaatagaacaatggtttgaaagttgtgtaaaaaatctgttttttttttgttgagtatgatcattttttaatgtaatttggttaaaattaaaaattggtagttcaacatttttattcaacaacaacaaataataaaatatttggtttttgccagttaccaaggggaggaaatttctcctcaaacctctctccgaataggaaaaaattcaacagttaactaatttttaaacaaattttttctcctagaattgacaattttccaaaataaattcagaaatttttaggcttctaaaaaatttttggttacgggcctatttggtttatggcataaatatttggtttatatcaaataaaaaaatcgggcccgtgttaaccaacacagaagtgtctgcgccgatcatcgaaacagtggaaa

SEQ ID NO: 27558 - DNA, 1198 bp, Heterodera glycines
tttaaatttattctctatgccagaaaaatgctatctcttttttgcgagaaattttgtaccatacaaatgtgcccagcatgggcagaggggcgcggagagcaatggccattctattctacagggaatttttaaattatttctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttatatttattctctatgccagaaaaatggctatctcttttttgcgagaaattttgtaccatacaaatgttcccagcatgggcagaggggcgcggagagcaatgagcattctattctacagggaattttttaaatttattctctatgccagaaaaaatggttatcctctttttt

SEQ ID NO: 27559 - DNA, 1015 bp, Heterodera glycines
aaacaaaaaaatcggatttttcaagtgttcgtttggggttctcaaacaattatggggaagcaaaaatcccacgcagaattaaattacagcttttaggggaagttatttccgaaaggatttggtctccccataaatctgggggcaatggtttcggggggggctgccccggaaaacaaaaaaaatcgattttttcaaagtttccgtttggggttactcaaccatttaggggggagcaaaattccaacgcagaattaaagtacagcctatagggaagctattccggaaggattcgttctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgcccagaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccggaaacaaaaaaatcgatttttt

SEQ ID NO: 27560 - DNA, 1157 bp, Heterodera glycines
tgaaacggaagagtgccatttgactggttttggcgagaaagaagccaaacgctacgtgagcaatgttgtccgcgtaggatttctgggagtcaacggagacccatatatatgcgcactcaatgaaatggaattcattgtgaaagcgatgcccatcgtaacgctgaattcgatggatgaagcggaattaagcaagaaaaaactttcccttccatcgcggccaagacagccagacattctgttgggaatggatgtcagacatgacctgaaaataagagacgagacagaaaagttgccaagtggattcacattgtcaacgtctcgagtcgggcggatgataagtggttatggccaagtccagggcccaatggacatgagtgtgcaagtgacgtacactggagcactcataagtgccttacaatgtgccaatagcagaagagatgctgacgaagaaattgaagaacagataaagacatttttcgggctgaacataatcggattgagcgacaatcctgaagaagaggacaagggagaagtgatgagaacgttcagaaaaggcttgacattcaaagaaggaagatatgaatgtggcctaccatggaacgaaagagtaaaggatttgccgacaaattttcaacaagcgagggcaagactttgtggcacagtgaagaaattgcgagaattgaatttggtggaagaataccaaaaaattttcaatgagtgggagaggaacgggataatcgaaagagtgccggatccaacacaaacaactggaccggtacattatctcccacatcggcccgtgataaaaatggacaaggccacgacaaaaataagaattgtgatggatgcatccgcgaagccagcaaaccgcaaaggagccccatcgttgaacgaatgcttgcacacagggccgttgttgctaaacgaattgaccgggatccttctaagatggagaagaatgaaggatctaatcctggcggacatcgaaaaagccttcctccaattatcagtgagagaggaggacagagacgcgaccagatttctgtggctggaggatccacaaaagacagaaatttcaagcccaacatatgtgagaaccgttgtgtttcggttctgtcaggtctcatttggattgacaacttcaccatttcttttaa

SEQ ID NO: 27561 - DNA, 1267 bp, Heterodera glycines
  misc_feature (25)..(25): n is a, c, g, or t
  misc_feature (63)..(64): n is a, c, g, or t
  misc_feature (84)..(84): n is a, c, g, or t
  misc_feature (1187)..(1187): n is a, c, g, or t
  misc_feature (1226)..(1226): n is a, c, g, or t
ggggggagggggaataaataaaatnaaatatattttatttaaaaatggaaaaagggacatggnnttaatgaagggggatgggtnatgtgatggaggggaagagagagtgttcacattgaagagagacggatagaaagaaaacgaaagagataggagagagaacaagaaaagagagagagagataaaagaaatagtgaaagaaaataggatgggcgagagggaaaataaggaaagaaattatgaacaaatgagataagggaaaataaaagaaatcagagcatttaaaagagtgaggggatagaaagaaagagagagagagggagagagaagagagagagaggaaagagagagagaacataaaagagagaaagaggaaagagagggagagagagcacagaaaagagagagagtggagggagagagagagagggaagaggagagagagaatataaaagagagaaagaggaaagagagaggaaagagagggagagagagagagggaagagagagagaatataaaagagagaaagaggaaagagagaggggggagagggagagagagaagagaaagagaacagaggaaagggcggggttagccagccaaaaagcgattaaattcactatttgaaaaatatagcttttattatgtatgtaaatcctttttgtgcataatctaaaaattgaaacttttctttttacaaaaattataatctaaaaaatttttgactaaatcataattaaataaaacgaacgaaaagtaaaaagagaggaaaaagaagcattcatttggggcaattagctgctgaaatgggcgaaatatgtgcaaacagtgaataggaaaattatattcaatttgaaaaagtgaatttgaattaatttcaacaaacataaaattatcgttaattaatttaaagaattaaaattaatttttatttcgataaaccaatagaattaaattaaaacaataatatttttttcaaattattatttttatctaatcaaaatttataatttaataaaacaaataaaaacgaaataaatattttttaatagttgcaaaattaaagtttactaataataataatatcaaattaattaacaatatttggttttccatataataatttattaatttatttaatataaaataaaataaataacctccaaaaaatcaaaaacaaaattanaataaattttaattatgtagctaaattaactaattttanatatttaaaaaaaaaatttttttattatttttattatatca

SEQ ID NO: 27562 - DNA, 1515 bp, Heterodera glycines
  misc_feature (217)..(217): n is a, c, g, or t
  misc_feature (327)..(327): n is a, c, g, or t
ttttaaaaaaacctgaaaatttttttaaaaatttttaaatttatttttttttttttaattttgggaggggatttttcccttcccaaaaatttgttaaaaaatcccaaaattttcaattttttgattggctgcataaatatgaaaatcggatttttttattttcgacattgttcaagtcagggttcggggtcggacatagctttccctaatcatcaantatgtaaattaaaaaataattttctttcagtggtggagcattgcattgataaaatcatggcgttcaattcggggctccccattgacaacatttactacagaacacaggcncaaccatgtgctggtcaacgaatatttgcctggacaaggcattatggcgagttattgttgccaaaaatataaatgtattaatataatttttcaattatttttaaaattaaattagtaaaaaaaaattttccattatttttaatattaattaattttattattattattttcagcctcacacggatggaccagcattttacccactgatctccacaatttcacttggctctcacacagttttggacttttacgaccaagtcagtcatgtctagggctccaatttttagccaaaagcctatttttttcctgagctccccgtggcctgaaacgcacgaaaaacatttttttgggctgttgttaagctacttttcgagttattagtgcctattttctagccttttatttttagcgcctaaaaagcctaaaaaattttgaaagagcctatttttgcctattttggcgttttgccgaaaatttgttaacaaaaatgcaataaaaacaaaaaaacacccctaagaatagacctgaaaattttataaatacacccttaagtaattaaaattttatcaaaaattccatctccaaaataatttatttattttcttgacaagaatttttgattttaaaaattatttagctcaatactgttttccctaattttttgctaaattttttaattttacacccaaaaaatttgagactttttagggcctattattcgaaaccttttacagattggaaagacacttttatctttttagaatagctttagtccctttaagactgttttcgagcgttattaaacagtcggacgattcagtccctgttgaaaatggacacttcagtatgcgattgtttacagcaaaatggcaagcgcgcgcctaatttgcatttttctcaccgttttgggccatttttttacaaatgttttgaattttttgatgcaaaatattttaatacaatcatacaataatcttcatttttaaaaattttcttgaaaacatttagctgaaataatttcaataaaaataaaattaaaccatcaccgtaatggctgacaataacgtaagcactgataaaaaaataacaattaaattttatattatttttgggaaattaaattttatttgacagtcataattcagagatttttttatatttttgtagttttatttggccttcaaagat

SEQ ID NO: 27563 - DNA, 1179 bp, Heterodera glycines
  misc_feature (1159)..(1159): n is a, c, g, or t
aaaaaatagcaattttaggggattttagttttgaaaatcatcaatttaaaaagaaaaattttcattgacgcctttgagatcagcaaatgatgatacgaatcaaactacctatcatttcttctctactcaaaattatacaaaaagttgatctcacaaaaatcaaagatttacgcattttgattaacaataataatagcgttttgatcaaatccatatgaatgacgacaacaagattagcaaccacaataaacacatattttgtttgtagggtcgtaaattatatggattaacatattttttctgctcaaatgataggttctttcaaaattttttaggcgctaaaaataaaagccgagaaaataggcactaataactcgaaaagtagcttaacaacatccccaaaaaaacatgtttttcgtacgtttcaggccacggggagttcaggaaaaaataggcttttgcctaaaaatattagccctaattattagtacaaaatttgagatgtatttggtttgcaattgtgaagctagaatttgataagatttggcattttaaaatccatttttagctgtttttagtgttttttattttaaaactttaaatccatttttagcagttttagtgtattttttaagtctgctttagtaaagattgaatttataaatacacatccactttttggaacttttgagagtttaaaacttataatttgtagtttttagtccatatttggcccatttttgagctttttagtccatatttcgggcttttttaatccatggcatttttggtccatataatttacacgcctattttatgcttcgaaagctatggtgatagcgcaaaatcacatttgcttgattgccgtacgcccgtagaagctggcggacgcgtacggctgcgactgatttgccgactggccccatatggcgtttccaagccgacgcaacacgctgggatagagaacgctgttgtcgtttccacgccgacaatcgcctgcagggggaaatattttattgaggaaaaattaagggggcctaaaccttcaaaatttaaaaagaatttctcataataaattttattattttttaacaactcagaaatccaaatttttcagcaaaaagtaaattttttttaagttttttaagcgaaacactanaacatttgtaattttttaaa

SEQ ID NO: 27564 - DNA, 925 bp, Heterodera glycines
cagatttcttcctccagcggtcaacatgttggtctcctgcctgacgcttgttttggtcagtcaatttttaattttgatcatttctgatcacttttcttgcttgtatttgtgaccgaagtgtgccccctgctctgatcacttttccattacgttaaatgatccgaaagactgatcgaagttcaaagcaaaaaaaacaaaaaacaaatttcatttcaccattcatctctctttattaacttctgctgatcaccgtgatcactgctttgatcaaaatttcttgttcagatcgcaatggatcgcttcttgttaacactgttccccgtcaaatggtcagttggccaaggccaaaaattaaaaaaaaaataataattaattactagagctcgacatggacatggatccaggagttgttttttcctggatccaggtccaggtctaggacgttttctgcaacctggattttgctggacctggatttttgtccgggtccaggaaatccaggtccaggtcaaatatgaaaaaaaaccaggtcctgatccaggttaacacaaaaacctggatttccttgacaaaatttttgaacaaattttcaaaaaatgattaaatggatttaaacacattattatagtaaattatagatttttatatgttcctcagcactagaaaaagttttttttcaaaatgtagagctttaaaaattttaatttctctaaaatttcaaggcgtatggcagccaaagcaccgctgttctgctacctgttcgcctggttttgtgccattattgttgcagcaccgtacggtgccgccgtgtccgttgaagatgccaccattttggacccgtaagaggccatttaaaatttaaaaaaatttggcataatgcttccccaatttttttccagctggaacacaccacacgtggagcatc

SEQ ID NO: 27565 - DNA, 1690 bp, Heterodera glycines
ttgtataggcatctgatcagttaagaaatcatcagagtgatcagtttgtataggcatctgatcagttaagaaatcatcagagttatcagtttgtataggcatctgatcagttaagaaatcatcagagtgatcagtttgtataggcatctgatcagttaagaaatcatcagagtgatcagtttgtataggcatctgatcagttaagaaatcatcagagtgatcagtttgtataggcatctgatcagttaagaaatcatcagagttatcagtttgtataggcatctgatcagttgagataatcagagtgatcagttctgtataggcatctgatcagttaagaaatcatcagagtgatcagtttgtataggcatctgatcagttaagaaatcatcagagttatcagtttgtataggcatctgatcagttgagataatcagagtgatcagtttgtaaaggcatctgatcagttaagagaccatcaaagtgatcagtttgtataggcatctgatcagttgagataatcagagtgatcagtttgtaaaggcatctgatcagttaagagaccatcagagttatcagtttgtataggcatctgatcagttgagataatcagagtgatcagtttgtaaaggcatctgatcagttaagagaccatcaaagtgatcagtttgtataggcatctgatcagttgagataatcagagtgattctctatgatcctgtcttgatcaaacattgtcaatggaagtgatcagtagggtaagatcagttaacagaaatcagcggaatgatcacctttgtcgatctcatcctcacgaaatcacttttcgaatctgacaaactctgtgtcctttgtttcaggcgaatgtgcagtggcggcacggcgtcgacgtcagcgaatcggaagtgcgtgcgctgtgcatgctcagccgcgacttgctgttgtcgcagccgacgatgttggaattgagtgcgccactcaaaattgtcggcgatatccacggccaattctcagtcagtccttttgatcgccatccgatcagtcccattttttcctcccaaaattacttggacaattctcagtcagtccatttgttcgttgtccaatcagtcccatttggtattctctcactttgtcagtcgatcaccgtccgatcactcccactttttcaaccaaccaaattcactccttacttaaaaaaggatttgcttcggctgttccacgcctgcggcttcccgcccaagtccaattatttgtttctcggcgattacgtggacaggggcccccgcagtttggaggtcatctgttctccaattggccataattagctattccaccgcttttgcagacgatcattctgttgttgtgctacaaaatcaaataccccgtcaatttctttcttctccgcggaaatcacgaagtcgcctcgctgaatcggatttacgggttttacaacgaatgtgagcccattttggcattttgttgacattcagtgaccatggcaattccaggcaaaaccaggatgaacattcgggtgtggaaggtcggcaccggttgtcttgatctttgtccattttggcatttttaggcttttcaagacgttttcaattgtctgccggttgccgcactaatcaacggcaaaatcttttgctgccatggcggcctttcgccacatttaaggacattggag

SEQ ID NO: 27566 - DNA, 729 bp, Heterodera glycines
tggtcccacaaaaaaaaaggaataaaaattcaaaaaacactttttaggggttatttgatgcgctgagcacgaatttgaccttcttttgacttaatttcgaaccccgaacccggattctaacatttgaaaaaattcaattttttgcaaatattgctgatgcattgcttggtactgtaactacaagatgagtaaaggaaatcgaattcttcctatttacatacgtatgatcaataactttgaataacaaacggatcgcgtcagttggatgaagtcgtaaacaaaagcatgaaatcaggcaaactattgaagaacataataggcggtcaataataatgaccagatcaaaagagacaatgagaacattttcaactaaccttaatactagcttattaacaatttagccatggatatctttgatatttgttcacaatttcaaaccaatgagcatacaacttttacgacaaattgcccctatctgtggctattatttatcacattgccttttattaccccgtgaataactgaattgattcgatttcctttactcatattgtagttacagtaccaagcaatgcatcagcaatatttgcaaaaaattgaattttttcaaatgttagaatccgggttcggggttcgaaattaagtcaaaagaaggtcaaattcgtgctcagcgcatcaaataacccctaaaaagtgttttttgaatttttattccttttttttgtggga

SEQ ID NO: 27567 - DNA, 1313 bp, Heterodera glycines
  misc_feature (157)..(157): n is a, c, g, or t
ccaaattacattccaataacaaataattaccatcactaaaatttaaaaaatcactcacaaatcctttctcattattcccacacaatttcacctttcatcttcaccatcactattatcattctccacactattcttctttttatctatatttattaanttttaaataatataaaaacatttaaataaaatcttaactgttttttacgcaaattgcacttgcaattaccacagcaaagaacaacgaaattgcaaaattcatttagctgttatataataacaattataagactttctaaatcataagaaaatcacttgataaaataaactttggaaccaatattctttgggattatattataaattcctggctatagaatttattttcagtggctttgagaactggaaataaagcattggcaagatgggaaaataaaaattttattttaagtaatatgacggaattgaaaattatacaaacaaaaaaaaaattatgcgtaaattaattgagtaatgacagcgttttatgcatattgttctacttaatgatgtgaagaaatcctacacattgacgtaatgttactagagatgagatactgttagaataatagcaaaaaatatataataataataataatgtggtaaatttttgatttttttaaaaatttattattatcggaaaaaattatttttttattttattcctctttttatatttatttgttttctttttaaacctttttttcgaatttaaaactcatacaaacacggttttcaagaatcccacccttgtaagatacgggaactaggcaatcaatatacataaggtattatggccaagatcgggtaaagattgaaatttttaatcttgaaaataatattggcctaatgcacaagacattatattaatcgaacagttttcaaaattccataattttctaaatattaaaattttaatttacaaaatatatgaaaataatgtcgtacacagtgccacccgaagaaagacaaaattttttgaaaaaagctaaagttaaaaaacctattaatgacagtccgaagtgattttgaattttaattataatttaaataagaaatgacaacaatttggcatcggccaagattcacaaaaattataaatattcgagacaaaatgaattttttgcaattatcgttttcatctgattcattccgctgtgttcatttctcaaaactgatgatatggtgtatcaggaaaagttgttgccagtgagtcggttaatgccatgctggaatagcactaaaaagggaaaataaatttaaatgatgcatttggc

SEQ ID NO: 27568 - DNA, 1868 bp, Heterodera glycines
  misc_feature (170)..(170): n is a, c, g, or t
  misc_feature (1861)..(1862): n is a, c, g, or t
tttttatgtttcatctaataggctactaattcatgatttttaatattcaaaaatgctcccgattaatgatttcgggtctctaattgtaagttgtaaaattattaaatttgttaacatgtgctcccaatttttcataatttttgccatttcagccgcccgattggctgagngtggacgagttgaaacggatgattgttgcggaggcggaacagagagcatttgcgcccattccggagtgctttttcgagctgtccaacctgttgatgctcaacgcgcgggaggatgtcgagcagtatgagcaggttttttttaagtgtccgctttttcaatgaaataggttaaaaatgccaataaacatttagggtataattgccaccgtggcgtagtggtgtacaaccccatctctctgtcggcagttcaaataccattggagggcgccaaaaactagaaacaaaacaaaaaaacattttctctaacagaagagactccattcactagtcagcagacactgtgtgttaaaaggtgtcgctcacgccgagtggccccttttatgcatttgtgcaatgtttgtgttacgtggatggaaaagcgaaccccgcgaaagggggacgaaacgcgagagtttgtgccggacacaaaattaaatgtttggtgcattagtgctgtctcgaacaatccgtaaaaaactttttgtttgaaaaattcatcgtattcctctacccctcctacagaaattttcaaacccatccaatcgaatttttttgtatgcattttccccaagggtttaatggagacataaaataggacactttgaatccgaacttaaacatttttcgttgccaaatttacattttcaaacaaatttgaattaattttttccattttagttgaaaacacttgtcaaggacttgtgggacaaacgggaggccaaaatgcgcacgtcaaccatcaaatttcttggccaggcaagtcttgtgaaaaaatttctaaaattgcttttaaattccaagtttttgccccaatttttggggttggacattttaaagggggtcgaatttggtgcaatttgtggggccgtttcttaccatgtaaatcatggacatgaataaacggggcatttttcagtacgaaattggacatgcccaactggacaatttgacgcgcatggaaatttgttgtgcccgtgccacgctcatcgagggcagcaaacagcttgaccggctgaccgccacgctgcattccgtccgggactgaattttctggacggggaattttaaatttttttttcgaaatttgtacgccacacagccttttgaccggataggactccaatttttgaatcgaaaatctgaacccctgtcgttatcctgaaaaaaccaagcaacaaatccccatcctcggatatacatacatcaattctccttgcatttttgctcgaatttcctatttttagacacggaacccccaattttaaaatgaacagaattccattttcgaataaacgatgatcaaatgtccccatttttattggacttgtataagaatttaacagccaaaaattgaccaatccgcgtccgatcaaatcaaattccatccaattttcatttggtcagtaactctttttaatgtcctcctttttcttggtgcaaatatcatccggtcttctgtcagcttttccattcatctgatttgtttttttatttatttttggatttatttgcatgcattttgtttaaattattattttttgttgtgtcattatatttccatgttgtttaattgatttgtctttaaagtgccaattctttaatagctttcgtcctatttgtcgcgtttacacttttttttttggacctgcagnngcatgc

SEQ ID NO: 27569 - DNA, 897 bp, Heterodera glycines
atgccatcggtcgtcagttgatcactgactttcatccaggtccctctgccggtccattcaaatttcgtccattttgtctctcatttcctttagctgtcaaaaacgtcgcttctgccagtcaaaatttgctccgttccttccaaagtgtgtttaattttccccgataattttgtctgtcaaaaaaaggcctaagtcatcacttttacgaatacaccgccgctttatacgctttgggcttttcgggcataaattcggatgagttcgaagtgagggaacagtcgaaaactctgcagacggtgaccgaagtgctgaagaaagtccattcggaacagatcgattgggttggtaacagtgaagggaaagcaaaaacaaagcccaaaagatggattacttcacggcgatggcactgacaatcaatcaaaacagcaaaacggagaaggaacggctgaaagcattgattagcggcttttccgagagagagaggcaattgagcaaagcaatccatcgaggcaagcaaatgccggacacgcggagtaacttttacgagacggagttggaggcgatgcgggaccaacaagtcaattggggggggaggaggagggggagagggggactgggccgaacataattacgaacgacaaatcggatgacaaatttggcatttgtcaccaatttaccaagtcgtttgtcacttgcctatgtcgatttgtcttttgtctctgtcgttcgaattgtcagtccaattagaattgacaaaatctaccctaattcgtcgtttaataaattttctttgataaaacaaaattttagaaatgcaaagatttaaaaaaatggtaaaagagtttctttgggtttttgaatcgttgattccgaaactaacgtttatttgctctaatt

SEQ ID NO: 27570 - DNA, 1005 bp, Heterodera glycines
aggggaggaggaaagtcggtcagtggaaggcaatggcggtcgagggattggtcatgggcatgggcggatggacgcatggactgcgcaaaggacggggacagacgaatttggggccgaatcggcgacttttgctgtttgtgctgctgctcttctcctgtcttcttctgtgccaatttgtcggtcccttttcgttgctgttgtttctgtgcctgctccatctcctcgtcgtccattccatcgaatggatttttgggcgctgtgtcaccttccgaaattccattgttaaccccctgcgtttgagcggaagtcagtagccgaacgtcgtcaactccgacgatgtcttccgctgaaaataccaatagggcgaatgcctttcttccgtcccttggccatcccttccgtttctccattcacctgacaaaaggtttcgcgccctcagcaccacgcggaatgccttttgcgcctttggcaattccaccgcccgccgcacccatcgcttctgtcccggcccctgaatggtgtcaacacaacgcagtggctcgagctcgtcctcctccacgcaaatgtccaaagacggagatgcgctggccttccaataggacaaagtgagttcgcacggctcctccaaacggtcgacgaccagcggagaccgaagggaaccctccgtcggactgtcgaaatggccttgggcataagcgaagcgattcacaactgcacattaattgacaaatcaattaactttgaacacagctaaatttataagtgcgccatcgtttagcaccaattaaacccaattagcctaattagcagaattatgccaaataatcagcagcagtacgctgcctttccgacctcctcccgccgaatggaccaatgaattggccgcgtccacaatcactgcatcgccattgtgccaaaggagggcgctttgtccgtttttgggacgccaagcacaaaagcctttggcattggatgggcccggctcaaaagaacagtcaaaggacg

SEQ ID NO: 27571 - DNA, 1068 bp, Heterodera glycines
ctattttggcgttttgtcactattttgtcactatttcgacattttttggaaaattctttaacaaaaatgcaataaaaccaaaaaatacacccctaagaatcgaccaaaaaattttttcaaaaaatacacccctaagaatcgaccaaaaaattttttcaaaaaatacacccctaagaatcgacctaaaaaattttcaaaaaaatacacccctaagaatcgacctaaaaaattttcaaaaaaatacacccctaagaatcgagctaaaaaattttcaaaaaaatacacccctaagaatcgagctaaaatttttcaaatatactcctatgaaatgaaaaaattttctcaaatatttactttcttggcaaaaatttttaattttaaaaacttttttaggtaactattttggttttttgctcttaaaaatcccagtcctactcattttgcaactgcaatcagtgaataaaaattatttttgctcaatttttggctgaaaattatgtcactattcgtcactatttcggactttttgtcactatttcttcactattttggcatttttactcactattttagttaactatttctggatttttcgtcactaaaagtcgcgaccctactgatgatggtcaaaaaagtgaaaaaaagtttttaaaatgtatttaaaaaatgtatagaaaattatcaaaaactaaaagttcaacaattttccattttatttttcaaggcggggatgaaaaactgctccaagttactttacagtatggaatttaattttgacaaaaaagattttctacaaaaattgggtataatttctagcaacaaaaaagaaatttaacatataaaaaaggtaaaaagaattcgaaaaaatatatttacttaatttttgttaaaaataacaattcacattttatgaaattatcattcaagaaagttatcacaaaacagaaaaaaagcaacgatttttttttcaaatgaaaatgcgcttcagaaatttttccatggaaaaatattgtaaatgccacgcggcattgcaaacaaacaaaaaaaaaaaatttctccgtctgtctc

SEQ ID NO: 27572 - DNA, 1633 bp, Heterodera glycines
  misc_feature (15)..(15): n is a, c, g, or t
cttttgttgtccttncactcggaatttaattggaattctttcaaagcattcgaattcggagtccattgagttcccaattttggcaaattcgtagtcatgtgcttgcaattcgatgcatggccacactttaatcaattcaggcccggccacttttgccaccagtttaccagattggaataattttctggcaaaagttgttggatctgagagaagtgccgtcgctgcccatcttctcgtctccaacatataatcacaaatcgatttaattgtctgagaaaaggaaagagtcagcatttctcttacttgttcatccaaatagcccaatttggagttcatttccgattcggtgacccaactttcaagtgatctcgtctttctgcttctctttgaggattcgttgctatcgtcggaaggcaagtcttgtacagcaaatccttcctccgattttatcagattcagaccacatgagttgactttctttgtgttgttcaaaaatgtcaaacgaaaactgacctcatccgaaatccaaatattgtcaagttgtagtcctttccatgtgccgattttcgaaaattcacaggcacgggtagtgttggtgtcccacatgagcaatgtcttgtcttccatctcacattggcctgccttgaattcgcaattgttcactaacccgaggggactttgcataactgtgctaccgtgttgtgacataattttagtcttaaaaagataacaattttcagttgagacagtcgaccagctaaatgagccaattagccacattcggggtgaaaaatccaatttcttgtcagtatgcgagagtcccgagtcattaattagcaagcctaagctgcactttccattttcggccatttgcttacattcactcggagtcatttgcaacataagtggttcaagagtctcttggatcggaacattagtgattgaagtgtacttacgcacggattttctcacttttcggcaagcccaagcatctgccgagtgctcaaataaatttggcgaaaagacatcgaaagttcgaacaacaggtgcttttgaatgatcaattgacagctttgaacagccagtaactgccggcaattgccaaatttttcctccgttttgggtttgacagacaaggggatgcattggcagatggggcatattagcagtagtaaagggtaaaatcattccaacaagcattaatgtaatgaacattaaagaagcgactttcgatcgtacgcttggccgttcccaatttgacgttttgggaatgtttgtctttgtttccggcccacaggctggggattcactagaggatccttttgctaattcattttcgacctgacaatccattgctgttgttttgggtttgatgtgtgtgagcgcattcattgccccagatcttggttcctcatttttgtaattgcgattgtcctgaattttgaggtcaagtaacgactgggccaagttctcgaaaaatcctggtgaagtgttgaaagagtttggcacatccatcatgttaacaggattctgccgattttgccattgtccctgagattgacgaggttgctgatttgaccattttccttgacggaacgattggttggaatttcctctgaaattggcacggcgt

SEQ ID NO: 27573 - DNA, 801 bp, Heterodera glycines
aagcaattgttttgttttcacttaatttcttaggagtgtattttttttaatttttgggacgattttaggagggtaatttttctgaaattttttaagtagattcttaggggtgtattttttggttttattgcataatacaaaataaatatgtaaaatgctaaataaatcgttaaaatctagtaaattttaagaacccttgtgcttaaaaatttatgttttcttaaaaaagggtaaataattaaaataaataggggagcaaaatagaatttagtgctaatttggattttggtgatgaatggatttggcatctttcatttgtgcttttatatgccatgatttccctgcccatctctgctgttcccattttggttctcttctctcagattaattgccattgattaatctgtccattgattttccttgggttaatttgagtggcttaatgccctcctctgccagtgaatgggaacggacggcattttctttgctcgcacaagggcactttgggaaaagcaacctaatcctcaaccaaaaaatgaaaagcaaaatgaattgatttgatttatgcttttctgaggccgaaagtgatcatttaaaagtgaatttttgtaaaaattaagcatatgtctaaataaaaaaaccggagaaactaattagcaactccttaaaataagaatcaactaaagcttataaaatcttttgagaaattattttttcatattataaaattggtaattttacatacaataaagaaggttgacgcaaattccgagtgaaaaatgcaaaaaaaaaaattgttcg

SEQ ID NO: 27574 - DNA, 725 bp, Heterodera glycines
aaaaatttttttaaaaaattttccttatttttctggtaatatatttttgttttcggtgggcgctttggacagaaggattaatccccacccttcccttctgccaggtaaaccacaatttgtggcttggcaaaaagttaggttgccttaatacaccaacccaccactcctacccccgcgcaccccgaacggttccccgaaaggaaggattttaataaaattttttcttcggggaatttttttccattagttgttcgttaacctttgattactttaattcatttaaaaaattttatggagatatatgtgttgttctgtaaagcgggggggggggggggcgggggccgaaggccccccacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataaactgatcagaagcgcaccagattttgcaagggcatcaaaaagacaaggaaaagcaccgctatgatgctaacaccagtaactcttaatttaaaaatttttattaatt

SEQ ID NO: 27575 - DNA, 1208 bp, Heterodera glycines
accattcgcagcaacgacaacgacgacaaacgcaacatctttccctccttcctctcccattcactcatcacaatcaattttgctgttcatcctcacatttttcatctttttggtgttcatcgcgcaggtagcccacacccctcaatcaatttgaacctaaccccttcccctctttaggctgttcaaattggagcacttttgcgacgcattctcaaaaatcgtgtcttccagcgcaaattgcagcagcgtcagaagagtgagttttttttttttttaaattgaaccaaccaaatattaagaaatcaaaactcttcgcaaccaagtgggtcgccaaacgatgccaatggtggtgaattttggccgggtgggtaaaaactttttatttttattttactattttaaattttcaaagtatttcagactggggacgcgcaaaggactggacaagtcgggggccgccgatcgatgccaccctctgttgtgccggcgaatttgggcggcgtgccgccataccaggtacaaacacaacaaatccatttgcttccctttcttataccatttttttttaaaaaggagccgcaaacgcagcgcgaggtgatttacgatgtgccggcggatggtgtgccggaagacgacgatgacgacgacagtttttgaacgatgagccgatacaacaatgagctttaattcctcataaatttttataaaatttgggaattttcatttcacatttaacaaattttggctaataaatgtaattcaaaaatgattaattggcaatttataggagaccactaaataggagaaatttcaaatgttttactgttgggtattcagatcgttaggcgagattaatgctctttacgcaaaattttaaattttaagcatttgatataatctttttgaatgattaatgtgtgatatagtggagaaaatctgtcggtacatcaaatgagcaatttgtttaaaaatgggtcacatccattatcgggaattcgggatgctttggtgcataataaagctgcctcccatttggagaaaaataaagatgttttgcaaggtcaaaagcgcaccatttaaattcatccctcccgtctcgctctctcatttgctcaatattttcacatttatttatcctctacattttgctatatcctaatcatatcatttaagtacaccaaatttacttcaaattaaaaaaaaatgtc

SEQ ID NO: 27576 - DNA, 1005 bp, Heterodera glycines
tacagtgcgtagcacaggttgccttttctcatccggccaaacgaagcattagtagggtgttggacaccgacagaaaaatcgtaacgtgcccaaaaatagctatctcttttttgtatccaaattgcgcattaggtatttcatacagtgcgtagcacaggttgccttttcttatccggccaaacgaagcattagtagggtgttggacaccgacagaaaaatcgtaacgtgcccaaaaatggctatctcttttttgtatccaaattgcgcattaggtatttcatacagtgcgtagcacaggttgccttttcttatccggccaaacgaagcattagtagggtgttggacaccgacagaaaaatcgtaacgtgcccaaaaatagctatctcttttttgtatccaaattgcgcattaggtatttcatacagtgcgtagcacaggttgccttttcttatccggccaaacgaagcattagtagggtgttggacaccgacagaaaaatcgtaacgtgcccaaaaatggctatctcttttttgtatccaaattgcgcattaggtatttcatacagtgcgtagcacaggttgccttttcttatccggccaaacgaagcattagtagggtgttggacaccgacagaaaaatcgtaacgtgcccaaaaatagctatctcttttttgtatccaaattgcgcattaggtatttcatacagtgcgtagcacaggttgccttttcttatccggccaaacgaagcattagtagggtgttggacacagacagaaaaatcgtaacgtgcccaaaaatggctatctcttttttgtatccaaattgcgcattaagtatttcatacagtgcgtagcacaggttgccttttcttatccggccaaacgaagcattagtagggtgttggacaccgacagaaaaatcgtaacgtgcccaaaatagctatctcttttttgtatccaaattgcgcattaagtatttcatacaggcgtagcacaggttgcctttt

SEQ ID NO: 27577 - DNA, 1465 bp, Heterodera glycines
  misc_feature (1460)..(1460): n is a, c, g, or t
tgttcgaattcgggttaggggttcggaataggtctaaatggatgtcatattcgtgatcagcgccctcgaaaacccccgagtactactcagaatcgcataaaatcctttattctttcttttttttagggaccaataaagtacatgattaccctatttcgtcctttctctttttctttataatttctcttattttgtcgtactaccaatcatcataagcagggatgggattcttaggtttttactttgtgttaaaaaatgcaaaaatatgtgctaaaaattggaaaaaccaatggtatttttgcataaaaattccaaaaaactcattctttatcatttttgcccgcacaattgcaaataaaaaacatttggaggtgtttgggggtaaaattagtccttttttgataaattgtttttaaagataatttttccatcagttgagtaagtgccagcaagaaacttcgatatccagtaacgaattaatgaagaattcgattttcggtacacgaaataaataaagaaaattttgaaagagcctataaaaatggcaagaaagttgatttttaggggtgcatttttgaattttttgtgtttttttttcttagatatttttttcaaaaatgccaaaatatgtgcaaaatatgtgccaaaccccgaaatatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctatttattatacatatttagttttggtgaatttaaattcggacagatttacgaaaaagactttttaccattttcaaggccatcgttggaaaggtaaaagcccaaccatttctcattgctttcgtttttcgtttcgatttgtgccattattttccatggaaatctcccaatgtccatggcatcgctaaatcggccacttcccacctcctccaccgcaaattcggacactttttcaatttccatctcaattgtgccttcgtttttgtagcgttgatgggtgggaaatttcaatttgataagcccagtggcatcacttaactttggatgggaataatgctgatacacgctgttcacttcttcaattgttaacacaccagttggaactgaaatttgattgaaatggataattaattagacaattaattcattcataaaatgagtcatcaattaagtttgccttgacctggggcattgtaatattaaaaaaacgacatacggtcttttaaattttaagtctatggaattaggttattagaattataattagtgcaaaataaaaatttgattccgattcgataagaaataaaggcaatcttatagtgaaaagaattgcagattttttttcgtatatttctttcaanaaata

SEQ ID NO: 27578 - DNA, 1712 bp, Heterodera glycines
ggcgatgataaaaaatatttaatttcaaaaaaaaaattttctgctttttgagagaaattatttttaatgtttacaattacccataaacaattttatacaatatatttgttcgaataaccctatcttttgggtatcattcgaaagcacaaagtctaaagcagctaagctatataaaatctcagcgtttaggcaattgccaaaatattataattaagtaattgttggaaattttcgtttgtaactttctttaagtgttagcattttctcgttttctcaaattattaatttgtactttgtgtttcgaaaaataccaaaaaatagggtttattcgaacatgaagaaatgttgcgtaaaaaaaccatgaattgttaattgagtggactcataaagaagtgcattagaaccattcctagaataggaacgataccaagaatgttagattgggtttttaagaatgtttaggattttttaaaattttatttccctttgccggatttaggaaaagttgcggaattgaagaaacgaccaagcacaacttatccatttttaagaggaatggaacgccaaatttcatcgaattctcgggcgttttcttttaaaattttaagcattttttgtgtcgatattttcgcttttacactgtcaaacaattaggtaattcactctgtgctttacggtaattaccgtcgctcggtatcgtatcttttcgcctccgttttgctggtgttcctcaaaagtagtaccgtttgaatttgggcagttgttgttgctggaagaagctgtcatggggttgttttgtttgtgctgaaattcagcaaacctttcaaaaatggcatcaaaattaaacaaaatattctccggttctttcttggcgaaacagaacgccaaaaacgggagcataaaaaggccaacaaaaaaagggaaacacatttattttattactgtcgtagaataaaaaggaaaagattattactaattacacctaaaaaacagtgaaaagtaattatggcatttttttcaacagtttaattttaatgagaaatgaacgaaagacaacatttttagccggaaatagattgttttgacgtttttaacgttaatatccataaattaaaaatatttttttaatttcataaataaaatatttacgaatatgtttttttaactttttcattattttgagaatatttcggcaattttaacaaaaatacaataaaaacataaatttaacgaaaactatttcccaaatcgcacccaattgtccccttttacaaatatggcctttggggttttttcgtaaatatttatttaaatgtttcggaatttttcataaatatttataaatctcagcttcagtgataagcaaataaaaattgccgaataaattaatttaagaataattacaactgaataattcatttttatttttgcgaaaaataatattcattttaatatgccataaaatcaatttttatattgattgcttttttatattatataaaaaaagttatctacgagaatgaagcgtgcaaaccaattacatattcgctgaaaaataaggctaatatataaggattcctttttatgtaagaaaaaaagcaaatatgtaaataaaaaatgtaaaaactatgtatgaattatgtacaaaaacccaggaatatgtacgaaacaaaatttttaaaatggttattttttggaaaaaattattcata

SEQ ID NO: 27579 - DNA, 1858 bp, Heterodera glycines
  misc_feature (7)..(7): n is a, c, g, or t
atactantcggcattaatgtttattttaaaaaatgggcccctcctttatgcgaaatcatcagaaagtcacgctattataaccctttgtgaccaaaaaagccaattgcaccaatgtgatcaatcagatcactcctacaaggcaatctgaattttgagtttaaattctgaaacaaagcataccgtatttccttaagtacaccccccccccattttttgacgggctgaaaaatacggtacacatatgataaaaaaaaacatcaaaaaatgtgctaatgacgaaaaaaaagcaaattccgtttttttgccaaaatcaacaaattaaaaacaaagacccatgaactctattttaggaaatacgaaaaaacaacaaaatttgtgctaaaacccaaaaaaggccaaaatatatcctaaaaatcaaaagtttcggggtttttccccaaaaacaacaaattttcatattttgtacaattttctaaattaaattccataaactgttaatgtgctaatccttcccaaaaaagctttgctaaaaaaataagattttttaaaaacaggtgtacatccatccgttctacaacggcaacgggaggactgctcggctgctgatgaacttcgttctgatgcgccgcggcttccaaccgatcatcctgcccgaggagaagcgcgatgagtactacgagtgcctggtggcggcatcgtcggaggcgaagaacataacaccgttcatcaacttcgtcagcttccatcagcagtgtgctcaagaccgtgcgcccgcccccatctcttcccttccatcctcctcctaattattttgtatgtaaatattttgtatatgttatgtaactaaattgtccacctatgtaaccattttatgtaattcaccattgtatgtaaactgtatcaattgtatgtatatgtaatttctgtgtatgtaaatattttgtttcaataaaatgtgttaaagcgaatatttctgttgtgtattttgctttccaaagtttatttagctgattgaccgggccccgggcggagacaaagggctaaaagttcatggcaatttgaatgaattaaacaaagcaaatgttatattattcatatgcaatttatgtcataacattaataaaagatgagattaatagttcagatggtatgactctttttttgaatgtcgaacaaaagtcaaaaattcattttgccaaaaattccaaaaaaatcaataatgcgtcttattgtacgttcgctttaatttttaacagtagtttggcaaaaaaaaactgaaatatacggtatataattcattttggcgccatctttttggcgatcgcaaaaatgtgttttctaatttttggctgcatgcgaattccgttaaaacccataggaacaagtttacaaaaagaagtcgtaccatctgaactattagcaaaattaaatggaccggtctgctgaaccgccgccgtctccccaacagggcgatcggtaaaccaaatcatcttcaatatcagcttttcattggtccaattcgttcaccaatccaaatggcacaattgcggggcacatcaactgacggtcggattggaacggattcaacgtttgagtgcccttgcccaaatgcatcagtctgggtgatccggagcagcatcatcgtgttctgtgtgttggatgtgcatttgtgcaaaataatgttttttttaaaaaacaagagaaattcaggggaaaattaattgctgacacttttatgatgtagagtattgtcgatttactattgccaattttcggctttttttgttccggtgccaaaagtgatcagaaaaaatcgaacaaagttgctaggtggaatgatacttagaagaaaatcaaa

SEQ ID NO: 27580 - DNA, 1756 bp, Heterodera glycines
ttttttgataaattttatacacatacaaatgctctcgagcatgatagggagggcggtgcgcgatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaatttcatacacatgcaaatgctggggtgagaagctagggatgggccgtaggtttcgcttttcgcatttcgctttttatttttcaatttggcccatccctggtgagaagtgtgtgtttccgccagtgttctgttttccccttttcgctttccacgtttccctttaagccctccccatttgaaatggctcccggataatccttcaaatgccaattctaacaaataagtgatgagttttttaaaataattactttaatttataaattgaaacttttttggacgatcactgtataaataataattttactaaaggattcctcaaacccttttggaaacgtttcaaatcttcaattatccactaacaaataaatcaaaaagtgaaattattcgttttttacatttattattatttatcataaaatcatttatcgaataaaatttgcttttatttgattagagggaaataattttcgttaaaaaacagagaaaggtacaactataagcaaaatttttatgaacggggaaatgattttgtcctcataaacgtacaattaacacataaaaaatctttcaaaatgccattaaaatttaatgagggagtaagttcgacaaatggtaaaaaaagagaatagacacaatacttatggcagaactatgcaatttatttgagaagggcgcttccgttgaaaaaataaatgccattcccatcccatcgtggataataaagtattatgtctgatgactgctggcattagggaatgccggaaatgactcaaaaataagtaattaagagggaaccattggtttcattgatgaaactacccttggggacgcttttcactcttttcacacacaaatacaacgtgaccacacgggaaggggaaggactttgcaaaaggatagtgttacaaaggagaaaaaagataaggagacggacattcacccggggggggggggaggaaaacatttatcttctaaattgcaaaaaggaggtgggtggaaacgaaagaaagaaagtaggcgccgttcagcagagaaacccaaaaatcacccccccccctctctctctctctctctctctctctgctgctccaactttaaaatccggatcacacagcctgtcattggattgaatattttggatacaactggtaatcatgtggtctgtcttctgtcaaaagtcatattattcccatcatttaaatgcagccagcagaacacagacaaaaggtagggctgct

SEQ ID NO: 27581 - DNA, 906 bp, Heterodera glycines
ctttaactttcaattaaaactagattttctaatagaatctccttataaaaaatttaaaaaattcttgaattttttttttctttagagaaaagaaattcattaaaatttttaagaaaacattctgcttttaattggaattttgaaaatgtacatgacgcttggaagaagacgacgactgctgctgaccctcctcctccgccgtcttctttggagaacttttgacagagctggctgcagatgttggtgatgcgtaaccagtataatccacgaactgacgttgtccaaattcaaaattctggttgtggccctcggtttgctgccgcttaaacgacgaattaattgcctttgtacgacgcgagttgtcattgaaccaaaaatgcaccacccaccgttgaatctgaatgttcgccaatatcatcatcctccactgctgctggcactgatgacgacaacgatccttcttcatccttttccttcagtccatttatttgggcttccattccatcaattcgagtcaaaagtttagcgaattggccaatacaaactgaaaaataaatgcgtttatttttataaattaatttgtattatcagcttttcaaagctcatcccatttagttttttgttactaaatccagcggtaaggtggattatgggactcgctcggtgcaaaatttcgaaagattctgttaagtttgaacaaagttatggcataaaatgttcgaacaaccagtttttgaattcttctggccataattttttaaccttaacgaaattttcgaaaatttttaggctaatagagcatttgaagggctctcgaatgataccaagattgttggatttagttgcaaagaaaaaagttatagtccaaaaacatgctggggcccaaccgtgccggggcacaactga

SEQ ID NO: 27582 - DNA, 1406 bp, Heterodera glycines
  misc_feature (139)..(139): n is a, c, g, or t
gcaattttttcgcactcattttcggatttgttcttttaatttgataataattattatcaatcactttttttcttcatttgaatagcgatttccatctaaaataacaacatttaacaattttatccaattaattttactnttgccaatttcaatgccaaattcctttttccaattatagtgtcactccgccaatgcccaactctatcgtaaattgcttcttttttccttttttggacattcttttatctcatcaattctttctaaaatttttttcttttcataataattcttttgatttatttttatttttcggcttaatccaaatttatttttccattcgtaaatttttgttcggccaattcccaatttttttgcaatttttctttcaattttaatccaaatttttggctaatgttttccctttttcttaattccttcctttattgcatgaaatttatgaacaatttcgcgtttgtgctgattaaaaataatttggaaaaattctgagttaaattttgcaaagatgtacggacgtttaagccaaaatcggacgtttcgccaactcgcctaaaatttgacatttcgccgactgaacatttcgcctaaattcgcatgtttggcctaatgtccaaaagcgaaattataacaacgaatttacacctaatatgtattctaaaatttctctgtgctttattgataatgattgctgaagtgcgccgaacataaactggcggaatgaatgccaaagaaagaaggatctaatttagaattgcaatcttttcggtttttgataaatcggaagccttaaaaataaattatttatattttttattttcttgctatcagtcgatagccctaagtgttttctactagcctgcaaaatttcagaaaatttcattaagtttcaaaaaagtcatggccaaaaatcttagggaacctggttgcttgtgtacttttggccataactttgttcaaaattgacgaaattttttgaaataataataataatatgacagaggaaaaaatattgaatactttcttaatatttaaagatggaaaaggacaaaagaagaagaagaagcattcagcagagttttctaattttcaaacgaatttggaaaatatatatatttttcaaaaatttatgaatctttatttgggcacttacactcaaaaaatccgtacactcggatgtccacaatcaatgatcgagtctaaaaattttatatacatgccaataaatttagtgaaaaattaaattgttcatgctatttttttctcataagtagtataggggtaaaaatcttgtccccccccccagggcagagagatgcgcattcaccatatgagagaagagagaattagagaaaaagagtaaaaaaatatgcgcgagaaaaaaaggaaaa

SEQ ID NO: 27583 - DNA, 1440 bp, Heterodera glycines
  misc_feature (26)..(26): n is a, c, g, or t
attaaattagtgacacaggcagccanttcgaaaaaccaatttgtaagtgatggacattttcgtttactttgttttcagcaagaaatgggcacgccgtcactaatctacttttctgtccatttctaatcttttacatcgacgattcagaccatttttaagcaattttgaattggtgactatgtcatttaccaagcttttttccaagtaattgatacaattgtttttctgcggaatccaatgaggtgaatgaaataaaaaagaaatcatcgaatggcatcatcaaaagtcctcttcctcgctggacgaactgctgcttatcatgaacagttggtgttccgtctcctcctcctcctcaacatgttcttcttctgctgcttctgttccgtgcccaacttccttctgctgattttccgttgccgcttcgtccgataacgaggcggaggagggacaaaagccgtgccgaagccgccgcctttgcttctctttcgttatcggccgtcttcggccgctgttgaggtcaatgaacatgccttggatagccaaaaatgccatgtacaacacctggaaaaatttattatccaaaaacgagtgatatatgaatggaaaatgtaaaaaataaaaaagaatttgaaaataatcaccatcgacacccaaagtcatgaaaaatcaaaaaccctctttttgtgcctttcgaaattaaaattttctattttttaaaaattttggtcggaggaaaaatgcgaaagatgctcggttaatcccttcctcaacacacctcttcccattcggacacgcacagagccaaatgccgaagcagcaggcggaacggagttggcattgtgtactcagaagcggcaaagattgcctgaaggagagaaaggcagcaattaatttaaatgaggggtaattagaattcaatttaattagaataattgattccgttgtgcaaaacatggcacacccacccgaagccatttcatacggcgcaatggttgggccacaattgcggacatccgcgggggatgaattttgggatgcggaaaacgctaaaccgagaaaaacacggggaatgaaaaattgtgagattttccgaaacttagtgaatatttgtcggagcgagggaacagtttttgcagagggctaatcggctgtaaaagagaataaaatgactgcttaattttgaaagtattacaaaatgatggaacacccgtaggaaaaggaagcacatatttccaccgactactctcaatcccgacaattttttgggagcagctagtttcccccccccccgtatcagttccccaacgcatcgtttccgaccgagaaaatttaaaaaattatttactaactcacaaggggacattccgagctgtaactcggaaaatgcatatgtattatataccattcgatagagccgggtcgacttccattgagaatttt

SEQ ID NO: 27584 - DNA, 932 bp, Heterodera glycines
atattttcaaaatctcaaaaaaaaatgtttccgatcactctgatcagtgaggatgtagtgggtcatttgttctcttcaaaaaatgaccactttaacgtcgtaagagaagtgatcgattttggacaaaagtttggggtgggggcggtgcgccgaaaaggtgaacaaaagtgcaacgggaaggaaactcgagactttaaatgctcgagattcaacacaaagatgaactttgttttggcaaactttgtaatagagtgagagagtgggaaatttcggaggtgggatagagagaaagagataaagtgagtgtgattttaaagtggcacaaagtggagggtaaagagagagagagagaaagacccatccaatccttgggtttgaagatgaccagagggcattggcaataagtcctctattcgaagatgatagtgtccgaaaatttttttgcctctccatcccttcggcccatttctgatcactccgaccagagcagagcagtcaaaaaatgatcttttctgctccttggatcacaccgattagagcagcgcagatcaacaaagtccccaacaagaattgttggatcatttgtccacttcaaaaaatgaccctctgatcctagagcagagcagatcaaccataagccccaacaagaaattgtcggatcacttatccgcttcaaaaaaaatgaccgttttgaaacgcggcgcgaaaatcactgtgtggttggcgttttgtggtgatcgatttcggaggacggggggggggggggggggttattgggcttgggctcgggtggtgatggttctgctggtgttggagggattggttggttggtctgcggagatgtgaggtttttgtgggctcccccctatcgtccgtccgtccgtccgtccgcctcgtcgtttttcgtcgtcgtcgccgtcgtttgtgtcaat

SEQ ID NO: 27585 - DNA, 1174 bp, Heterodera glycines
  misc_feature (1046)..(1046): n is a, c, g, or t
  misc_feature (1079)..(1079): n is a, c, g, or t
  misc_feature (1100)..(1100): n is a, c, g, or t
ttccattttccgttccataagtcccaactatttaatggggagcattctttggataaggagtcagttgggggggccagttattggcgagggggaacgagaacaaagcgcgggcggaattatattttaggggatggcccaatattattattatttatactccttctcgcccatccccgcacgcgtattcgatcagtgcgcacccaagggattaccaatttggggaggtcatttatccagggcccggattttggcttattcctttttccccccaaatccaatcctcgttctcactcgttcccttcctcatattctgggctggacatcagcaccttcactggtagcaccggatggttgctggcacgccgccggcaatccatccccaggaggacgagtgggatttgcgcgtgttggggaacgagaatggaatgaggtgcaccgctccttcgggagatcagtcatgttcggatcaaaaaaattaaatggccaatttcgaaccaatttgaaaatattttaaaatttttgccccaaaaatgggaagtctattattgttgccccagaatgggaagacttatattttttggatattttttgccccaaaaatgggaagtcgatttttaattacaaaaaaaaaacaattttatttttgcgccagaactaattgcgccagaaaggcaagtcaagcgccgcgccaaaacgacaattctattattttgccccaaaatgggaagatcatcacattcttattgctcccaaaatgggaagactgaattttattaaaaaaattgtcaaattcattttgcgctaaaaataataggccaatttacatattttgcgccaaacggcaagtctaatgttgcgcccaaaagcaggagtcttttttattgcgccaaaattcgtttctatttgctctgccccattcgccgtgaccattttataagaaatttatttattctgctcgctctcttcgaatatttgctaagaaataagaattttctgtattcctttttttgtcagcaaaaaaaaagtttaatatttattgaactccnttgggagtaccgtcaagtaagaggccaaaatanaatttgtaaatcatccatgantatccgtcagatcaaataaaaatctcgatatgcttttattttactaatgctgagtatcatttttgtgattttta

SEQ ID NO: 27586 - DNA, 1034 bp, Heterodera glycines
ctatatcaaccaacaccttttatggggtctaatgagcggtcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttcacctcatcggtttcacgtcctctttaactctctctttcaagtgctttgcaa

SEQ ID NO: 27587 - DNA, 1739 bp, Heterodera glycines
tccacggtcaagaccggcataatcaaaaatgtccacggtctgggaccggcataatcaaaaatgtccacggtcaagaccggcataatcaaaaatgtccacggtcagggaccggcataatcaaaaatgtccacggtcaagaccggcataatcaaaaatgtccacggtcaagaccggcataatcaaaaatgtccacggtcagggaccggcataatcaaaaatgtccacggtcagggaccggcataatcaaaaatgtccacggtcaagaccggcataatcaaaaatgtccacggtcagggaccggcataatcaaaaatgtccacggtcagggaccggcataatcaaaaatgtccacggtcagggaccggcataatcaaaaatgtccacggtcagggaccggcataatcaaaaatgtccacggtcaagaccggcataatcaaaaatgtccacggtcagggaccggcataatcaaaaatgtccacggtcaagaccggcataatcaaaaatgtccacggtcaagaccggcataatcaaaaatgtccacggtcaagaccggcataatcaaaaatgtccacggtcaagaccggcataatcaaaaatgtccacggtcaagaccggcataatcaaaaatgtccacggtcagggaccggcataatcaaaaatgtccacggtcagggaccggcataatcaaaaatgtccacggtcagggaccggcataatcaaaaatgtccacggtcagggaccggcataatcaaaaatgtccacggtcaagaccggcataatcaaaaatgtccacggtcaagaccggcataatcaaaaatgtccacggtcaagaccacataagcagaaaatgccatgccacgacgatgactcgcagcgttatggatgagttgggtatggatgagtcttttttaaataattttttgtttttttaatgttgtagcctagtaactcctcccctaaaatgcatgttgtatttgagaaaatcaatcgaataattttccaaattattattttaatttaaaataaatatacaaattcattcatttccttaatataaacgctaaaataatttctttttatcattttatgaaaataaataaaatgttttgccatgtttttgctatttcttttggcattatttgcctccttttcttgttttcattttccaatgcaaacacatcggtgagtttcactttaattgtttattttaatcccattttaattagtttaatgatgataaaatgcttattggttttatgaaaggccacaaaaatattcgaaccaatcaaatcagaacgctaaaatttgaggcataccttggcattgtgtattttttgaaaaagaattggcaatgtgacaaaataaagaaaaaagttgaagaatgccaaaaatattgcaattatttggacattttgtacgaatatttgttcagagaattcgtcggacttcccgttgttaagccaaaatttgtgcataaaaaacgccaaaaggaaatgaatgggtcaataattaatgtggtgaattatttggccaaaatttcatgtttttgttttgattcaaatttgaagaaaaataatttgattatttcaaaagcaaaccctaaattattgaataagaaaagattgaattatgaagcacagaaaattgaacaattagtgccaattaatgaattggttttacaattggcaattgatgcggccaatgaatggccaccaaatcaaagtgtggacagatttatg

SEQ ID NO: 27588 - DNA, 833 bp, Heterodera glycines
  misc_feature (67)..(67): n is a, c, g, or t
aaaataaccaaccaaccaaccaacgcgttgaacaatcatccgctcgccccgttcgaccccccccccncccctcacacgcctcccctcccccgtcctccaccacgcatcccatcccagcatcatccaacgatataaggaaggaggagggaagaggggaggtgaggttgggacccccgacgggacgaagggacccaatctcgtacaaaagtgaaagggcggaggggaaaataatgggggggggtggacaaaaagaaagaaaaaggaaggaaggaaaagaaaggcggattaaggaggaacaaaaggaacagataaagagaaaagaagcatcattggaagagaaaatacgaaatggagaggagcagagaaaaggaggagagacgaagaagaagaagacggggagggaggaagaggaagagaaaagggaggaaagggaaaaggcgaggcagatgaagtggaggaggaagacgagtagagaagggaaaagcaatgttggaagagcatggagagaaaaagatagaggaggaggaggaggacatgacgagaatagcgcccccctttccttttaccctctcgtgggttatgagcaggaggacactccgcccaaaagcaacccctacaggagcagcagactgaagaagaacatcacatcatcatcatcagcatcgtcctccattctcgacggtcgtcgcatgggagagccgaccgaccgacggacgaccgggcccattcggttgctgccagcacggttgccccaaatcactttcacttttccctttcacgcgacgacgacagccaatggtcctcactttgtgggacactatcggagagggaaa

SEQ ID NO: 27589 - DNA, 1384 bp, Heterodera glycines
accccgcggcacccggcacggtcccccgaaggaatggatttaattaattctctccttcggggattttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaactttgcaggggatactccccggtaaaaggactaacttacactgaaatgagcgccgagctagctggctcaaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgggttttcggggcagtccccctgaaccgatgcgcccagatttataaggagtccgaatccttcgggaatagcttcgatatacctctactttatttttaccttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccattcggtgcaggaaaattattaaattttaaaaattttttaattgctttttaaatatgccaaaaaatgtaggcttaacttttttagtgtaaattcgatcactcatattttttgctaattgagcagaagcgtaccaaactttgcagggatactccccggtaaaggactaacttacactgaaa

SEQ ID NO: 27590 - DNA, 1182 bp, Heterodera glycines
  misc_feature (1174)..(1174): n is a, c, g, or t
tcatttaaccataaccacgttcttattctacgggcccggtgcttttcggaaaattggcgtttggttactctcgagagcaaatttaattggcactttccttcacttattcgttatagaaaatgccaatgatttctcattaatctctcaaccctttcactctattgccacttttacttttctctctcatacatacactctctcctctctcccattcctctaatattctcaccgtctgatttattctttcaaatttatgctctctctctccctctgtctctctcaatctcccccccccctatctctctttttctcccccactcctccaacgttctcaccatttaatttttctctctctctctctccatctttctctctctctctaatgtgccatttctgaccaatacgaaaattatttacttaaaagatgaagccccggaggcggctttgcggtgtggtgtaggattttttttgattctgctaacagctaatatgtacatatatgtgctgctcttaggaatggtgatggcggtgcacattcatttgcatcggcggatgcgacgcggcggcggcaaaagattaaagagagtgcgttccgtcgtcgtcgccgccgttttcccccggacgccccgccggcgtttgtgtttttcttaaccccctttggtccctctgtctgtcccctctcaatctctgccacactcctcccattatatcatccctcgtttgctgctgatgctggggtccctgccctcctccctttttttggttttggcggtgatgtaattgagtagaggggggggggggggggggggggtgacggcgagaccggcggcggcacggtgcagcaacaaagaaaaatgaatgggatgatgttggggcaattaattaaatggaaaacccgagagtgatgggaggggggggggagggagagaaagagatttggcgcggatggatatgtgacagactgcggtagaagcggcatagccagcagcagaggcattggcacactgtccggccggcgtcgggccaaccacaacggcattttttttggcaaggcacacagcgcacagagtaagtgctgtgagtttagtgcggttgcggtgggcgaccgctaaattaagacgtggacgacggagcggcgggaagagttagaatggattttggattgtcgtcgaantgggggga

SEQ ID NO: 27591 - DNA, 1330 bp, Heterodera glycines
cctctgagattttgtagatgaaatcgcaaagagtgcgccttacgatttgtttcgtttggacaccatttgtaggttagcaaaatatcgaaaaaattaagaaaaatacgcggaaaagaacggagaaaggcaaaacaatgaaaactaaatgaaaatatagcgaaaattaatggtgaattaaaaatataaaatgaaggaaataattgaaaacgaaagaaaaatgcttaatgaatagattacaggaaaaaaatacagtaattgattcatcggtgttaggttgagacgaaaaaagtatcattgaaagtaatatttaaaattaattgtttaaaaatcttattttcagaataataaacttaaataatattcctttttgaaatgtaattgaatgccaaagaaatcttagggtttccaaatgatgtcaagggtggtatcatttgggcttaattgaacattgaacattttcatacattaaaacccttacattttatgaccataaaatatgacacatttattgcttaacaactttttcagaagcaatcttttttaaagtttcttaactcaatgttcagcagtccaaagatttctgtaattttcagttacaaatcatcgagtctaaatttttcgttcgctcaataccaaaattgattagtttgatcaagtttaagctaatttgtaagccaaattatgatttattaattattcttaaaaatgaaatgcaatagaaactgagtttttgaaaggcataaataataatgagagggaataattagcaaatggagagggggaggagggagggaatgagtaatgtaaagattaatagctattagacaagtgagtgccggaaatgccggatgcaaaatgagtgatttgaatggatacatataaatgccgggtcggagcccaggcacaatttgtcggttggatggcatcattttgatggatgggtgagaggggtgtcaccgttttacgtttatggtgtggttgtcctttcgctcccccccccccttttgcccacccttttctaccgcaattaacgtcggcaattacataatatacgctaatcactgatcactgacccttcctccttgactgaagcgaaaatgccactataattaggaacaaattcgcctcattaaccaacgcgtcacttaaaagcgcgtcaaatttgaattggggacaaggaattgcacacaatggacgaatgaataaatgaatatgcatgaaggagttcattggctccctgaaaatgcgacacccgtaaatacgacattggaaaatgcgacaccgagataaagtttttaatttcaagaaaatgcgacactaataaaatacg

SEQ ID NO: 27592 - DNA, 894 bp, Heterodera glycines
aaatgcgccgattgcggtgcacatctcttctcacatgaagacagtaacatttgctgccggaagggaagagttgtgctgccaatgcttaacccgcatcctgacgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaggcgggcgcttcgcgaccgttttttaaatttgtttgggccagacgggcgcttcgcgcccgtttttaaaatttgtttgggccagacgggcgcttcggtaattgtgcgtatttttttacgtgataacttgttttacaaccaacacgccaatttatcactttgccccgcggaaccgcccggccccccggacattccgggagcgtatggcagagcctgagagagcgggcgaagcaggcaccgtcggactgcccggaccattaccgctaattcaaaaaactgttgacgcggagtcttgccgagagtgcccgtcagggcctcccgggcagcctggatatacaggaccacctgggtcaccgggagcagatgtaaggacaaatctatgattggttattgaaaaaattatctttttagggtccatctggatagaggtgcgttttcggaatgacacgaaatcccggaaccat

SEQ ID NO: 27593 - DNA, 1388 bp, Heterodera glycines
  misc_feature (1296)..(1296): n is a, c, g, or t
  misc_feature (1302)..(1302): n is a, c, g, or t
ttaaaaatttttaaaaattttattcatctccctttttgctattaaaagcatcagagtgcctaaactaacatgtaaataaactctggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccagatgggcgcttatcttgtcaaattacgaatttgacattcgctacatcaataccactgcgtttggtcaagtcgacatgctttcacgacttatcgcgaattatccgcgacctgaagaagatattttgatagcgaaaatttgcaccgaaacagaatgtttcatcggcacaattttgcaggcacgaattaatcatcttcccgtcactgccaccgaaatagcagaaatgacggaaaaagatgaaattctccaaaaagtggccaaattctccaaggaaggatggtcacaaaagtgtaatgaccccgacctcgcaccgttctttccaaaacggaacgaaattttgcaaattgagaattgcctgctttatcaaaaccgggtgatcattccaacaattttgcgagatagaacgttgaaagcacttcacatggcacacccaggaattgtgcgcatgaaggctctcgctcgccaacacgtttactggcccggaatggactcagccattgagaaattggtaaaaagctgcgaagaatgccaaatcgcccaaaaagctgctccaaaagcaccactttctccttggaatgccaccaaacggccattcgaacgtgtgcatattgattttgccggcccatgccaagacggtcatgtttatctacttttagtggattctttttcaaaatggcccgaagtttatcagatgaatacaatgacatcaaaagcaacgatcagtgttctccgattaatcatccatcgacttggcatcccagaagaaattgtctcggacaatggacgacaatttcgttcgtcagagttttccgaattttgtaaagaatttgggattcgacatatgttcacgccgccatttcatccacagtcnaatggncaagtcgaacgctttgtcgacacttttaaaagggcaatgcagaaagtgtcgaaaaggacaaaaatgggctgagaaatgctcctgtc

SEQ ID NO: 27594 - DNA, 1554 bp, Heterodera glycines
ttatatcgttttccattattaattattctttttctttttctatcggtgaatccccctttttttgtgcctttcccaccgcttttcctccgccacttccaattcgttgtgcattttcagtgacacttccttggccactcgcaattcctgctccaattcgctcacttttcgccccatttgttcttccatgtcgctttctccgctcatttcctcaatttgttcagctccttctccaatccctcgttgaatttcttgcacttttcgtgccaacaaattcttttcagtcttaaaaagaaaaataaaatgttgtatcagttccaattgggatgatatgggcggatcagaagtgttagtttaattggagtgttgctgatcaaccaaggcactttctcatggactgaccaatgatcatttgtttcgatacaacgaatactgatccggcttaccttgagctgatcaactattgtctttccttttgatcagtttttctcatgtctgatcagcctttgagcctcattcccccacccctccgttttgtccacctgcaattggtccctttgccgctccgccttgcgcagtttgaactgcagaatgcgcccgttcttcgcgctttgctccaactcgcgctgcaactcgcggaactcctcgatctcttccactcggtattggtcctgcatctcttcaatttcgcgctccaactccttccgctctcgtcgtaactgctcgcacatggactcgctcatctgcagacgctcttccaataccgcgggagctgaacacacgccgttgctgatcactgtactggcagaggcgctcatcatgtcacggctatgcaaaaactgtaacggtgcaatccttcaattatcgtaccttcggccatctttccctgtgccatcccattaccgtaccccttcccgtcgttccaccaattgtcctttgagtgcgctgttttcctccctgtactcgttgagcatcgtctccatttcgctcaatgcttcttccatcatgcgttgcccgtccaacgttactgtagtcgttgtctgctgctctctcttgtctccgttttctctctctttccaattaccgtacttcttccttagccattctgtccaccgtttccgttcgtgccgaaagcgacggcattgctcctgcaaacgtcgattttctccacgaatatggaaaaattcttgttgattctgtgagaaaaaaaagctatgcatttaaatgtcgttgtttcttttcttaaatcccgttacaaattccatcgccgtcggtgtcatcgcccgttcaaattcgtcatcgtccgacccgaagaagtgctgcgcctccgacgtgcttttcggcgtcatgaacgggtcttccattgggtcgtcaaagggcggactctttcccgttttgaacgactcggcacaagacaaactgttcaaactctccactgatcgggcactgaacatctcgtcaaccgtggtggtcgtgaaggtctgatggacggatcgatccaaaagcgaatgccacgatgggaggaggacagcgacaacagttcttcctcttcatgct

SEQ ID NO: 27595 - DNA, 1326 bp, Heterodera glycines
  misc_feature (1237)..(1239): n is a, c, g, or t
  misc_feature (1277)..(1278): n is a, c, g, or t
agcaatctgtatttatagactctggtcgcaattgtaccaaaaacgagtttagaccgcagtacctcggcttagagagaagattaagggacgcaaaagagtcgatataaaaacgattttacaattatatctaatgatataataacaatgcagttaccccccccccccccccgccgcttcccacagggccgtccgatgatggcaaatgccatcacttcgcactttgttgcttgagaaataaagaagatgaatgtgcgacagaagacaatacaatctgctctttagagacagcagatgtgaggcgttaaaaaggagaacaattggaagagaaaaatgacattttgacacttcggtcaattggggggggggggggaggggtccttttgtgtgagagggattaaacggtcatcctgcaaaagtggcacatcggagagagtgctggacagaaaagcagtgaccgttcagtgaaaagaaagcaaaaggacacgcaattggtggacaaggaaagacaaatagcaaaataaataattaaattagcgaaagagtaaaaaaaaacattgcttcccacaactttctcacgaaaaaaaaagaaaatgcgatgaaacagagcaaataaagcaaaaaacagcgcatcggtggtcatttttacaaatattcttcattgaaaatcaaaaataaaacttattgaaaaaagaatgggaagaaaaggcaaaaccaaaaacaacgaggtgaaagtgcggcattgaaaaaaaaatggaagaaaagagtttaagaaaaaagtttatggggaaaaagatatttattttttaaaagtttgaaaccacacccccaatttgcaattgtaccccaaaataccatatctacctgggactgaaaaccccaaaaaatcccggactgtaaatgtcggaacacggtattcccctccgctaaaaattgaaccgactttggccgtctccgtcgttgaagcgcttttctttttgtagtcgggattcagcttcgctgggagcggaagaccgcgctgaaaaacgcgagtgcgcttttgcagctccaattcttttttctttgccaaaagtgctgcgcgacgttcgtccaactcagccgcgtcttcaatccactgaaaaaaataacgaaatcagtgcatcaaacttattattagcaggaaatgattaaaacccattttaactgcttaaaatgaccaatttttgttttttgaaccttaagaaaatgaaaggaattttannngtgtaacagaacaaaaaacgcagtcgaagttttaattnnttcaacagattttttcagaaaaaatctttttttttctcgaattctcta

SEQ ID NO: 27596 - DNA, 1097 bp, Heterodera glycines
  misc_feature (994)..(994): n is a, c, g, or t
  misc_feature (1080)..(1081): n is a, c, g, or t
aatatttttcaaaaaatcgcccttataaattgcatgggatatttcaaagacaatttagtcctgtactggggagtatcctgcaaaaaatggtggggttctgatcgcttttcaaaaattacttggaattaaatttttactaaaattataagcctaaaaaataaggttaattattttgaatattttttcaataaatcgcccatttccggcactatgccaagtttgggcgggacagacctaacggggagatataaagtatagggaatatcaaatctattcccgaaggattcatcctcccgaaactgtctgactgttcgaaaaaatttttaaaattaagcctaaaaaatttgtctaattattttaaatattttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttaaatattttttcaaaaaatcgcccatttccggcactatgccaagtttgggcgggacagacctaacggggagatataaagtatagggaatatcaaatctattcccgaaggattcatcctcccgaaactgtctgactgttcgaaaatttttttaaaattaagcctaaaaaatttgtctaattattttaaatattttttcaaaaaatcgcctttataaattgcattggatattttcaagacaatttagtcctgtactgtggagtatccctgcaaaaattggtggggttctgatcgcttttccaaaaattacttggaattaaatttttactataattataagcctaaaaaataaggttaattattttaaatattttttcaaaaaatcgcccatttccggcactatgccaattttgggcgggacagacctaacggggagatataaagtatagggaatatcanatctattcccgaaggattcatcctcccgaaactgtctgactggtcgaaaatttttttaaaataagcctaaaaatttgtctaatatnntaatatttttcaaaaa

SEQ ID NO: 27597 - DNA, 977 bp, Heterodera glycines
atgaaacggaggaccaaatgagaaacgaaatgtaaataactaattaacaatcaattaatggggctcacctccttcggacctgagctagtaggcttattgaagaatgctgacaacctccgatatccattatagcttattcctaaaatagagcacccgtggctttattttcacccactctcaaaaggggggctttattttaggggggagggtttaatttagggagggagagctgtattgtaggaaattctgtaaaatcatatagcatcagatactttttgtttgtaccgaacgaatccgaaagaattttcgaaaatacacctgctgattggcttataatttttttccactcagtttttatttgtccataaattctttcgcatttgaattatgaaaaatttgggggtgaaatttttataaaaggttgaataaatataagagaagcatttgtttttcgccgactcgggttgggaagcaacactaattaaagcaattaaattgagggtaattaatctagttagtccggttcagttacatttgtggcgacggttggctgggggtgttccatttgcttccgcctgctcagcttggccttcaaattgcgctgctcagccgacgctttgactgtttggtcgacgaacacttcaaaacgcggaaatgggcgcttggatttgtgcgcattggcaacaaaattggtgcaaatggcaccaccgaattggcaataaaaaatttacgggccaaaacattgccaatgccggacaaagcattgcccagcaaagtgatcggattcaaaagcattatgatcaggtaatgctggcgaaaatgcattcaaatggcacaggtttttattagccacaaaaatgggctaaaggattgacataaaaaagcaaggacagtccttgaagggaaaacccaatcccaaaaaggcaataaattggaatttacgggatttgaaaaatacagagaaaaatgccatacat

SEQ ID NO: 27598 - DNA, 1144 bp, Heterodera glycines
aaaaccccattattggaatttcatttgaccaagtaactgatatattaaattttgtttattcccttattaaagccagtttttccaatatatttattattatcatattcatactcattatgattttcctaattccatgtctactacgtattctatatagaattatgtgtcgttgccttcctctttcgcgcgggagtgtcgcgacaacgtgaaatcctaagataaaacccaaaataaaaaagggaaaaaataaaaaacaatagaaaataaaatggggaaaaataaaacataaataataaaaaatatttttacatttattttggaaaaataatattataaaaaactattcaaaatataattacataaaaatgggaaaaccttttgaaatgaataacggaaaattgtttgaaaagggaaagtgcatttcctcaggaatgaaaggaacgaaaattaattaatattaaatgattaatatgaaagggcgaattcggttaaggaattgcgttcgtaaacaaattattaataattaattaaatatattaaagaaattggaattgtaaaggaaaaagtggaaaacaaacaattaatgggaaaatggcaaaacccaaacggatataacaaaaacagattttaattaaaaattataaattggagcgtactatggtttcaaaaaagccgtataaaaggggctgggttttcagtgatttcagatcgctcattggttccctccgaagtttccattccttccccgtgccgtgctccattccttccccgtgacgtgccctgctccttccccgtgccgtgcccgtgcgcctttcccgtgccgtgcccgtgcgcctgccccgtgccctgctccttccccgtgccgtgcccgtgcgcctttcccgtgccgtgcccgtgcgtctgccctgtgccctgctccttccctgtgccatgccctgcgccttccccttaccaatcccctttgtgcccatttgatcatgtcggattatatttgttcattaattaattatggtttaattacccaagtttgagggtacaaaataaagtgaatttttggcgcctttggtctttaatttttgtcaactcgctctgaatacgtccgcccagcccattcaaactttttttgccgtcgtcagaacgacat

SEQ ID NO: 27599 - DNA, 1028 bp, Heterodera glycines
cttttattaccctcataaacatagtgcaaatcctcggcagtgttggcaccaactaaaaaattgaactcggcggataaaaagataattaaattttggtcaataggcatcaaaatttttatttccaaacttagaccacccaaaaatttttttttaattttgccggcggcacttttcttaattgctcacttcctaaggcgtagagaatggcatctttggatgcataagtgaaaattgccggctcaggaatgtgttgtcgtgccttttccgggtccattttttccttttaaataaattttgaaaaaaattatttaaatttaaaatcataaatattatttaattatttatcagtaaagtaagtaaagaaatgattaagaaaagactgaagattgcggccaattttggcttttacaacaaaatttaatcatcaaacaatcgcctcactcaatcaatgagagagagtgtgttaaactgtttttctctccccgtcagtcaaataattaaaaattataaaataattaataaaaaaataattaataatctccagaggattttataaaaatttcaaaaaaacatatatttcataaaatatattaaaaatctcatgagaatatttttcataaattttctccggaaatgggaaaacacagaaattatttctctaattataagttgactgggaacaggttcactgtttattcattaagcgagaattttccgaggaaaattgcaagtttttcgcgaaggaaaattttcccgtgccaaaatctgctctgatcttcgtgccaaaatctgctctgatcttgatcagagagagagactgattggaatggttggtggtggtaccatatttggggtgaggcgccaattttgtggagaagagttatggtgccgagcctgctgctgaagtgcccaattgtttgctgctgctgctgctggactcaaccgtacaccccttacaataatgcgaggaaactgtattattaatttcaacatttaaaaaatatttatgtaggtaggttaaaacggaa

SEQ ID NO: 27600 - DNA, 1228 bp, Heterodera glycines
  misc_feature (1167)..(1167): n is a, c, g, or t
  misc_feature (1212)..(1212): n is a, c, g, or t
tttcatatatatcatacacaaatatttatttagctggcagaaacgtcagtctaaacgtgagagcatatctcattataactaaaggaataaataaacgataagaatatttaagaaataatctacgagaaacgatagaaaatgtgaccatatgaaaagatttgttaaaattttttaataaaaatatttttttttcaaaaattaattttttcctaataattcaacattaaatctatactcatttaaaaacaacaataaacaggttaaaaatttagaacaaagcattaatttaataaaaaaagaagtcaaattaaggtttatgaataataatcgggagtaaactcattcatggtaaaagcgaaaaaaacaaatgctaataaatatattaaattcaaaaatagaaaagcaaagaatttgaattaaaaattataggattgaaaccataataaaactagcttaattaatattaataataaaatattcatatttaataaaataagaataataattaacttgcacgggtctggaaatctgcataaaatttaaatatacaaaagattttttatttaatattttaatattgaagacatttgattctttctttaatttcttttaaagtgagtaattgtacttttgctactgacttaagacagggacgcaattataccaaacacagagtaggccaatgtcaaatccaaacactttaattccaaaagacaaataccgatgagaaacaatttgacgaatatcgattttaaagtcaaaagaaattggacggcacaaaacaataaaaattaccagataataaaattggaatgaaagatggaaagaaaaaacaaagaatacaatttttaagtgagaaaaaacgcgaaacaagacattatgccaaatttaattaacactaatgagtcattataattaaaattctacaacatccctcaacaatcagaaaaggcgtccctgcctttagaagtcagaaaccgaaaggtggggtccaacaggtgtctcagcggcgattaggacggaattcccgacggcgttcgttaccgtacgtccctggcgattagtctcataaggacggtaacggatggccggacgatcagccgaacgattaggaacaattctacgagaatcggcccgatctctcgaagaatgccctaattccagctngtccgatcggtgatcggcccgatctcccgatggaaaatatgacgncgaaggcagcgagcga

SEQ ID NO: 27601 - DNA, 915 bp, Heterodera glycines
  misc_feature (746)..(746): n is a, c, g, or t
ttaaggatatcgtgctaaatttggcaatcaaaggcagccttcccctactatttaaggatatcgtgccaaatttggcaatcaaaggccgccttcccctactatttaaggatatcgtgccaaatttggcaatcaaaggccccctccccctactatttaaggatatcgtgccaaatttggcaatcaaaagccgccttcccctactatttaaggatatcgtgccaaatttggcaatcaaaggccgccttcccctactatttaaggatatcgtgccaaatttgacaatcaaaggccgccttcccctactatttaaggatatcgtgccaaatttggcaatcaaaggcccccttcccctactatttaaggatatcgtgccaaatttggcaatcaaaagccgccttcccctactatttaaggatatcgtgccaaatttggcaatcaaaggcagccttcccctactatttaaggatatcgtgccaaatttggcaatcaaaagccgccttcccctactatttaaggatatcgtgccaaatttggcaatcaaaggccgccttcccctactatttaaggatatcatgctaaatttggcaatcaaaggcagccttcccctactatttaaggatatcatgctaaatttggcaatcaaaggccgcctttccaacctatttaatgatttttttcatttttatggcaatcaaaggccccctccccctactatttaaggatatcgtgccaaatttggcaatcanaagccgccttcccctactatttaaggatatcgtgccaaatatggcaatcagaggcagccttcccctactatttaaggatatcgtgccaaatttgggcatcaaagggcgccttcccctactatttgaggatatcgtgccaaatttggcaatcaaaggccgccttccccta

SEQ ID NO: 27602 - DNA, 814 bp, Heterodera glycines
ctcatctcccaaatcagtgccttttctctgatccctttagagcatggagagcaccgttcgcgcctccttcgtcttctgatcctgttcaatgctttgccgcattttttccccgaatttcgtggcggcttcatttgacaaagttggcggcttcgtttaccgttcgttttctggagcttacaacaataccttggcctgtattttttaaggctttctctttgtcctcccgcaaatccttttttgcctcattgttcaaagtcgactcccaaaatgccattcgctcgtttgtcggcttcggcggtttttcgaaggcatctctttctctttcttcagaatccacaatcgagatttcatcgtctttcgttgttccgacgctgaggcttcgtttggtttccgtctcgtccttctgcttcatctcttccttcttcttttccgtctctttttcttttccctctcttcctttcttctcctcctcctcttttttcttcatttcttcgccctttttcgtcgtttcttcctcattttcttcccactcctgtggtctcactggatcatcatccgacgttccggatttccatttttcgctttcggtcacactttgctggaccctcagaagttgatgttcgagctttctcttcaatctcttcagagattcttcctcctcttttgacagcaattccatcttgaaaaatgaatggcttttataaattttcccgctcttttctttggactcgattaatctgccttttttgttcatgatctcttttaggcctgaaagttgcttatttttctcattaatttttcataaattgttcca

SEQ ID NO: 27603 - DNA, 1194 bp, Heterodera glycines
attgctcaaattgatcatggacagtcaaaaatacaacatttgatcattttaaacgtgttttgaataaatttgtaaaaatgaggctttttgatccaaactgaggtttttttgcatgccaaatgaggctttgaaaattttaatcacacagctctgcttataaccctactgatgaaatgtacttagttcgattgaaattagtttcaaaaaatctaaattttttttaaatattaagttttgccagcacattaccaatatgccttttgaaaatgtaaggccttcttctatataatgtaaaatatgcagttttgtatgttaaattggcttccggtgtagtagaaaatgctcagtgagatagtaaatttttcaaagtcagaaatctaaaagtttgttcaattttacggcttctctttaaaatttatttaactttttggacctttcaaaaaattgaattgataattcgaacgaaaattcttataagattttgactttttaatttatttaaaaatattaccattgacgcattttccgattacggttaaatttacatttttgatgtatgtaaaggttaaattatttttgacttttaaaagcatcggtagctattacgctgacaaatgaaagggcgtaattattgaacacatcaaatgcgatcatttatcattcgtcattcccccaccccgccctttgtgccgtcccctcctcttcctcgtctgttctgcttttcgtctcctcggcactctttttctttggatttgcttcaaattgcgagaaattaatgagcggcgaaaacctgcaaaataaaatgaatattaatggaaataaaaaaggaattgccccccaatgcattccaaatgcccccccccctcccctcaattgtcccctcactcttccgtcgcttttctctccttccgatgcgtcgtcgtttcgtccctctctccgtttcgtctctgctgctgttgttgctgctgccggtcacccatctccccattgtacacaacgcgttgttgggcaagtgcggttttgtgccacatttcggccagcatttgttgctgtaagccaatggaagggaaatgcaaagcgatgggcgggggacaatccgtcgacgagtggaaaagcagcggagactgttgttggtgctgttgctggtgctggtggagatggagcagttgttcgagttgagaccatcccaaccca

SEQ ID NO: 27604 - DNA, 994 bp, Heterodera glycines
  misc_feature (43)..(43): n is a, c, g, or t
tttgagattttaaaaagaattatgaaaaatacgggtgaatttntaaaaatatacataattaatttaattaaaaaccaaaaattcaaaattttctcgaagcatctctttaaaattcaaagtcatttttataaactaatttaagaaatctttgccaagaatttctaattagccaaatttgcttcatcggaagagagtccaattaattgaaaaagcatgaaaaaagttttatgcttgatttgttaagtttatgatgaagtttttatatccaactttttgcattatgcccatattttctttcatattttgacatctccaaattttttttttattataacggaccatcagcaaaatttgtctttttacctcaaaatatccgaaggttttgcgaaaatttatgaaattttctcgcgatgtttgtttgaaattttaaattttcttaaaatagtaaaatttgtggccaaattaagtaaaaattatttcgctttttctgtcgttaaaagcaaagcctctggatgttttaatttagaaattacattattttattaatgataataattaattaattaagtaaaaaaattgtggacaccgaattgctttggcccttcaacagttatacaccaagtgataacagataacatgctgaaagtaccaaagaaatacgatgtgctcaattttcattaggaattattggaaaagaaattaaattgttgaaatttggcggaaatattgattaaattttattaggagaaatatgtttttttggaataataatggccaatttacgtggaagataggctcatttaaaggaaaaccgtagtttattgggcggtgccaattcgcagccattgcccgccccctggggccattggaaaaatggggagagagacgcagaaagggggtcacactgtggggaggcagagaaaaattaagaggagagtagaagagagagagagagagaagataaatatatgttagacaaatggcggaagagaga

SEQ ID NO: 27605 - DNA, 879 bp, Heterodera glycines
ttgcatttgtcggtgctgtttttgaactcgcatctccaaaattttgtcatcccatcagaaccagggctggacgcaagtggatttacaattacggaaatccgcaatccgcaattgcggcgattttctcagttgcggaaatccgcaatccgcaattacgggtgtccaaaaaccccgcaatttccgtaatttccgtaatccgcaatccgcaattgaaaaaaaattttttttaataattttaaattttattttaaaaaatcctataaatcttttaaagcaatttaaaagcatattaaaaagcaaatttataaaagcaaaatcattcaattgaaaatccggttagaagcaagttatggtgaagaaacaaaagctttgccagattttccgcctgtaaactctttctcaagtcatctgaaatcaggccggccgttgagaaaagcctctcactttctgaacttgttgcaggcggagaaagaaatttccgtacaacggcaccaatcattggccatttttgtgaattaacttcccagtataatgctggatcgaccctggatttgattttttggtcccgtaaatattcattcacttcaacttcggctttttgtcgtgtctccaatgcagatggactgggggatgttgccttaaattaattaatttgaggggaatataaattaaacaaatgtatatattttctttaaataaaaatagaaaaaaattcattttataaaaaataatcttacaagaaatcgtcgcgaaaaataatccaatagtcaaattacggatcaaaattgcggataaatcccaaaaatccgcaacccgcaatccgcaatttacgggggtccaaaaaccccgcaatttccgtaatccgcaatccgcaattgc

SEQ ID NO: 27606 - DNA, 106 bp, Heterodera glycines
tttttttttttttttttttttggtgggggggggggggggggggggggggggaaaaaaaaaaaaaacaccccccccccccccccccccccccccccccccccccccc

SEQ ID NO: 27607 - DNA, 1023 bp, Heterodera glycines
cccccctccccttctcattacattgcatttgcatcgcatttgtgacaagtcgattgcgcaccgtcaagaggtcggcgagtggagggggggggggatgggatgccattccggaagcaaatctttttgtgccgtcgtcgtccgtcggcggcactctttgttgtcccccgacccctcaggagaggattgttatccacaaaaatggacagaacgacaaaatggaaaaactatttctttttgatgaaagacgagaggaagtggcacttttcacgagtacccagagaagaaatatacaaaacatttatatattaggcgaaaggacatcaaatgtcaacagattcgaccactccgtccccctcgcccaatttaataaaagtattttggaagaaaaaaaatagaaacctaaaggcatacataaaaaagaagcgaaattttccggatttaagaattattggataaaaaattggataaatatttgttttaaatcaatttaacgaataagcgaaatttaccacaaaaatttggacagaaataaattttcctgttggaaacatattttaaattaacttttttaaagaatttttgtggatgggactctcaaaattttgagaaatctcaagcacaattaagacgcaagaagcaataaaagaatttttgtcgcaatattttttgaaaattgtgtatgaagtacgcgctactcacttctgtatggtagttgaataaatataaactgttcgagagtccgcttctcctgtagcgcctgtgaagggatcatacaacccagtccagatagaaaagcctcggtctctagtttttagcatggctctgatgccgattccgaagtgagggattcctcttttgctgctttgggtgccattatgaaaggcattggggaaaaggccttgggctgtttcatttcgcccgaattggccaaatgctcaatgacaacaccgatgagggcaatccgcgtgctccgcgccggtcacattttgttggcagtgatggactttcctcagccgtttcgta

SEQ ID NO: 27608 - DNA, 1244 bp, Heterodera glycines
atcagagttctcacactgattagtaaggaggctaagccccatctcaccactcattcagcactgattgaattttgagagaaatttgtgattttggcagaaaatttttttattattataaaaatttgacggggatcggatttgaaaagtttttgctatgttttctgatcagaacgcacactcatcaaactgcttacttgaattgcaatcagttctacaatgatattgaaaaaaaaagttagttggacgcaatttattttttcagggaagcataatatgacatgggacgcataaaaccgactagaaccttaaattattatattaggatgatggatcagtcaataaccaattttttggcacgcatttggataaaagcctttctgatcagagaaccgagcccaggaatttctgttttaataatatattattagtaataatttattactaggggccggatttattggacaaaaaatccaaaatagaaaattctaattgcgttcttatgtttagaaatgtgtccggtattctgcgtgggtttgatccatttatgaacatcgtcgttgaagattgtattgagcacctcaaggttattattaaacctcaaactcacttcttttgttataatttctgtcatttaagattttccggcgttatttacaaagagtagtattaaaaaaaattttaggccaaaaaaagtgaaaaatgttcaaaatactactctttgtaaataacgcctaatttcctatgctttttgaaaaactcaactttttggtgtagaaatggcagtgtttttcactattataaaaaggagccatacattctctttgtccattttaggactgttggaaaacactttaaaatatcttgttttaagaccggcgaatcgcagagcattggaatggttgttgtccgtggcaattctgtcgtcattatggaaccgatggagcgaattgggtgactgtcgcagacagaaaaaaattggcagtgatcattggtctctagctttgttaattttactctttttgttcataaattttgctttaatgggagccactttttcgaattaatctgggaaaggccgttaaaaaatggtcattccatggttttttccctgggcccttaatccgtttttccccattcttaatgtttgatgtccaccatttgcctcgtgcgctcgtcaacatgttcatcagtgcgactaccaaacggtcaaatgattcgttcacatttttcaattcatttttaat

SEQ ID NO: 27609 - DNA, 981 bp, Heterodera glycines
cacatcacccggagaaaggcgggaggggaagggtccgggcgaatttgctctcccgcaaattcgcaattttccatcaaatgatcgccgattttcatcggctgtccgccttggtgatgtgttgtttcgcccgtcgcaccgcgatggtccgatcggcgtttttgcactgcctcgggcgtccttcacgcggagaaggcgccacatccgctttttatcgctttccttcccctctttcacgtgctcgcctgctgccgtccctcccttcgccccctttttgtcctcccttcccttcatcatttcccgtttgccccatttttcccatctttccatccattcatcactcctcgtttgctgcttcgttcattcctccccgttctcctcatttgtccgctcaacggacattcgcggctgacgttcagtcgcgacaaaagtgcgaacagaaaggaatgctcaaaaaagaaatgtttaatcttcgaacagttcgatttttaaataaataattcatccaaaaaaatagatattatttgtttttaccctttcattcagaggcaatctttggcatattccttatgttcgcagaattcaagattgagttcgagaattggataaaagcacaaaaatttaaattgcagaaatttggataaatcgaattaacagaattcaagcataaacttttaattaaaagatttaggatctagataaaaagttatttatatttttggaattatatctatgaattaaaatctaaacctccacactatgaaattaatcaagcaataacgtgctacagcatgaaaatacaaaaacaaaattattacacacaaaaagttaaaaaggaatatatgaggtaaagaagcttattaaaaaacgaataattgtacataattcttcaaaatatgagaacaatcatgtttaattcaaaacaaaaataattctaaatacccaaaaataaataattcaaaaatttttgaaatgcattaataa

SEQ ID NO: 27610 - DNA, 1303 bp, Heterodera glycines
  misc_feature (67)..(67): n is a, c, g, or t
cagcgctgtgcgcttttgctaatcaaaactttcaacccgatttcccatcataaagcattctcagatntcatctttcctacgtcagtgattaattgtttttttttaatacaaaacttttcagttttgtcctctaaaatggaattttttctaaatattttaagtttctgtacatgatatgtataataaaattaaagaaataagggaaaatcaaaaattcttagggtatagaagaaaaagaaaattttttttaaaaatttatcaatccagaacattacttagttcgaattatttatcattttttgaaattttgtaacgaaaattaaaaaattccacaaaattttaaaattcaaatgaattttattgagctagcttccttcaaattttaatttgaaaataacttgttaaaacatcggctcaaaattaattttcgattttcaccagtccaattggccccaatgctcctttttttgacaaattccatcagcgtttttctttctttttcaactgcctgccccactcatcaaaaagcgtaccgccgccctataattacacatttattaatctctcccgcccctccccccggggggaaaacaattttcccatcacattttgcaaaaatttttggtgctttaatgtcaaagtccaaatgtgggtgtgtgtgagacttaaagggcctattgttcattcacacttcggggccccctaccccgcccccgccaatttcttaagagacggcggtggtcgtcgccgggagggattttcacccttttagccccccccggccctcccaaatccatatccccgtcatttgtgggtgcccaaatttaacgagaaatgaatgggcgagagttaatggagtattagtctaaattgatttcgatgtttgagttggggaagcggggacgaacgaagcggggaaccaaaaaaggctttgatttggattgggtcagttgattgcgagatataattgatcaatgatttgccgaatgggttgattgaggaaacaaaagctgcaactgagacaaactggggaccaaaatacggggatttaggaaaaaaggggagacggggataaaacggggttggagaaaattgatcatttgggacaaaaatttaagggatggggggtggggaaattcgacctactcccgcgccaacaacaggtggaggaacggggcggcacaaaaaaaaacagggagaggtactggaaaaaaaaccaatctcgaatcgatgagacggggaaaccaaagcggggagacggggacaaagtcggggaaaggtggcacaaaaaaaacacgaagat

SEQ ID NO: 27611 - DNA, 2209 bp, Heterodera glycines
ttgaaaaaaaatcatcggctgaaattattgggaaagttaatgttcttttcctgggattgggtacggatttccaagccaaaatatagtaacttcccacccctattgttctttacaatattatatattcattaatgcatttctcgggagccataaaaattaaataacccgaatttcgaaatgaatttcaaaaaaaagaaagaaatttcctaagtaatataaatgaagggaatgaaaggaagaaattttaaaaatgaagacggaaaagaagttttgcttgaattgacagggtatttatatggtggaatgtgggcggagtcaggacacgctcgcgagtatttattgagtggaaaaggggcgggcctgagcaagcacgcgtgcgtgtcgagcgctgattggccgccgatgggctttatacagtaggcaacccgttcgaccatgcgctgttcgtccttgaaggcaagcaaggacagttcttgacgtttcggcatgggaaaattagttacgaggatactgtaacccctgtcaatccttgtcattgttgtgagtaatagaaaaagcatcatttttaccaaaaaaatgtacaaaaaaaaaagaatttgtaaatttatcacttttggattttgcacaatggcactcgttatgccggtatggaggcatacctgaacaattattgagttagaccaagacaatttgctaaaaaaattttctattccgccatctcatcagttaaaaatttgcacaaaaactgctcaatgtgtaccacaagggatgggacaaaaattttttcgaactttttggtactgagtcggcaatttaactgtacataaaaaaattctctactgttgcccaccattcagcctcttctcgattacatgccgggtcatcgcttgtggttcgactgttcggatagaccaggaagaaataactgaaataatttttttatttatttatgggatgcggcatggattcatatttcatacgccaaatttattcaaccaccggggacccctctcttaaaccccaaaattttttttaaaaagttgccgcaaaaaatggcacgaaattcaaaaaaaaaaaaaaggacgtcacccggaggtgagaccatctttaagctgaaatcctgggaccgtccctgattgcagtgcccctgctagagagaatatacctgatcccgccagacagaaaatgtccggtcttgaattggccaatattatgaaatcccaccccctccctaaaactctccccccccctccggtgttcatggcagttcgtacaaaggcttagaacaagccaagctttaggcttaggctttattttattgacccccccccccctcccgccgcgcccaaaaaaaagtacaggcagaaaatgacgaagaagaagaagaacgacatttgtgtgacccaatgaaagcggcgcatgaacgacgcggaaaactcaacattgccaaactcgtcgaacatgccgaagaataggcgtcgccttcagggagggaggggtgagggagggagagggaatagaaaattttgaattttttatttttacaacttttccctcctccgccagtggcctaaaatgccggcatcgagtgttgttgttgttaatgcatcagaatcgctggagctgtccgtgttcaactcaatgccaattcgaatggcattcaccggcgagcattgatagttgagaaaggattttttttattttggtaatcagggtgccaatcaaatgggcacttaaaagccaatcaaatgggcacttaacagccaatcaaatgggcacttaaaagccgattggcttttaagtgcccatttgattggcttttaagtgcccatttgattggcttttaagtgcccatttgattggcaccctgattaccaaaataaaaaaaatcctttctcaactatcaatgctcgccggtgaatgccattcgaattggcattgagttgaacacggacagctccagcgattctgatgcattaacaacaacaacactcgatgccggcattttaggccactggcggaggagggaaaagttgtaaaaataaaaaattcaaaattttctattccctctccctccctcacccctccctccctgaaggcgacgcctattcttcgttatgttcgacaagtttggcaatgtggagttttccgcgtcgttcatgcgccgctttcattgggtcacaaaaaatgtcgtttttcttcttcttcg

SEQ ID NO: 27612 - DNA, 2090 bp, Heterodera glycines
  misc_feature (2078)..(2079): n is a, c, g, or t
cgaacaagccagactcgacagcctctcggatggacatcagccgcattgtggacggattctccacgcatttctcgtccacgtcgaacccttgggcttggagcagtttcaggaagtcggtttggaagtcgacaagcgctagcgggtccacgtctgagcgtgcgcgtgagccgcgcaacagcgaatcactgccatccgaagagcggacacggacggacaggctgggctcgggtgcacgccgggtgcgcaccacggtctcctcatagccacgcgggcggccagtagcaccgctcgtgccgctaagcgtgtcgtagcctgcgctgctcatccgctgcagggtcgagtcatccaacggctccagccggaatttgtagccctcaacgtcgcgccgcttcaacgcctcgctgaccgcaagcgctgcctgcattggcgagccgatcagcgcgatcagtccccgttgaacagcctccttcagcggcactgtctgcgcaccaacggcaccctttgcatgcttcggcacgtagcggccgtgcgagtcgatcaggtccatgctcagcgcctcgcgcaatgtcattgttttggacgagtccaagtcgtgcagcagcgagtccgggtcgaccagtcgctgattgacagcggcgccaaacggcaggtaaaggcgcgtctgcgggtcctaaagggaaaagtaatcagtcagatataaaaatttagaattatgaaaagggtacatgttctgctgatcatcatggtctgatcagaaagaaatattaaaaattcattcaattttttcaaattttcaaaaaaaaaattcatgaaaaactttgaaaattttaggttccaaataattcttaaaaatatgaaatttgaattttcaattaaaatttataaattttcgagaattaatttagtataaacataaaatttctaaattttttttggtaaatttaaaatttttgaattcatggaaaaacgattcggtggaattaattttgcactcagctgatcagttagttcaaggaaaaatttgcgacctgtactcgtcccgatcgctcgtcaaattcttccgattggatgatccgcgccaggttagtcgccgcttcggctccgtctgtatcaggcccactgattgaaccggtgtcgatcagtccatggctgaccgcgtccgcaatgctcatctgccgcccgctttctgcgtccgtgaacgtgccctgcgccgcgtcgatcagcccacggctgaccgcctccacaaaagtcagtttgtccacgcgctgcaactgctccccaacatcgcgaggcagtgcgccttcgtcaacagcctgtttcactggcacaaccctgtccggcgacagttgcaccgtttttgcacgtgggtcaatcagacgggcatcgaccgcttgcaccaggttcagccgccgatgggtacggtggtcgaggagcgcaggcgttgtcagtgagttgaacgtttgtgcgtcgatgatgccacgttgatgcgcctcctccagcgacagctgttcctgcgtgattgggttcaagtaggcaactgcacgcgtgtcgatcagtccgtcagcaaatgcactgtaaatacaacaatggataaatggaaaaaaacagagctgatcgattaaaatgtttgatttgattcaatgatcaaagggcataataggaactaattgatcagttattttcccgtccgctcgcctcgccagctcacctggccactgagacggcgtaacccttgcgcgggtcgtacacgccgttctgcgtgatcgcactgtacaccttgcgcgtcaggtccacccacgagaggcgctcgccggtgaacggatgccgcacttcgcccgttcgcgagtcaacaatgcccgcttcgacggcacgtcggacgctaactttctcgccggtgcccggatgtacaacaccgttgggcaacgtctcggccagcgtcacgtccacaaggccttggtttgccgcactggccaagtcaattgcttcaccagtccgtggatggatgtactgaatggcaattttatgactagggttaaaatgggattaaatgaatttgtaggatttttttcagatttctnnatgactctaga

SEQ ID NO: 27613 - DNA, 1498 bp, Heterodera glycines
aactctatagaaaatgtgttatttatccataatataccttactagtaggcaaaaaaggtataggcctcaaagcccgttatttaatgataaataatttccatactccctccattctttctatttaatctattattattaataaattttaattgtatcttgcataacattaagtcaaaaatgaattgaagttgcttgctacacatataaaaaaccaaccaatgttttattatatacagtttttagttgcttagatattaaattcaatcttctaaagcgttgatttacattcattttttaactctaatcacattctatgtacttaaaattaatctaagtccatttataaaataatttaaaaggaaaagattaacgaaaagtgtttaatttacagataaataaaaattattaaaaaaaagaaaaaatattcccaatttgattatctataaatttgctcaaagaaataagtataaaattgggaaaatgtctccaaagtcaacataaaatttaatttcttattgacgaaaattgtgattatgaaatttcacaatatttaaaaaaataagaaatttaaactatttcgctcaaaatataatcttattcgctcaaaaaaaaagaatatctatttatttttataataattgatcgatataaaataatttactaaatataatttaatccatatacaattttatatgtgttgttacttttttaaatattggcacagcaatttttggtataaaacaaaattagttaatttattctaaaaataataattataactgattgatgattactgatggaaacattgtgttggactttttgacctttattttattttttgtatttgtttggcattatgtttaattatttgtgaccgtttttttcccaccttttcaatgattcgaatttaattgtattagttttatgttttgtcttctccaaaaaaaattgtttgtgtttcttttatttaatttggaataaataaactctctgaaaagccttgacaccttccttgaatcccaaccaaaagtagaagaaaaatctcatttttatgttcttctcgcaaagtaaaagcctattttttcacgattttttttatcttttaggcgtgataaatgggtttttccgattgcgtactgccttctcacttcagtcataccatagaaaacttcaacgtgcatttgattgttcacatccaactgtcttctgcttcatcaacacaattcgatgtgagcaaaaaccaattgatgcagacatcgcccaatgcgtctccggtgaatccctcctcaaaaggcgcccaaatatcgtgccgccgatgcgagaattcttcgacttttgcagggctacaatgccatcaacaataacccggctaaccaaaatgaccacaattatcatgccaatgtcaatgttaatcccgataacatcaatcatcttctagttggtgtttctcgaaattatgaaatgtgcccgtaattttccaatgttttattattttttc

SEQ ID NO: 27614 - DNA, 1196 bp, Heterodera glycines
tccacgacggaattgtcatgttttcgttggtcatattgccgccaaattcaccaaattcacaacggcattcgtaatcttggcccctatttatggaccatttttccgcaattgccgtgcaattattgctttccaaacaaccccaagcaatgttgccaccttttttgtcgtctgtgtctgtaagaattgtttggatgacaaaaaacgacagaatgcaaataatttttggaaaatttacccttcatttcgaaaaattatgtctatatttttgcaatttttgtacatatttcggcttttttggtctatattttatggtcatatttctcgatttataactagggatgggaatttatgtcagaaaaatcgcgaaatacgtaaataaaatatgaataaaaattcaaaaatgtgtataaaaaatttttaaaatgcttattttattggaaaaattcttcgctaaggatgaaataggcaaaaattgctactaaaatgttctaagcagacttagaatcacatttttagtattttaaaaattaatttttgaagtctcttttaaaaaacgatttttaggggtacattttcaaaaaattttttgtttttgcgggtctaaaaaattcctattatattttatctttttcttataatcattttaataataaaaagtagatttaaaggttctttctacctgctggtttacagatggcaaaacaaaactgttcttttttgttgcatttatcaacaccaagaaagccatatcccttactattaaacgtgccgcgcaaacatgacaaatctgttttaaaattaattaaataattcatcagcttaaatattaatctgtgcctgctcgaatttgagcaaagttgcaactatattgacttatgataaagttaaataaatttaatttgttttggaaactttttatgttttcttcccctctatagttttattaaatccatacatccttgggatcaattgaaagcttaaagtctagaaaatacttgcattaagaaaaaaattgtaaagaacaaaactgaaattcataattttcgtgtatattcaacaataattttttgtttattgcctttgtccgagaatttttttatacaaaaataactgtgggctttaagcccccaattgataccaagaatgtaagttttatccaagaaagaaaaaagttatgacttaagaaaccgaggata

SEQ ID NO: 27615 - DNA, 1260 bp, Heterodera glycines
  misc_feature (67)..(67): n is a, c, g, or t
  misc_feature (93)..(93): n is a, c, g, or t
  misc_feature (97)..(97): n is a, c, g, or t
  misc_feature (102)..(102): n is a, c, g, or t
  misc_feature (1232)..(1232): n is a, c, g, or t
ctaacatttggtaattaggcgattgaacaacagacaacttcactatgtttgaaaatttgtgaaattnccgtttttatgccttaggaaagaagntgantgganagttacaaggttgaaaatgggattgaagacaaacaatttgcccatttcttattttttaagccaattaattaattgcttttttaattacccgcttctttcgccttccccgtggcatttgttgtgacaaattatttgaatttaaatattcccacaaatgggcgaaactataatcagaagggtaataattattcatttgctcttcaacggcaatgccaccactccccaaatggtcatcaaaatgggccatgtcgcgtggcatgtgccttaattaattgcttaattaatttgtttttttgtccttttcaatttacaaattgccaatttttctttcaatttcgtttcctcctttcacctgctgctctgtccgctgttttcttctcccattcttcctcccactttcagtgtttgtccgttcaacattttggccactttttctgcgtttttatcgtccaaaaatgttttgtccaattcgtatgcaaatttggcttcttcccgttcattgccattttgaagtaccggcattctaagttcggcactgaacagcgaacgttccttgggctgactatccgcggcaaattcagcttcaaaaggtttgttttgtttggttttgattggtttacggcattggggacacttctctggcagctgatcagatgttctttttgtttttagcctgattaaatgagaaagagcattacaccctaaaagagaggaggtcccaaatgctaatggattatgccactgttttaaatttaatttaccattttttgaaacaattccgatgagcaaaatgctaaaaataaacaaaattataaaaaataaaaatatttttatttttattttgacctcacaacccgccattttcagtgcatttttttccttttctgagaattcatcaaggcaaaaagaacattcattcaatatctagtaaaggacaaataattttgtaacaattaattagttaaagcaattaattattatttaaagcaattaataatttaatgaattaattgtctcttaattggcccaccatttcgaccatttccatgcgaagtgtcggctccgtttgccgcactcttttcattcccaatttgttcagctccaacttcagtccgtcctcctccatttcncgtcgtttcacttgtgccacaatggttg

SEQ ID NO: 27616 - DNA, 1350 bp, Heterodera glycines
ccccgctttttcaggctcttgacttggcaaacgcggagattgtcacatttgcgggaccgcagccggaggatgtggcaaagattttgcgtatgatgcaggacaacttgcagttgtggacaccgaaggaggtggccaaccaggcgaagacggacggtgattgaagtgccgaaccgccgaaggagggatgaacagcatcagacagacaataatatgtactcctcagattgtgcccgaagcaatgatatgaaaatgatatgtttttctaaatttagaaataaaacgatttgccattttgggtgccattgccaagagtatttaatttttaatttccaataaagtgcccttctcctcctcctatctctctctccaccacttcttttggcacttttcttctcccaatggtcatcatttccatggaaacagaaggaaacccataaagagagaaggaaggggtcagcaaatgcctgctggtgaacgctgcccgtcaaaatcccgatgcgtcgaaatcccgacgcgtcaaaatcccgatgcgtcgaaatcccgatgcgtcgaaatcccgactaagccaaaatgagtcataatcccgacaaattaaaaaatataaatttatttatttttgtacatctatttacatgtatattatatattatatatataaatatatcataatagccttataaacaaaatgaatcgaaaaaaaattgaaattcttcaaaaatgtcgtaaacgcaagtttctgaacaacaacgacggtgaaaacgcgacaacttctgaacaatgtgagcataacgacaacaacaatgaccgcgatgaagactttggagaagaacatgccatcatcaaattcgaactcggaaaaactcaaaagggaggcaattgtctttggtccgaaggtgggaactcatttaggcgtactatctcttcaatttttaatggaaaaaacaacatttacttcacatcctgtttaactttttttttcggcgtgttaaacccacaccaaattttacatagagatagagaaaaaaatatataaacatttttaacgctcgaagaagaaatttaaaccaattgaaacccaaatttatttttgcatgtaacaaataataagtatatggaataaactgaatttgtaaacaaaattctttaaaaatgcataatttttaatttgaacggctgacatataaatgccaatgacaattaaacaccaaattagcacacaaaatgggctacaacaacaacaacaacaagcaataataataataaacaggcacataaccaaaaaaaaaggtcaggaaaggcccaactcagggaaattttgttttaaaatgatacaatgtcaaaatatacaac

SEQ ID NO: 27617 - DNA, 1155 bp, Heterodera glycines
  misc_feature (170)..(170): n is a, c, g, or t
gggaaagaataagggacaacaaaaagggcggtggcgacaattaaaagccttatggtcgaaaaaaatcatcaactgtgcattaataaagcatggaaaattttgcgaaaacaattcggaatcgcagacatcgtcattcaatttcaccacaattgattaaaaatcaagaaaantcatttaatggagaaaataaaagttcgcagagtttataatcaaaaattaataaataagtttatatattttatatataaacattaatgaaaaaatattacgcctttttaccaaaaaaaaatataaacaataaattaaacaccagcttctaataaaaacgaacacttattacgcctttttgcaatattttccatttttcgatgtatattgatatccctaaaaaagtgtaaaaacaaaacaaaaatctgtccttttaataaaatagcaattccatcaaatcacaaattttttgtaatatttcaaactggaaagaaatttatctataaaaataataattttattgaagcagacgaagttttaccttttgatctgacaaaggcatttaacactattattatttttttaaacaggtaatatcataaaataatgttttgaaatagtgattaaatataataatttattatttttgctttatttctttatatctatttatttagtatgaaaaccttaaagttatatcattttaattgttctaaaaataatcgatctggcagatttattgcggccatgctttggtttattgatcatgtttataagtatctgaaatatttacgacaaaaattaaaaattaaaacgaataaaatttattcaaacataattttttgaagacaatttgtaagaaatatgagtgtgattttacgtttttaataaaataagaaaagtttcttatttaaagaaaagagtattaaacataaaattctcaaacaaaaaatacctaaaggaatcaaaatagagcaaaatttgataaacaaaaatcagttttatgaaaaaattaaaaattatcttttttaaataattcatcatatttattaaattttcgaaaatagcttaaagtttttgtctattgcactaaacacctgatagtgtacggcaaatggcacaaaaacactcccattattaagaacagcatttgccacgttcagtgat

SEQ ID NO: 27618 - DNA, 1278 bp, Heterodera glycines
  misc_feature (55)..(55): n is a, c, g, or t
  misc_feature (120)..(121): n is a, c, g, or t
  misc_feature (128)..(128): n is a, c, g, or t
  misc_feature (133)..(133): n is a, c, g, or t
  misc_feature (195)..(195): n is a, c, g, or t
  misc_feature (234)..(234): n is a, c, g, or t
  misc_feature (1193)..(1193): n is a, c, g, or t
tattttaaatgtgtaaaaaatgcaatggtctaattaaaaacatagctaattcatncgagttaggaatttaagttttttacgaaatcgtccactaattaaccatgtttattttgttgatcnnatacaanttctnaatatcaatgtcaatgtatatttgtgtaataattaaaggctcagtctgttaagacttaattnttatacgaacagaaacttgaacacgtctaaccctacgtntaaacaattgtaagaataaaattgttgtcctgttacctccgaaaatatttgtggtcttcgaattgcttataatatttcagtctaaggttagattgtccaacaatttatcgtccttctacgtgattccgaagtcatttttctatttgatttaagaaaattggattttaaatgttgccttttgacgctgccataaaatttgagtcatgtgtaaattttacataaaattattccactaaatttgaagcaaatttaaagaaataatttaatatgggaccaaaatagaaatgaatctttctaaatgcataaaattaatgagttaatcattggtttttaaagctaaacaaacgtgaaaaatctttcaaaactttttttctccaaattttggctttaaaaggcatttgcttacaattatttaatttgcattctttcatttgtttcccaccacaaattcccatccattatcgagccatgcgtgctttctcttctccatcctggcccatttcatgcccaatttttctgctgctcattgtcctacaaaattcgctgttaattaatgctttcttcggatggggtggttgtgaggacgaaacgcaaatcggagttgcacaaattattggacaaaaacaacaacaaaaagaaaaccaagaaaaacagcaacaagaacaagaagaaaaacaaaaccaagaaaaacagcaacaagaaaaacagcaaaaagaacaacaagaaaaacaaaaccaagaaaaacaaaaccaagaaaaacagcaaaaagaacaacaagaaaaacaaaaccaagaaaaacaaaaccaagaaaaacaaaaccaagaaaaacaaaaccaagaaaaacagcaaaaagaacaacaagaaaaacaaaaccaagaaaaacagcaacaagaacaagaagaaaaacaaaaccaagaaaaacagcaacaagaacagcaacaacaacaacaagagcatanagacacacaatatttcggcaacagtgatagccaacacagaaacacgacaaacacttcagcagtacgagcagtacatcaaatctct

SEQ ID NO: 27619 - DNA, 866 bp, Heterodera glycines
tgccgggaggggggggggaatgggagcagaggacaagttggaagaggaaacactgccgaaagagaggacgaacccaaagtgaaaagccaaaactgataataaataattaatgcgtttggggtggcgttggactttcattggcaaaagtgacaaaaccaaagggaaaacgaaacaaaaattggacaaatcagcagcaagtgaaagtgatcggaataatgcctaataaaataattaatggaacagaaaatcgttgaattaaaaagcgaccgatgccattgaaaaatgccaatgatttactgatcgaatcattcgattgaactcaatcatttctcatcgaaggacaaactttggcatttgagcattgatttgtgagtgccattgcttctcttctctctctccaatctcatcatttgcttttgttttgtcctctcattgttttccattgtctcattaaatctctttttgtccccccccttggccatttttaattatatgtctttaaaagaattgacgttattaaccccaatttatgaaaattcttttcttggcattacaataattcttaaatggcctttttaatatttttgccaaaaaaatttaaattgaaattttaagtttgtcccaaaatgggcgaataagcgtcctactagtcgaccatgcatttttccaatttgacgaaaaaatcggggtccaaattgaagtgagaatggcaaccatttgctggactaaaaaagtcccgcgaataaaacactaataaatttttgggaaataaaaaactgcaaaattaaagagacagcccgctcagaatgattggcacaaatgccactattgaccacccgatcccaaaaatcccccacaaattattt

SEQ ID NO: 27620 - DNA, 1142 bp, Heterodera glycines
aatcctcacgcgcacacacacatttgtcataattcatgaggaaaacaaatcacaaccaaacggaaagcattttcatgtatcgatatttatttaaaaaacgaatgctttttaggctggcgaaatgtccattttttattattatcatttaatcatttttatggcaattattcatggccaaatggcagcgccaatagtggccgaaagctacagcagcgccaagcaacagcggacagaattcaattatcaacaaaaattgcaatcaacccaacccaccaacaatgaatgtaaggaaagctaagcattgaaaaatactagctactgtatgctcatttaatagtgccatttttcgtcagatttggcattttttgaaaaaattggtaaaaaaactttcatttttttgtgcgctttttattattttttggaaatttatgctcggtaatatttttcaattttctacttaattttatcagatttggaaaattcaaaaaatattacttaaaaacttgaatatttatttgaaaataaatgcttcataattccgatatttttcaaaatatttccaattttttcctgattttttttgccaccaaaaaatatataattagtttggttaggtcataaataaatagaaggaatagcgttgagtaataacacaaaaattagttgcttaaagccagtctgacgtcatccaaatgcattcccccccccctctctctctctctcttatctgatcactctgatcgcagattctacgccatcattgacgttcattgaacaaatcgggcgaatggaactggttcagtccattgttcaattaatggaaaaaattggcttaggaacgggcgaaaataataaaaaaagtaaaaataaataaatatgaaatctaattttttttaagaaaaacagcgaattgagcgccgaagtgctacaaataaaaatttgaaagaacaacacagggaaatttttggcagaatggtgagacatttgggcgcaaccgtatgggtgccgaagaaatataacacacgttaccaaatccaacaaacatggaatcacccggaagctcttaattagcattattaagctctcaaaaatgacaaagcattgcaggcatgtaaaaaactgtaaattataatatgcaaaaa

SEQ ID NO: 27621 - DNA, 1645 bp, Heterodera glycines
  misc_feature (62)..(62): n is a, c, g, or t
gatgatgccatttccaagggcattggctgggccatttccaatggcatttgctgtgccatttncaagggcaatggcattggctggggcattttggtcggtgttggcttatgtttaattattgtaactttgtcatttcaacgggcatccaaccattaccacgggcatcgatgatgccatttccaagggcattggctgggccatttccaacggcattggcattggctggggcattttggtcggtgttggcttatgtttaattattgtaacattgtcatttcaacgggcatccaaccattaccacgggcatcgatgatgccatttccaagggcattggctgggccatttccaagggcattggctggggcattttggtcggtgttggctgatagtttaattattgtaacattgtcatgtgccatttcaatgggcatcccatcattaccacggacatcgatgatgccatttccaagggcattggctgggccatttccaagggcattggctggggcattttggtcggtgttggctgatagtttaattattgtaacattgtcatgtgccatttcaatgggcatccatcccatcattaccacggacatcgatgatgccatttccaagggcattgactgggccatttccacgggtgaaaattggcaacgcaatcgagaggatgaaaatgatcatgtacaaatcagttagggtcctcatattgtagttcaaatccttaaattttccttttcaattagattcgaaccttatttctaattgtacttaaaatgaaaaagataattgttttttgggtgttattttacagactgctaaattgttgtcgctattccatcggaccaaaccaataaaatccgaaccgaactaaaaaatgattgaatgaatatgtaaagggagtgaaattgagcagaaattttcgaattagtcatcccattttcatttggatttattctgccaaatgatttttctgtgattcactgggaaagcgatggtttggagcttcggttttatttttataatggaaaatgcattccgattaataataaattttagtaaagaattatgaataaaaattattttaattttgaatgaaattacataaaatttcagtacttataggtagggcttacatttttaggctttttcctgagttcccattggtctgaaacacacgaaaaccatgtttttttcgttggttgtcaagcaacttttcgaattatttttccaaaaaacaccttcaagattttttatttattttctagacaaaatttttcattttaaaattttatctgaacactggtttggcttaatttagttgcttctggataaaattttagtattttactccctaagcctaaagcctacctattttattctcgaaaaatttttatttgtcagtgcgcaatgaaaaaaaattgttaatttttatgcctttttccaattttttgtagtttttgtacattttatgtcttttttacctttttctaacgtacatttggcagttcgtacaattgacagtcagtagcagggataggatttatagttgctaaaaactagagaattttgaaattgcctggacctggacttggaaaatgaaccgtgacgggatcccgggaccgggactcccgtttttccggga

SEQ ID NO: 27622 - DNA, 1311 bp, Heterodera glycines
ccttgtttcaggagaggctggtgcccccggacagcccggtcagcctggagcccccggtcagcccggcgcccccggacagcccggcccgaagggaccccctggcgcccctggacagcccggaaacgccggaggcaatggccagcctggtcaacccggacagcctggcaaccccggagagcgcggaatctgccccaaatactgtgccatcgacggaggagtgttcttcgaggacggcacacgaagacgttgaaaaggcacgaacagtccaaatgcaacaggagaagaagcggaagaagaacagtcactcccccgccccgcccctctccccactttccggtgtccttattgttcttattttttgtagtttccccaattcatccaaatttcgtccccaaaaaactgccatttgttccctccttcgatgagaagcgatcagtgatcactatccgaaattgcaaaagatcagcaaataaaaaaggatagcacgaggataaagcttttttgaaaagaaacggacaatttaaatgggaaaagggaaaagccaaagaaagcgaaacaaatttaaaagtaaaattagcaagtgagcgaaaagagttttaagcaaagcttccgacctgagtatttaaactcaattagtggcaaagccttaagtatttagtgctttttacaaaagccctttaaattggccttttttgccaaaatcattaacgtattttcccggcatttcgttaccaccgtaccctccttatggcgagaaattttggcatttttcatttcctatgaatattttttaaatgtttttcatttttatattcaaatagtttttcaaagtttttagctaagactctgtttttaagaaaaagtgaaaacctttaaaatacaaaagaataaaagctattttatattcaaattaaatttctaaaatgccttccattttatggccgttatttaaataattcattgataattattatggcaattgactgctgctccctttttcgctatctttgccatttccatttttacatttatttcactatttttcaattttatttttatttttgtttttcctttttcatttccttccgtttgttcggcctccaaagttcgacggccattaaaatgctaaacaaatggagaaaaaaggcgatgaacttgcaaaaaaaagaaggaaattctcagaagtgatttgacgtggagggcaattggggggggggagaatttattgggcgtgggagggctcaaatttagtggagagaaaaaggggggaaagggggggaaagagagggggaaagagggggggaaaggggg

SEQ ID NO: 27623 - DNA, 2139 bp, Heterodera glycines
tgtacgctatgaaactccaagatgcttgaccgtccccgctttagaaccgtaggagctgcgggaaactaccgcgcaatccctgaggggcccggggtaaagcaattagtccaatgaatattaattaattttaattaagggacaaaagtcaaagtctaattaaaaacaaaaagagaattatgtcaaatcgtcaaaataggcattttgtgatacgtaaaagtcaaattataaatcataaggaaacagattaaattattctaattcaaattttatctatttaaaattacatttattagtgtaaatcggtggtgtgtgccgaagggtacaaatgcactgttggggcgtcggttgaaaaaattggtgatcgaccgtttgcccaatcagtctgtaagtaaaaaatctaacggaaaggtaaaatgaccaaattaattttataaaaaatttggctccaatatttagccttgccgcaatgcgttgtcaacggcggttcattaaaagatgtgagaacgaaaatccgaggcggaccaggggtaattaatgcaataattaaaaaatggatttactacacttatgggtccaatcaatgatcttttcttcattggtttaattttaacattaattggtatcaattggaagcttaaggtctcggaaagtaagacaatatgcattttttaatatatatattttcgtcttaatgagcttatttgttagaatatgattatttaaaagggcaataaatttcaagctttcaatgggtaccaagaatttaagtttttacaaagtaaaaagaaaaatttatggcacaaaaaaatgaggatagtcattgctttgacgcgtaaaagtgcagtaaagcctaaaaactaataaattaagatgattacatataattaacgggcaatttcattttctaagtgcaaccaacatgtgtgtcttcccggaaaaacatgtacgacctttacggaaatttttaaaaacggtcattttccgcttgaacaggtggtcttaacgaatcaatttgttccaatttataatttataaatttttccataaatttcctttagtatcttgctccattttgcttttgatgctgatgagcccaattaatgaatgaaagaggaagacgaaaatggaaggaaggaaaagggcgacggagaataaaatggaagaaaatgacaaaaaaaacaaatacctaataatttcaagcattaaaaaataataaatggaaggatggtaagcctaaagggcaccctccaccaaatttgatgattccggcaatgaaaaggcactttagttttaggcattaatctcggatctaattatattggtcttcctacaaattagcgacagatattttctacggtccattcattaaattttcattttttttttgaaatttgcagtttagagcttgtcaaattcatatgaattcagcataattttgaaaattgagtgtgattttgtatcattgtcaaaaacttgtccaatttggtgattttagccaggcggcgcctaacgagaaggcttcttaagaattcttctgcaaaaaaaaactgtaaaccgaattacaaaccaacattttttataaactaaaattaacgaataaaaagtaactagcgtaacaaaaacacaaaattgaaaaaatgaattaaaaataaacaaaggtcaaaaagacattattaattaattagatgaaattattgccctcttccgttgtttctattttcttcaaagagtggccaaattgatttggaaatcgcttcgattttatcaccaattctcagcaaagaaacgaatttaaaaataagtccaagtttatttttcaactgcttcccatttaacagcacccactctttgatcgttccatgatttataaaattattttgcaccaagtccctatataaattatttactcccgagaaattgtaataaatgtactatttccaaaaatagccgattgctttcaatccaaaaacgtttgtcactaattaccatttcatcggctaatattccatcgcagcagaattcgagtggcatgtgtgggggatgtgggtgatgagctgctgaaatgattgttgacaataaaggacgaagaagcaccacggatttccattggatggaaatgtggccgattttgatacgtca

SEQ ID NO: 27624 - DNA, 458 bp, Heterodera glycines
aatcgcattaaaaattacaaaatttttcccggcggcgcctatcggcacccaaaaccttatttttataaaaagttggctcaaaatcgcaaaaaattggccttttttggtgaaaatctgttaacaaatcagaattaaattacaaaaaatttttccggcggcgcctatcggcaccgccggacccctcccctcgcacttcccaaaagttttttggaaaaatgcgccgcaaaaaattgttaaaaatccaattttttgatcctgaatgcgctaaaattttatgatttgctaatttcctccccaaaattgttaaaatcgttaatgggagacaaaaatataatatttgatacattattgatcgaataaattgtaaaaataactgatttgaagcaattttgcaaaatgtccttattttggacccaaaaatcttattttttggccttgatgttcttattttgaaaaat

SEQ ID NO: 27625 - DNA, 922 bp, Heterodera glycines
aagacttactgtttaaatgaactttaaaatgactcacagagctactgaaagtgtgaatttagtcaaagaaaaattcttccgccaaagttctttttaagagaaaaagaatggtcaccttttccaactcttccgattttcagaaactgaatatttaagtttactcaatgctcaattggttcattggttacttaaaatgaggctttgaaaatgcttgttcgactttgactatctttcccccacccaaaaaggaccgttttattccgccacttccgttgggtgcggccgaacggcgcctgacattgcgccaactgaataagttgattgaattccatttggcacaacaagcggcgcaactgtcaccacgaattcgacacattactgtacaaaacggaatggtaatttgcattaattacaatttctgaatttcctaaaaagtgttgccttcttcaataaggcttctctggtggtccccggagaatttgaaatggagctgactcggctgggcgatgagccgaccacccggtggacccttctgaacatccgaattctcgtggaaagtgccgaagtcggagagggacagcaaatggtccatccgctgcaagtaaagaaagcagcgagaaaatagggcaatttacaacattttaaagatcaatttcctccatcaaatggtgcaggaaaaactcgacacagcaaacgaagtaaattatgggccaatatgtaattaattagacctaattaaagtgggtgtttggatttggcaatgcattcattcattctttcccacagttgttcctttcttttagcccattatggcggcttacattgttttgcattggttctgtcgctctctccatttggacattctttttttgtcaggtcgtgttttttcaatttccataatgtttttttccgttttaggctc

SEQ ID NO: 27626 - DNA, 1077 bp, Heterodera glycines
tttttattgaattctgaaccgttttgagtagattagcctttaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattaaataaaaaaaatatgagtgatcaaactttcactaaaaagcccctttcccagggggattattttggaaacgcttttttttcccc

SEQ ID NO: 27627 - DNA, 733 bp, Heterodera glycines
  misc_feature (28)..(28): n is a, c, g, or t
  misc_feature (716)..(716): n is a, c, g, or t
taaggcttttaagggtccgacgggaaanatttcttgacattttaggctatatattaacagattttcaaaaaattaataattttaccaaaaaaactcaattcttaccagtgtatttttactcccgtatttggatcaaaatttacgggagcgggaattcgagatcttccgggagcgggaatcccgtaaaactcccgctcccgtaaaaatcccgttgggcaaaaaagtacgggagtcgggagcgggacccccgtaaactcccgccggactctagttattgtaattagcaaactcgcggcagcgatctcttgttctttttctgatcactttttggcaaatcaattttctgcttacaaatttttattgtattttaggcgtaatgggcgaaaaaagcattttttggggggtgaaatgatcaatttttgggtttttgattcataaaacttataaaattagtcatcctctcgacatcgataggcttcattacgggaaatattgcaaattttaacaaaatcattaatcaaaaatttaaacatttaaaaatgcaattattttccttcaatattttttattttcgacttaaaaatcaacaaaatactttctcatcaatgtcaacaatcactggagtttaattaattaatcaattagcgtttgtttaaacgatttctctcaaattgtggcacagaatttccgtccaaagtgccaatctcttcccggtntgtgtgtcttggtctca

SEQ ID NO: 27628 - DNA, 1471 bp, Heterodera glycines
ggaaaagtgatgctcactaccgtaatgaacaacggtaatttggggtggggggacgaaaataatagaaatcttgttcttaatcaaaaggattcgtcaccgtcgaagagggccccgccggtggctcacgaatccgcttcaaactcgtggacattggccgtatcagtttcagccgggatttgcccgtccacgacgtaaatccgattaaaattagcgtaaattgggatgccaaacggaggcaaccgaacaaatgccaaaggatcaaacgaaaataaaataaatgggaataaaggaactcggaaaagcatttttatttaaaaatctttttggtttggcatgaaaaacccattaaacttaagtatcctcaccaatttaagttggtccgcgaatggactcagttggaccacaaccatttcgaggcccgtctcgacatggaaacggcgagaaaatctttccttttttcccaatcagctgattaattggatttttagctaacccatggaatgcaagaacacacagtgattgtctacacaaaagtgatgtgagaagtgatcaaagcaatcagcagaaaatgttataaattatcaataatcaccgtgacaattatttttattattttaaatacattgcttatttttggaaaaaaaggaatttgctaattggaataaatagaacaaacattaaaaccaatgaagagcgatgcccaactcatccacagcggcccgcgtcgtggcaattcttatgcatggataaaatgattatactccgacaaaactgcttactttagacagtaatatctgaatacgaaacccccaaatccgacacactttccgtacatttccattcgagccctttcggtccaagttagcgcgtgtcctcgttttccaaatcctttatttggccaaatcaaataaaagtaacaaaggccgtgtcaacatcggttgatgatcactctcccccccccttttcaatgaatttgtcgcgttttcggctgattcgttctttgctgctcatccaatttcagtctctccgcccgaaaggtttctttgttcgccttcttttccttccgccgctctctccgttcttctttcaccgcaattttacgaattctccgctcttccgtcgtctcccccttcggtcgaattgcgctaattatagaaatgcaagtgcggacggacggcgccggtggcccgtctctttggtctccgtcaacttccatttcctaaagttgggagcgaattgtccggtgttccatggcggtggtcatttgtccgtcacctccaaattggccatgcccttctctttgggcgtcctcccccttcgcctcccaatgcctttcatcggctccctaatttcagtcggatgattgtaaagctgaatgaatttgaaaagtgggggaatgtcgaatgattggcaaatgctttgtttacggtggaatgcatggagagaatggactcgcaatcccagcggcttc

SEQ ID NO: 27629 - DNA, 1664 bp, Heterodera glycines
aattttaacaaaaatttttcatttaaattgtttttttttggagaaaattgtttgttttaaatttaaaaaaattttagcttccatccagtttttagcttatattttggcatttacaaatccgatccctttaatttacgtttaaatatttaatttaatttttgcacattttaattcatttcatagatatgtcgaaaccaatttcggatgcaaatgatttctatcgcgcaccaaatcaactgcaattaccaaaaagtgaaagtggcttaagtgttgacagttctgaattgaggcaataatttaaaaaattaatagatccggattttcgaattggattgacttaatatcacctaaaaataattatttcgcttttggcacatccaaaaacctattcgcatcaatttcaagtttttataactccatagttttttataacggataatatattaaaaagcatgaaaaagcatttgtccatcaaatttttatgagtttttaattaaaatttgaaaactaacattaaaatctttctccaagaaaaaaaatatataatctttcattactggagataaaagccgaaattaaaagtaaagtttaattcaattttggaaaaattccatattataaacaaatatttggcattttttttcgattttaagcaactaaatcccgtctcgaaattatttaagtcgaactaattttttttttaaatattttttcgtaaatatttagattatgtgagttttttaaaccaattttacattttttaaatattatttttttttaaatataagttttacttttattttgtaaaaaaggattaaaagaccaaaaaacctttttttttctccagcagtgggcgatcatcaccatattcaacaattgatagtgaagctgattttgctcgattagcggacaatatggcaataaaacggaatgccaaagtgaaaaacaaagcaataaaatatgccaaaattaaacaaaattgacagggtgatctaacttttaacaatcaatcgcctattgatgaagattcggcaacaatttgtgaggaaagtggcgaacgaacactgcaacggggttcaatttgttctggtaggatttttcttcaaattaaatcgagatttttaattttaattgattaaacttgctttactgtagcagaaataatttgccttactgtagcgagtagttttataatctcgtgtgccatgtgttttgaatgcttttgacagtaagtgaatttcaaagccaatttatttttggccgtttttcgagaagcatgaaagtgggtcaaataagattaaaataaatttcaaaaatgatttttaatgtcctttgtaatatgtataaaattttcacttttgaccattaaaaattgaatacaattacaattttcataatttttaaattttactatcgaatcagcaactgtcgaagtctaaccgtaacacaattttatttaaaaatatttccttttattcgattttttaactcagagtctgatcaagctaatttaccggcaaaacaacaacgaaatgcacagggtcaagtcgtcgagagaaagggtacagcattatttgcgcgaccattattaatggatgcctttaacgggtacatttaataattaacatggattaataatattaataattaattaaaacatttat

SEQ ID NO: 27630 - DNA, 1076 bp, Heterodera glycines
tggcatgggtttccctcccctgcgccgccccttccgatgctgtccctccctttccgcaaaattattttatgctttgcttgcataagtcttcccgcccggagaaggcgggcgaaaagggacgaaaattggctttgaagccccgaaaagcctttgccgaaaggcggggggggggggcgagggtcgcggaccgggtcccttagattgggctcaatattagcaattccccgctcaaaacgagattagccgctggcccattccctctgccgtgccctcccccccccattttggcattcccctctctcactcattcattcatccgtccaattgttgctgagttagggaaaatcaaaaacccgtcctaaaatgtcgaaattatattacccgccaccaaattggaagccgaaaccgagcaaaaagtcaggtgagtggggaaaagccgaacaaatcgaattgaacggtcgaaatgaccgacgggagagaaaattaagtcaaaaaaaaagaaaaagcattttgcattttcagccggacattcaactgttatggcgaccacacgagcggcaacttgtgagttaattaattggtcatttaaaagtaattaaagaaaaattggaaaatgaaaaaatcaacgattaaaacgacccattctgttctggtttgtacacatccgctgacaaaatgttgatcaaaaacaacagcaaacaaactctcgacaaaaaatgacatgacctttttaattttaaaatattttaatattttattacacaaaaaaacatttcaaataaagttaattttctttcaaaaaaatcattcgaatttgtctgtgtgattttggcacttttttctcattttatcagttaaaatgattgtcattttatcgggacccaattatgcttttccaccaattttccgcttctttgaatttaatcctttctttctttcttccatattaattagaaatgaaatgccgcctcacgcaaaggaaaattggagaaaaatatattaacgagaaggataagcacccctccgttttcgttgcattttctccattgcccccccaattgattcccccccccccc

SEQ ID NO: 27631 - DNA, 930 bp, Heterodera glycines
cccttgaaatttgtttttgagatttacccctcgttcccaagccaaaatggactgatcagatcaccatgaaggaagtgatctgatcaacttggtgttgttaccttttttgatcagcatccaaagttatgcttacctgaatttttttagatttttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtatttgtttatcagattgttgggaccgcaggtggcagggggccagctgaacgatgatggtgatgatgaagaaggagaggaggaagaggggtcggatgatgaatgaggaggggagaagggagggggcggggaattgtttagtttaaaaggaccacccgaactgaaattcggaaaatgtatatgcattatatagagcagggcttattatctattaaattttaattttagctgtgtgtgaaaaacccccaaaaaattatggggcctcgaaaattgagattttgatgctatagggcctatttacaacttttttttcactttcgaatgaaccccataactgattgacttttgcttattttcactaaacaaaattactatacattttttatgtctaaatttttttaaagggttaagttttcttcctttatcaaatttttttgtttttgtgtttgctttgcccggacttccaaaagatagatttaactatctatgccataaattctactcattttccgccaa

SEQ ID NO: 27632 - DNA, 1450 bp, Heterodera glycines
  misc_feature (1304)..(1304): n is a, c, g, or t
ttccaccagttcaccagaataaataatattaggcaaaggaaaatttttttccttcctctttaaaactgtttaaaaatttttgttgttaatattcagaaaacggttttttttttactgacaatttttttcaagagaaggatatgaacaatcacttataagggttcatgcttggagataaaggaatcggaaaaaaaaattatctcaacaatcagtcgtgaaacagttcaataattcggaagcagtgccatattgggaaaagatgcacaagtagagtaggctcgaaataaagggcaactgccgaagattaccaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagngagtggcggtagaccctttgttgatacatttgacaatgtagagcgcgtctagctcattcgaataacatcaaactggtttgtttttgtcacgaaacaacccgctgatggccacgtcgaagaaaagtccaaaatttgacatccataaa

SEQ ID NO: 27633 - DNA, 1982 bp, Heterodera glycines
gattctgtttaaaatattcaaaattattcccggcaatcaattaatatccgaaagtttagtatgattcttgttgattaaatttatagtgcaacgaataaatttgtttacggaaatttgctcctgtgaaataatttttgaatgttcaaattatgattttttaacattattttgacattcccctcgtgaatgctttctttctgctttcttctcgtccattctctttcttttagcattgcttaacgctcgacgggcatttcatgtaagtgagcgtggcatctaaaaatgcaattaattatcaaaaaataattttaaaaaatatataattaattaacaaagtaattattaaaaaacagtttttttcgaacttctcgctatgcccacgagacccccgcgtggctccaaaaagttaaacgcatcaatggacaagtccacgtggttgggcgggcactccgggcatttgttattgattggaacggtcaaactttagtaattaggataattaattgagacgatcagagacggttggcaagtgtttgtcctacgttttcccattgtaatcaactttgatacaaatgttcttgcaaatcgggtcgtccaacatgtactgtttgtcggctcggcatgcgtctttccactgcccgtccgacttgaacaattggccggagccggcagctgacatttttggctaaaatatgagatgccatcaaaattgtattgtaaataggggctctttttcgaaactatgatttttaagatttaatttaccatcactcatcacttttcttgacttaccactccggcgtctagaccgcacgcgccgcgtccgccggcaccgtagaaagtgaaaatgctgttcttgaccggcttgcccaagtatgaatcaatgggcccggccgttttggtgttcgacagacaccccatgccttaaaagatgaaaccttctgccataatgtttcactttgtcaaattatgattgttacatgatgaagatgatgaagacggtgatgatggtggcttatttgattttgattgatttggttttggttttgattttgaattcgatgcttttgattgcttgccgctactcttggccataacgatttccgagttgaattgaacggccaacaaaataccgaacaaaaagaatacaaccaatttcattttgggttattctgtaaaaatattaaatatttatttaatttataaattttgaaaatgaaatatgcactaaacgtttgttttgcatataataattttcactggcaccttttatactcatccgatgacaacgatttcattaggcttaattgaaaaatttgagcattttcggtcaattctttcacaattttcaactggcgcgacgaaaaattatatcaatttgtgtcatagatatataattcagacaacttcacgcaaccatttgataaggcgagagaacaaacagtcaatgttagtgcatagtctgcgctgcatgactaatgcatcagctctgtttacaacgcgactgccgtctcggtcacatggaaggaatggatttaattaaattctctccttagaggatctttttacgttaggtagtccgttagcgttcgattgctctagtcagtttttcaatatattcgttgaaatatttgtcgtgctatgaagggcgtgggagggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttccactgaaatgagcgccgagctagctggctcaaaaaaatttttcgaaaatctgagtctttcgtttttaatgatttgcaaatattaattccataaatattttt

SEQ ID NO: 27634 - DNA, 1097 bp, Heterodera glycines
  misc_feature (50)..(50): n is a, c, g, or t
  misc_feature (84)..(85): n is a, c, g, or t
tcgaccctccacgtagaatcattaaagcctacaggaatatacaatcttancactcaggagagagcgatgttattcgatcttatnncaatcaagttaattagcatcagacaccgagtcagagctgccttgagaccaccggaggaggatgattcattcttctgatgtcaccgagcccaatgagcggattgacacctggagaaccgtccttaacttgcggttcggcgactaaccaatgttccagccgattgtgaaaagaatcatactgaagcgaagacaacagaagtgatgttgcggaaagcgactcaaatttcttaaaatctaatttgtatttatttttgtcgataatgtttctctcgttcatctcataatcactattcttttttcatccattttctctgagtcatcaattttttgtttcgtttgtgattatcttttccacgttatttgctcatccccttatcgattataaaatataaaaacctggcccacattcattgtttgcacttgttgatttacattcaagtcagctcggaagttttcaattcaattaaatcgtgtaaatttaaggtaaattgtatttgtgttcatttgaatagagttagagaaaagttcttctctcaatctgtaaaagggacatcaggagccctttcatatagactataatttgccctccgttaggtcataactagagaccgcaaaaaaaaggcgcgaaaaaggcactataataagcaccaaataaatgaaaaaagccatgaaaagtaacgaaaatcccgaaaaaggcatgaaaaaggcaattaaaatttttcatcacaaagaccttcaattacagtttccacactttgacattgaaaggattaattgacgcctaaatgagttttttcgtatgcgtatttgaaggctgactttgttttgccccataagtgctcccttgaaaaggtttgaaaattttaataaagaaattgataattttttcaatatttcaattaaaattaaaaattaagaaaaaacgaatgtgctttaattatagagctatataataagcttagaaaaaatatattaaaaaacatttaaaatgtttcggaaaactaatccgattc

SEQ ID NO: 27635 - DNA, 1084 bp, Heterodera glycines
caaaatttaaaaatgggcgccaagcgcccgtctgaggccgcgaagcggccgaatgttctgaacaaaattaaaaaacgggcgcgaagcgcccgtcctgaggccgcgaagcggccgaaaattcccaacaaattaaaaaacgggcgcgaagcgcccgtttgaccccaacaaaatttaaatcgggtgcgaagcgcccgtccaagtccaacaaaattaagaaacgggcgcgaagcgcccgtctggccccacaaagtctaaaaacgtgcgcgaagcgcccgttctgaggccgcgaagcggccgaatgttccccacaaaattaaaaaacgggcgcgaagcgcccgtcctaaggccacgaagctgccgaaaattcccaaaaaattaaaaaacgggcgcgaagcgcccgtttgaccccaacaaaatttaaatcgggtgcgaagcgcccgtccaagcccaacaaaattttaagaaacggatgcaaaagcgcccgtctgaggccgcgaagctgcaaatgtcgcctttaaaattttgaaaaaacataagcctattaaaattttgaatatggaagccgcgcatgcactagcaacgaagtcctttgcgcgaagcgctcatgtaatgcatattcttttcatctctcacaagtatactgtctacaccgagcaattactgtgcaaagcatactgtctacaccgagcaattactgtgcaaagcatactgtctacaccgagcaactactgcgccacacgctagtttatatatatatagagaaaaagggggactcgtcttcaaaaacaaaatctcccggccaaaggccgggagctccctgacagtagtggcagggtcttacaactttttgaggcgcatctgggaaaaatacgggtttttctctccggtggccaactgagtcccggcggccgatttctcacttttgcttgcgtttgatggccccgaaacttttttcctaaattcgaatcaaaaatgtccgctgcgagggccaccccgcaaaggtcctctacatgttggaattttttattttttaataaagcccccccctgcccgtgagaaaatggaaactgaagcggggtcaaaa

SEQ ID NO: 27636 - DNA, 1521 bp, Heterodera glycines
cataaatgttcatcttttgtgaccaaaaaatgcaaagccaaaagcaactaacggactcttagaatgtgcaaaaatgcgatttttatctgattgcattgtttttaacacaatggttcgattacttttaccgcatgtgtggccgagtggttaaggcgttgcgtttaggtcgcaaagggatatttcctgcgcaggttcgaatcctgccacatgcgtaccacttcagtttttgttaatctatcctacaatttaatttggtgaatatcatataatttagcaatatgatgactacataaaatattcagaaattttttttattatttttatcaatttatcacatcgcagactattctcacgattttctgaaacttaaaagagcaataaaaacgaaaatacatccctaaacctgaaattaaaaaaaaatatatatacccatacgaatgtctgaaaatatcaaatccatgccttttttatattaaaactaaaattggaactgaataagcagaaagggtagaaaaatacgcaataaatatgcatatatcctcaaagaggcattaaaaatagaccgaaaatttcgatttcaaattttacaagattgtaaaagctgattttcttattattttgtattgtcagatatagctttcttctttggcatccaaatctaacaatcttggtatcattcgaaatgctttattagccttaaccaaaagcgaaaagattttcaaacttagaaaactcttattaataaaaaacttcaaaaatttcgactttttgcaattttcatgtataacttttttggtaattgtctaacggcgaatcaatagcttagaaaaagcttctaaacatgttagctttcgaatgatatcaacaatgttggatttggatgacaaagaaaaaagctatagtggaaaaacatgctggcgccgaaacgagcgcgccgaaacgcagtggacccataaatgatacagcatgcaaattttaaaaacttaaaaaaaccgaattttttcaaacttgaaaacacgcatatttttgcaaaaattttgaagtataaaatctatgaaattttatagactattagcgcttatgttttggtaaatttttccctggtggcatctttcatcgtctccgggcctaaatccttaatttacttcaaatatttactcaaaactctaattactaaatggatataaaatttaaatgcttttttaatctaaaaaaaaattttttttttctttttataaaatttcgaaatcaattcgtcctttctcaacagaaatattcttacattaattgattttttctctccatcaactttattttaatatattatattcatattagcttctcttttttttagcaaaatgaatgctgcttcttctcttctgctaattgtgttccttttttatttccaatttgattgtgcccttttgtctttcaaatgccgcggtgttccgactgatcaaatggagccatttcaatacacttcgacccaaatggaggaggccaactgagagtactgcgcaa

SEQ ID NO: 27637 - DNA, 1123 bp, Heterodera glycines
atgatcaggaagacatttccagacagggggttgctccaaggggggtcgaaatgttgttatttttgctccaaaacgacgtttagacccactttttggagttcgaacaaatttcatttgttattttcgctcacagagcacttgtaagacctcaaaagagactttaaatgtttgtacagtgactgggagccctgggttattgaaaataaaaagttcgaacaaaaggtcgaaaagtcgaacattgttcgaactctacaaaaatgatcaggattaggtctaaaatctgaattaaataaaaatgactattaaagtagcgtaataaagtgatttaatacatttaacttaaagtaattttaaaatgcattttttcatttgaaaatatgctttttcatattagaaaattaatatataaaaacgaatataattaaggaattaatatttattataaaatgagaatgatgtttgttgctgatgaaaattttaacaaaactgaaaaaatgagaaaaggcaaatgttcaggagcttaaatatccttaaacaacggtaaagggatagcatataatcaattaattgaaaaatcgaaacagaggcgtccaccatactctctcatcgccacacgcccgcctccgcagtgcttgtggtgaagcaaaggggaaaatttttcaccatttagtcaacaattatcccattcctttcaactcaccctgtggccaagtggttaagctcctcgcttccactctcaacggttcgagtccactaccatgtttttgatttttcacaatttttcggaattttcatcataaagtcaacaattatcccatacctttcaactgcccctgtggccaagtggttaagctcatcgcttccactctcaacggttcgagaccgcgaccatgtttttgattttccacaatttatcggaaaaagtcgcgcagctctcgctcatttaaattaattaattttaatttaaattaatttaaattaattaaattctcgcgcacaagtccatccaataggtttcggttgaagggatcaaagatcatccaataggtatgggggggggggggggggggggggcccaaaaatggatttaaaaaaaacaaaatcaaagtacttgtactttgta

SEQ ID NO: 27638 - DNA, 1441 bp, Heterodera glycines
  misc_feature (9)..(9): n is a, c, g, or t
atttaaccncaaccataggttcaaacattgcaaaaaaaattgttgctaaatcagaagtctgctctaccttcgatgattgtggcgtggtggcatcagttgtcgctgccattggttggctttgtggcagtcgtggaggagcagcagcagaagaggatggagcacaaatcaacggagggggagaagccattgtgggaagaaacgaagtgggcgccgtcatccgttgcggtggagcagcggcagatgggaacatttgcctcgctgccatacgaaaaggcatcggagaaggacgagacgtaccaaaatgcatcattgtaactggcggcgccatccgtggaggcagtggagaagtatgaggtggaccaaaatgcatcatcgagtccggcaaagtcatccgtggaggcagtggagaaccgatggaacgggcgaacattgccggcgatgtaacccgaagtgggtacagcgaaggcggatgtggagaagcaaagtgccgcattggagtcggtgtcgtcgctgttgttattggcatcatcagtggaggaattgcaggccgagggtgcggaggaggaggcggtggcgtgtgtaaaaaggcgacagtacccgacggagagggtggaagaagacacggtggtgaccgaagaaagttgcggttgccttgtggaggaagtgaaggcggatgaaaaggtcgaggaggcggtggtgggggagggggcggcggtggcggagagtgcagaaaagtggcgacattggcgcctggaggaagtgataatggaagcgaaggctgaagggaaggaggaggtggtggcggcggcaattcgctgacagactcggcactctctgcagggggaggcggtggcggcacgggcccgacattctctcttggaggaggcggtggctgcaacccgttgatatgttcggcactctctgtaggaggaggcggtggtgtcatgtgcacgacattccctcttggaggaggcggtggccaacccgttgataagttcggcactctctgcagggggaggtggtggtggcaattcaatgtcggcagttttggcactctcttcaggaggcggtgggggcggcacaggttcgtcgacactgcctcttgaagcagtaggcggttgtggcagcggtggcagtaatgacacgaccgacgaagttttcggcagtgggctagaagcagcagcggaactgtcacaaaaatgcacgtataggcacctcttttcacgctttcaacaacaccttgactgttgtgatgacatcgcacaagtgatggtggcggttgatgtaaacattgccgtcgtcgtcgtcagttcagtcgctgttgttgctgaggttgtggacggtgctgctgccatctcttccggctccaaactttcccattcactaggcgagtacggccgttgcgtattgccatcgttctcaacaacatcaacagaagcaa

SEQ ID NO: 27639 - DNA, 1148 bp, Heterodera glycines
tcatcgaacctggttctttctattctctttcaaatcgccccaaattttttttacagccacgaggccgcgaagcggccgagtgagtaccttgggcgcaggaaaattattaaggaggaggggtcattatttatttatttttgcaaaattaattcataaatttttttcagaaactgctctgaaacgcaccaaaatttatttataagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatgtttggatttttttttggcttaacaaaacttcatcgaacctggttctttctattctctttcaaatcgccccaaattttttttacagcttaactaggcccaattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtt

SEQ ID NO: 27640 - DNA, 1239 bp, Heterodera glycines
ttttagtagcataccacttttctaaccttaatgtcagtgtccatgaacagcgcagccgccttctgtcgaatgatgctccttgacacaggctgtttatttttttgtttttcgctgatccattcggccagttcagtgtcgatgtccggacggtgaactgggcgacctgctccgtcgagtcgcattcgtttccccccatttggtgacatgctaaaatttttgatcacaaacaaaaaaaattattaaatacctacatttgttttctcagcttatcttcatgcgcgatccaatctctgatcgttttcctgtacactttgaacttctttgctgctgcatttattgagtttttttgcgcccactcaactgcctccagttttttcatcacatcgttgtttctgtggcgcttcttgtcttttgtcggtgtgccttcattctctttattgttttgcggttcttgttcatcgttttctgagccttctgctatcgttgcgtttccttcctcgtttacgcagttgtggcacacgacctttccgccgaagccttcgttttcaactccaccagaatcgccatagaatgtgtggcacggcaatttgcagacggaacagctgtgggttcctccataaatagctttacaaacgcagcaaaacgattccatattgcttaacttttcattaaaaattccaatttttatgcataccggaagcaagaaaatgatagatttttgtcattttggagtcattttcagaagttctttaacataaatgcaataaaaatgttttttttttgacgcgatgacattttttggcgacatgttcaaaataaatttcaaaaattttccactaaataaatcatcgaaaaataatttccagtctctattagtctaccaatctccaattatctacccccttctgaggaggttgaaaaataatataccatggcatataaaaagagtatatacggtatgtacttggcatccaagtacgaatctgagccctgaaatactcaaaagtttggacttttatttgcatatttttacatatttcggggttttatacatatgtggtacatattttggactttttcatacattttttacatattttgtggatttttacagaaattttcggaaattctcaaaaaaaaatccaaaatttcggcaaatttttcgtacataatttcaaatttttataacatattttgaaaatttttgaaaatttataaaatttcttgtgaaaaataaaa

SEQ ID NO: 27641 - DNA, 1479 bp, Heterodera glycines
actaagaaaatttacggagaaaaaaataaaaagtcaaaacaatataaaaagtttgtaaaaccattctcaaattgtttacttataaatgccaatgaaagttataatggttattcaaaatataaccaaaaataatttaaatacataaaattataattagataaaaaatttaatgttcccgtaatttttttttttattccggctctaatttttagattgttttacttttcgtgacactcctggtacatccttttttggtcataaattttttttaaattaaaggaattatatattttattaattacatagaccaatcaacagggctgcaaaaaatatgcacgaaaagtggccaaaatatgcgcataaatatgcaaataatgtcgtatatgcatcaaatatgcataaaaatcgcaaaatatgcatcaaatatgcacaaaaaatttgaaaattaggggtgcaaattagagtgcagcgggaccgggccgggaattcccggtcctttgaggtcccggtcccggttccggaatttgaaaagctcaggtcccggtcccaatgggcaaccggaaaccgggaaaaacaagcactggtaagaatgggggtctgggtgaaaaattaatgatgaaaattggttacaaggaaaaaattttaaaaaatattaatatattcttttagaaaaaaattgatctgaaaagtaaatctgaatttataataatattcgatcacttagtccaaaagtgattaattaattgtttgaaataattgaacaaaatttgtttgaaatttttattaatttaattttgttttaacttttggattttataaaataaaaatcaaaatttaattatttaatattttcacgtgaaataaattaaaatttgaattttttttaaatttttaaaaattttttgaacttaaaaattcccgggtggtcccggttcccggtcccgaaaaaaaccgaggtcccggcttctcaggtcccggtcccggttttgcccaaaattcccggtcccgctgcactctaggaaaaagacaacgaattggttgaatttaggaaaatgtgagaatcaaacggagaaaaggccaaaccaaagggaattaatcaaaaaaataaattaaataattaggaaattaaaaaataattgatgtaattttccttcgatcgctgctgctgttggccgccctttcacctttttggttattcgatatctgtccgccaaagattgtgccgaccccgccggcgccgttttcaacccgctgccgtgggccggggggagtcgtgccaaactaagtgggttttgaagtgccgacagcgcagtcgctgccgccgcttgaggcgccgttgtcatcgccgcactttaaaaaggagcggaggacggacagaaaaaggtgagttgcacatcggagaagaaaaggcaacaatcggcggatgggaaactgttggaaaatgagcaaaaaataaaattaaaaaatgaaaaaccatcg

SEQ ID NO: 27642 - DNA, 1527 bp, Heterodera glycines
  misc_feature (280)..(280): n is a, c, g, or t
cagcattgggaaaacggcttcattttatttgtgacacaattcgcggggcatttggagttagaacaacgtcccaacaattattctgattacagaagcaatgtcccttttattctcgaatagggtaatcggtgcaggagttttagcggcacatgtcaatcatacgaattgcgttgtagttatacttttaagatgatccaaactgtataccgtttttgatctatcccgcacattcaggaaaaccggtcgcgagggatcccgggtcgagatcccgaccgaatcnccctcccgatcaatcccgaagattttttttcgggatcccgcgggattatcgggatttgctcaaacctattttttttacattttgtgccaagttttgttcaaatgtttatctaatatttataattgatcaattcgattgaagagaaaaaaaagagatgtgaattatatgatttttatagaaatttttcaaaattggaatatcatgcccaaaaaatcagattttcaaaaatgagagcatttaacaacatgccttaaataatttttttacaatttaatcaattaatatcaatttttgtattttcgcctcagatgatcatttttaataattttgagaaacggaatcaaaaaatcagatttttaagatttttttttgctccaaaattttcaaaaactttaggagaacaggggggggggaggtcggcggtgccgataggcgccgccgggaaaattttgaaaatttgaaatttaatttgttaacaaaatttatacaaaaactgtccatattttgtgattttgaactaatttataagaaaataatgggttaatgggtctggtgatgtccgattggcaccgaaggaaaaatgcgtagacaataatttttattctgattattggacagaattcttagaaatcgttgtgccataaaactacctaataagatttagaataatgttttagaaattaaaaaaataattctttttatgaagaaacaaaagtcacaaaacggccaacttttgcgtcaaattttgaaaattttagtggaattttggagacctgtaaaattttttgggatttgtaagggattttttaagaaaaattagcaaatgacaatattttttaatttaaaattcaagatcttaatttaaaaaatggagattttttgaaaaattatgtatgacttcaatcccgcgggattggtaaaatggtcgggagggatcccggttcgggatcccgatgaaatcccgatcccgatcaatcccgatgaatttaaaaaatcgctcgggacggatcccgaggtcgggatcccgaatttaatcccgcgggatcccgatcccgtccggtctctaataggcactaaaataggcaaaaaaaatttttattaacgctttttaggtagcaaaacgcataaaaattaatcaaaaaaattattttgcttatatttcaattgttttaaagtttttttcgttaaaaataatttttttaaacctaaaaatttttatgaagaaaaaataattaatttttggggaa

SEQ ID NO: 27643 - DNA, 1134 bp, Heterodera glycines
  misc_feature (1084)..(1084): n is a, c, g, or t
  misc_feature (1090)..(1090): n is a, c, g, or t
gttcggacccaattgtcagactcaacaagatccacgacggactccacgggggcatttatgtggtgggagaaatttttgttcaacaaaacaaaactgacaatcgaaaaaaatttagcacgaaaaaggaaagggactcattgaggagaacgaaatctatgggaacactttggcgggcatttgggtgacgacaggtgaaaaagagtttcggatggaccatccgtttgatttctctatcatttttgaaggttcttctcccattttgcgcaaaaatcgtattcattccggaaaacaagttgacattttacacattttgtttgcaacaacttaaatttgtctttgcaggtcggtgtttacttttacgacaacggacacggccttttggaagagaatgacattttcaaccacctttactccggtgtccaaataaggtacccttttccaaaataacctttcatttctctctttccacataggaccggctccaatccgaaaataacgcgcaacaaaatttggggtggccaaaatggcggtgtcctcgtttacaacagcggaaatggcgttttggaggtcaccggaggaaaaggaagacgtaactttttcgatggatataatattttaggacaatgaaatatttgacaatgcaatggccggggtttggatcaaaacggacagcaacccgacacttcgcaggaacaaggcaagtgttcctcagacacttcaatggtgaattatgaggatttttcgcagatttacgatgggcgggacggcggcgtttgcattttcaacagaggacgcggactgttggaggacaacgatatttaccgaaatgcacaggcgggcgtccttatttcgaccgagtcgagtccgatcctcagaaggaatcggattttcgagggaagggcggcggggattgaaataacgaacggagcgaccgcaactttggagtacaattggctttacatgaaccgatacggaggtgagaatgtgcacaaggagtgtgaaggaaactgggggagggattttcaaaaagtgtcggtttcttgtgtgaattcccctaacctccccccccttccgtccgttaggnctctgnttggctactgacgtacgaccatcacttcgagacaatcgcatttt

SEQ ID NO: 27644 - DNA, 1736 bp, Heterodera glycines
  misc_feature (1728)..(1728): n is a, c, g, or t
atttgattgatagatttttctgccttttttcccgaccatgccaaaatgagaattggcccactaatttttctcgaattttttgtcaaaaaccaaagctgatataacaaaatcttagtttttctatacaatttagaccagtagaatccgaatatggccttaaatggggacctatcttttcaacctgagcttgtactgctccaactccatgcatgaagttcgagctgtacaggtttgttgcgatcccagagaccaaatctaagaccatattcgaactcaacatacccgatttaccttgtttaattaaattcagaatttccaaaaccacttttaaaacattatgttacttggtggtcttgaaaaatgccgtttttggagaccactttcagtctcggctctccaataattcaatttttgtaattaaaattttatatttttgtgttcttatagtcctaactttgctcaatttaatcactatttctctggctctgtatctcttttatttttctttaaatcagccatcaaaaatacccacctctaaaatgaccattttacttacttaactctaactccctaaatacttttccattggtattgatctcttgccagaataatggcaacatattattgataataatggcgggtattttgaatcatgattgtgttttgttgaaattaaaaaaaatttttaataaaaaaaatttgggtatcaaaaattatgttccaccctaagtatgtccatgaacaattctctcccaacccgtataatacaatttttttgatcaaattattaagattaaaaaaaattaactcactcccaggttacgggcctgaatgccacgaatcttatttaaaaagacaaattttggcattttgaaaaatttgggtttgcttcaggcaaacagtgcaaggcaagaggaggaaaagccggcaccatcagcccatcttccgcttaatccggcacgttccattgaatcggtggcgtcacgcttttgcgccgctccgcaggcactgagcggcagtcgccagtttttggccccgtcctctcccacaacagttgcgcgcagcaacagcaacaaccgaaacagacgcatgtcagtggccggagatcaacaggactcattgcgcaaagagatggcacgggccgcgggcggaggttgacattttgatataatagaccgatgtgaaaagtaatctgatcaggtctgatcagtagtcaataatggacttaagtgtaagttctgatcagtgccggataaaacaatttgccaattggttgggcctaccattatggaaattggtttaggccttcaatctaatcagtgccaaataacaattgattgggccaatagatgttctagccaaataaaacaaggctaatccgtcaagcctgatcagttgtacggttttaaaactctgatcagtagcagccaaagctataaagtattttaagaggactcattacctttttattttttggcatcgttgtaagccattattactaattgtagtaaggggttgaaaaatacgaaaaaatgttgaaaccgtgaaaaacatgcccaatgaaaccaaaagtaggcattggcacgtcgtcgtccaccggtggcacgccccagcgccgcttttccagggcaaccacctcaaattgcggtgccaactcggccaccattgcgctggtgacgcggaaaatgagcgaattggcagccggaacagcggcagaaacaacactanatgaacac

SEQ ID NO: 27645 - DNA, 1749 bp, Heterodera glycines
cgaataaagcattttcctgctccctgacttctttacttgtggagggaaggattatagtccaaccctttagaagggcttgtgccttgcttaatttccgcgagagtttctcggcagcgaggctgatcggctccagggaagtgggatcattaggcaacaaatcggaatcagccccctgtaatgagtcagcggaaatagcggttaaaagagcgcggagctgcttgtcggataatggccaacatgattcagagaaaagagagaaaaaaacgcaaaaaatttgagtaaaaaaggagtaacttgacggtcttatcccttcacagtactaagtccctttagttttgccggtttagctcgaaaaaaggcctggtcagtagagcaccagactcttaatcaaactgtggtaaacacatgaaaaaagagggaacaaatgggacaaaggggcctgagtcagtgggatgctggccataggcaacggaaacgaacaaggccaaagcggcgtcgaagtggctgggcaatggctaggcaaaggcaaaacagtgaccacgggcaggaagagccggtgatcaaaaagggccaaaaaaggggggatgccacgtaatggtcaaaagggtggacaaggcaccaaaaatgagaaatgccccagaagtgatcagggggcaaaatgcggagaacttttaacggaaaagccaaaggagcaaagttttttttttgttttttttaaggcaaaaggcaaaattgaaatggtaaagcaaagtgaaaatggtaaagccaaggtgaaaatgtaaagccaaagtgaaatggtaaagcaaaagagtcaaaaggcaagagcagaatgggaaaagccaagggtgatggcgagtaggtagagcaaagtgcgaagtgtaaccgccagaaaagtgaacattttgtcgagcatccttctttctttttatacggccaaacgggatgggcgggtccacagtgtccgggtgattggtggtaggcgggcaatgctgattggtgggccaagcggtgggtgggcgacattgtccggatgagcaacggacaacagatgggacaacggcgaaagcacagagagccttccaaagcaaaaaatgtcaacaaatttcaaactgcgttgaacaaattgattttcctattttggttttctttcaagtttaagtgtccaaacattgacttaacacagtttcttagctcaaaaattttttcttgtttggtaagaattggacaaaccccaaaatccattagacaaattagcataggccttgcccaaaagggaactaaaaaccaatctgaacaaacctccaatttgtcgtcctttcacgctgactgtctgggcgttcttgctcttccaacatttggagaagatttgcttctttttgatggtgcccactgcaaaaaacacattttttcagttgcatgaccataaaataaattgacacatttaatgcactataaaagtaagcatccaaatcacacattcttggtatcatttgataggccaaagagtgctctattcctctgcaaacattcataaaatttcgttatgtttcaaaaaagttttgctaaaaacgttgacaaatcagttttttgaggttttctgactataactttttgggaacctaacgaaattcttttgaaattttgcagacgaataactctttgggctataaaaacaaggctaagactaataaattggatgcttctaggaaagttatgtacttaaattttcaaattttgtggtcatgtaaa

SEQ ID NO: 27646 - DNA, 1123 bp, Heterodera glycines
ttgcaatgctttccattgcttctccttttcgctttcctctgctgtgctcgatgttgtccgttcgccttcgctttctccactatctaaactttctctttttttaaaagcgttgtattatttcgctttaatttttctatttttctttttgcccccctccctctcgaaggacaatttgtactgttcgtgtgttaagcaactgtcagtcgtgttactgtttgcctctcacgtaaaaaataaacaaatggggacagtacaattggggttttacccctctctcccaccgaccaatgatttccatgcccatcccagtgaaaacgggaaattgtggagtgattgaactgtgcgcgacgttttcgaaagggagaaaacgttgtgtgttgtttttactggtggaaagagctgctgagggatgaattggcaacaaattggaagtggttgttgtccgatcagtggacccctttttcccattttggcgcgtgccaaattctcccaatcgatggaatgccactggtggcgttgagttgctgctgcttccattgtccaattttgtaggattaaaaatctgcactgggctgaatgccaactcttcctcttcttgcgacaaattgtcgtcctcctcctccacgactgaggaggccaaagatgaagagagtccgccggcggaagtggctgagacttcttcgaccgaggacaaattgtgaagggaaggcgacgggaaaaggcgatggtcctttgccattggcctctttaaatggctacgtaatacattaatttaattacccaaaagtgcgacctttttttcggcggtgcccatttgtcggtggaccgaaaccattggaggtcggaaaattgggaaggcgacgggcgcgccgagggaatcggcgggggaaggcgccagcgaaggaccgcgggggaggggaggcgctgaaagtgtccctttccgcgattttggccagggccaaagtgtgaaaatgcactaaacagcaaaggaaagagcggtgaaaggcttttgtaacaaacacaccaataaaaaaggcggaaaatgagctgaagatttgcccaattcgtcgccgcctaatgaaaaaaacatcgcaacggacgaaaaaaacggagcgatcggcgg

SEQ ID NO: 27647 - DNA, 1014 bp, Heterodera glycines
cccccccccccccccaccgactgatccctccgtcagcccccccccccagcacatttatcggctgcttcggcccatcacccaccgccgatgagctctttcctcagtcctaacgatcgattggcggaagcaaaagacacaaacagaaaaaggacaaagggccaaaaggtgcggcgacggaggcggcggcggattgataggcggcgatcgacggataaacggcggaagaacgccgacccacacacaaaacagcagcagccaacaaattcacttcagctgatcactccgaacgccaaaaatggacaacgaagcggccgggacggacggagaagcggtggaggacgaggaagtgatgacggacgcggacttcgaacgcgccatggaacagctgagggaggagggcggcgaggacgtcaacgaattgctcagtgcgttttgccaaaagccaaaacattgccaaattaaacaatggtcgcctttttagtggcaatgagtgaaaatcgcatcatcagttgggaggtgaaacaaaagtcagattgaggggccattgcgaattggccattttttaggaagccgaacacattttgggcaactcgacaaatgaaccggtaaaatcgtcgcttcctcagcagacgcggcccacggagccggacaacgacacggacgtggactggtgcgtacaacggctgatgaacaacgacccgaaactagtggagataaacctgaacaacatgaaagtgcgtgccatggggtggaaagggaccgagtgtttttcgatcactatcgattgattgattatcaaatcatttatcgatcgctgctctattaaactattgattggatcacattaattgatctgctggtcaatctgccgctgattattgcttttcagaggacacccattcccaaaattaaacgtgtgatcgaagcgtgtcgcgacaatgagcatatggagaagctgtcgctcgccaacatgggacggtatgacacggatgtgcaggtggccatttgcattgg

SEQ ID NO: 27648 - DNA, 1072 bp, Heterodera glycines
  misc_feature (974)..(974): n is a, c, g, or t
  misc_feature (1004)..(1004): n is a, c, g, or t
  misc_feature (1026)..(1026): n is a, c, g, or t
cattcagtgtaaaatttgttaaacctctcaacattttactcccaaatcctaataaaaatttagttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgcagttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttagttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgngtaattaaccgaaagaagaagtgcagtggngaagaatgacgcccaaatgaangaatattcgatgctgtgcgaactctttgtgcccctctctgactctg

SEQ ID NO: 27649 - DNA, 1374 bp, Heterodera glycines
acagcttaactaggccctattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactatgccatattaagcttatttccagaaaatctcgcatgaattctcatttttaaattttttatagatttttaaatgtttggattttttttggcttaccaaaacttcatcaaacctggctctttctattctcattcaaatcgccccaaattttttttacagcttaactaggccctattaagcttattttcagaaaatctcgcatgaattctcatttttaaattttttatagatttttaaatgtctggatttttttttggcttaccaaaacttcatcgaacctggctctttctattctcattcaaatcgctccaaattttttttacagcttaactaggcctgttaagcttatttccagaaaatctcgcatgaattctcatttttaagtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataatcgtttgagtaccccaaacggacacttgaaaaaatcgattttttcgttttcggggcagtccccccgaaccgatgcgcccagatttatcggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagagctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgagggggaggggggggggggggg

SEQ ID NO: 27650 - DNA, 861 bp, Heterodera glycines
cgtgtcccgacatttgcgcctttgtccaaaatcgggttcaaaattaagttttttaaatccctgattattacctaaacatttaaataagcgattgaaggtgaatgtatccggtcatttgatcgtcagtaaattaaaaaaagaataaagaattatgttcctaataaattagaagaccgtgttttcttaattttaatgctgttaggctaccagggcttgaaaaaattcaacttttaatccaattttggacataggcgcaaatgtcgggactgtaaaagtcggggctccgcttttgctcgcaaagggcaccaaaatgaatgggagaccaccccttcgcagtgagagtggccggtgtaaaagaggtggggggaggggtgggtggaaggaaaatttttgaaattgaacagttttttacggggggggggcgtagtgtaccttccccggtgaccccgccccctaccttttacgctcccctccccctcccaaaaaaacaacgaaattttggggaattaggtgcgaaggttgaggcgattcgcaaaacaatgctgaaattgaaaagctaaatttgaaaaaattcaaaatctttcttgacttgccaaaagcatgctgcccccccctccttattttacaaaatgccattaaattaattttttgtccattttttgtcattctctcccgtcccacttaaaaatgtagcgaagaagcgtcagcacatgccaattctgcatcagcaaagccctgtggctcataattggcatcaaactcaatcgatcaattggtgaaagagcatccgacgacgaacggcggaaggagacgaagaaaatcaaggacagacggaccaatttaggctgttatacatacata

SEQ ID NO: 27651 - DNA, 974 bp, Heterodera glycines
  misc_feature (147)..(147): n is a, c, g, or t
tcccccattaatagttaaaagtagcgcacaatcagcaaattattcatttaatcactttcatatacagagattattcaattggcagaaaattagattaattctaaaaacacatgttttagtttgtttgaatttcatattatatatganagtcaagaaatgaatttaaaaatttcactgtaaaggagaggattttattttgatttttcaaaaaacattataaaaaagtcattaaaaactctctatgttttgagaattttaactggtaactttgcaaaaacacagttaaaattaaaaaagaattattttaaaactcgtgagtattttttcatattttttttgaacatggacaaattggcggatcatgaagcgtttgttgagcactgatgatgcgggcggatgtgcactttttagtcggacaagacgatgagcaagaggcgagtttttttaatacattttaattgaatttattattttacaatatttcgaaaagtttatcttttaataatttaataattatattttgaattaatttaaagcttctgccagcgcgtaaaccattttgagagttgcgtccgatgtgttcgatgcaatgttccgatatgacgagaagttccccgcttcggtaactcaaagccccgccgatgaaaagggtttgaaatttaaatttcattttaaaataaaaattttagcttcccaaaaagagggaaacagtcccgtggagattccagatgtgtttttgacatatattattaaaaaattcttttggcagacattgcgttggccattggacaatgtaagcagaaaggaatggactgttcggcgaagaattaccgacaaatgcttggccaagcattggtcaaaattcgatttccaatcattaatatggattttttggctgatattggtatgcaattttacttgcgctttacagtaggaatgatcgagaatcgcaatatcaatcgacttgatttttt

SEQ ID NO: 27652 - DNA, 1927 bp, Heterodera glycines
  misc_feature (1697)..(1697): n is a, c, g, or t
  misc_feature (1809)..(1809): n is a, c, g, or t
ctcagaatcgaaaatttttaatgcagaaatgcgttttttgagcacctttcttcaaaacaattgagcaaaaaaattaggtaaaacctaaaaatatcatccctaataatcaattaaaaaattttaacaaaatttaaaaattttcgacggcatttgtcggcaccaccggatcaaatttctttatcagatcattccatcacgctgatcttggcgccccaatacactggaaaattaaaaattggaaaaattatgcaaaaattcagcttcttaaaatttaattttttctacttttagaaagaaagtttaaaattttaccaaaaaataaaaaaccccgagacttttctcgagtcgagtctctctagtaaaagctgttcgcatctgtcgggactagggttcggacctcgtgggcgggggtggcttttcgcgggggcgggggtcagagtcgcgggggcggtggcggggcacgatagttccgcccccgcggggacgggggcgggggtttgatttgaattagctccaaaaaatctcacaaaaaaattaatttttatgaatgatctgttggctccacgttcctttagtcgatgtatcgcctcgattcacaattccttttggcataaattacacagattttgtctaaagaatgaccaaatttattgatttatgctaattttttaagaaaaaataggttttttggtggccggtggtgccgataggcgccgccggggaaaatttttcttatgaattttgttagaaattagccaaatttttcagaaatttcattcttttggatgaaaatacgccctaaaatcagaacatttcttagaaataagaacataaagaaaccctgcattaatcagataaaaataaattcaaatgaaaacgccaacgggtgtcgaactcctaacaagaaatactgttagtgttcaagcactaaccactaaacaacaaatatatattgggaattaacagcaaaatttattttatttcataaaaaaatttgtcaaagatggttaaaaattcaaatttgtataaattttttgccttttatcccacgaatatgccattcttagggtgtattttcaccccgtgcccccgcgggggcgaaggtcgcgggggcggggattgctggggtcagagtcgcggggacgggggtggggtccgaacctctcttcctcttcgccttttgttatttcctttctcttcctcttttttcttctattccccacctgtttctctttcttttcctcttctgttcctcttcccctttctcttcctcttctcttctattcccctcctgtttctctttctattcctcttcgtcttctgtgttctcctcctgttcctcttcgccttctcttcctcttcgccttttgttcctcttcctttctcttcctctttttccctctattcccctcctgtttctctttctgttcgtctaggaagagaaggcgaagaggaacagaaagaggaagagaaagagagagaggaggagaaaagggaagaggaacaggagaagaagaggaagagaatgggaaagtgaatgaagaaaatgggaagaggagaagaagagcaagataaagcgaagagaaaaatgctgtacttggctgttcgtccaagtatcattttatatcagggttcggttcgtccttgagcctgacccacctgttcctagatattttttggaaaaagcgcaccgctanaaaaatgaatatgcggtgaagtgaggaaatgaccagaatcaaaaaatatttataaaaattcattccggcgcaaatatataaaatttaatcatttttccttacatacgattanatttttatatgtccttgatttttatggaattttcccttggtcttggaaacggtatacccgtccctgggaaggggttggccggtccgaaccctgcttatagcccttattcattataaaa

SEQ ID NO: 27653 - DNA, 775 bp, Heterodera glycines
  misc_feature (729)..(729): n is a, c, g, or t
taaggtcatcacattttaaaggttcaggattttctttaattccaatactttcgagtgtaaagaaatcagaggaattatttcagactgggtacaaaaattgatcagatgattttggggtaattgagtattaggatggggtttgccggccacaattggacccaaaagagtttgtacgaggtgatagccgcttgaaattctttgaacgggggtgggttctaactcgtaataataatcagcacctaacaaaatggcaggacaagtggtgctaatttgatccacaatttcacaggatgaaaaaagctctcgggaaaatggtaaataatgagtgggttgggtaagttggtcaatggcattagcattaacaataatcgagcgcccgtcaatcaattttatgccaaattgggtaagatgggctggtaccatttggcatttgggactgttaaatacaccgagcataagtggattgggaatgagtgggaggtttaattttttggcctcatcagttcgaatatatgtatggttacttgcgtcatcgagaaggataatatattctaacgaattttgaggataatttggatgaaaaattggggccttgacacattttaagagaacagggagatttttcttaggatgatttgttgaaatagtggtatttgttagcgttttctccataccttcaaatgaaaaagtaggaaggggattgtccaattgtaccttttgattgattgngaagttattgagggggtttggattcggcatggaagttgggactgat

SEQ ID NO: 27654 - DNA, 1018 bp, Heterodera glycines
  misc_feature (793)..(793): n is a, c, g, or t
  misc_feature (849)..(849): n is a, c, g, or t
ttaaaaaaaaaatgttcataggtcaatttctgcttcgcccacgtgacttgcaccaggtgcattgaatagggcatatgggaccaggaattggagaaggcctgcgcgctttgtggccgattccgaacttatgcctggtccccgttcgaattctggcacacggatgtggaatgccgcaaggtcgtcgaagacccactggctgccttcaccaagtggttattgaacttcgaaacggtagtcctcggcatggagcccggtgcgaagaagagcagaaaaaggaagaatgccgaaaacaccgacggcgaggctatggaagtagatgaggaagaggatgccgtggatgaggacgccgagaacaactggatgctgggatacgaagaagccggggagaagccggagtcggtgacaacatacgcatacgcccacgccggtaattttgaaattattcaaaaaaacttggaataaataaattttaaaggttcccgctacgaccatgtgctggtttatggtgaaatgctgcgcatgggtgtccgccctgaactcatccgccaaggcaaccatctcctagagatgaaggcgcgcaaaacgggagtctacacacccaccgtgtttcgggacaggtaaaaattcaaactgaataattttttattttgtcctttcagctacaagctgatcccgatcaaattggcaaattttgtcaagacgtttggtctggaaattgagggcgtggaaaacaagaaatattttccacacaaattcaataagggtaaggggttaatttaggaaaataatttanaaaaaaaaactcataaatttcaggcggaaaactacggcacagtcttggaaacctgncaccgatggaggactattaccccagtggactcttcccggcagagcgcgcaaagtttgagcagtggtacgacgagacccgggaaaactggttttgagctcagtgaagtaatcgcggactactgcaagacaggtacaattttttgaagaaaaacatgcaaaaatacaaaaa

SEQ ID NO: 27655 - DNA, 668 bp, Heterodera glycines
aagcgctcatgaatatgacatccatttcgaccagtttataaactcggaccagaattcgaacaaatatatcggaacttcgcatttcaacgaatttcgaatttttcgtctaaaaaaggcttatatgatcttttattacaggaaagatgactttcagtttgttttcatgcatttaagtcgttttcgagacattaacccaaatttctaaaatttaactttcgattctttgttcgaaatcgggtcctgttttaggaattggtcgaaatggatgccatattcgtgatcagcggcccaagtaacccccgacggtgggcacaaacaacttcattcttttgttgattatgtacacaatttcccctccatttttaaggcaaacgggcacaggacttggccgaagaaggaggacttgccgaaatgatggacatttttcgcactaccacggcagccgaacgaacggaggcggcggaacgttgaagggtgaaaataacatttttaaaattttcactgactgatcaaatgaaaaaaaaaggaaattcattttcatatagcaaaacgacggacgaccaacagcagcagcagatggacacggcactgaacaatgatgagagggaattgcggctcacaaacaatcggacggatgtgatttatattcgatcattttccatgtatgg

SEQ ID NO: 27656 - DNA, 1164 bp, Heterodera glycines
  misc_feature (112)..(112): n is a, c, g, or t
tttttgtttttttgtgcacacaacctattgtcagacgcataactatttcccatttttagcttttttacatttcccaaatgccccaccaaaaatgcaaaaattttattgtganaattatgcaaagaaattccggcacataaagaaaagtcgaagaggcgaagaatttgccctttgtatcgtctgcaacgatgatattaatctcctttccattggaaaagctgccatttctcagcatcaaaatactggaaaacaccagaaagcggcaaaagcagcaaaccgatttctcaattcaatcccaaaggacgaattgcagaagctcaacactgaacaaaagtggatgaagctatttgaagccgatttaccgcacttgtacaagttggtcagcattgtactttccgtgccggtctcaaatgcatttgtcgagagagtgttttcgctttgcggctcacaatggactgatgttcgaaattcgttgaaagtcgaaaccgtgaaggctctggtccagacgcaaataaattttgatctcacttgcccagaaatgtatcagatgctcatttccaatcacaaactgttggatcagatcggtggatgggacaaattttgcgggacgggatcccgcgggattaatcccgcaaatcccgcatttaaaatttgcgggatcccgtgcgggattgcgggattttggaaaattcgaaaaaatttcaattaaatcaaaaaatttccaaaaatcaaaaaatgctgaaaataggggctggcgggatgcattaaaaggggctgatgggtcgactaagattttcgattggatccgacggtaaaaagttgatcggaaatcaaattataaaaaaatttctaaatattttaataggctaaattttttaattcttaaccaagtaaaaggtatttcacaaatgtttttagtatattcgcttgaaaaaattattcaattattttatcaaaatcttttgtcatttttcattattttagaacatttttgggaaaaggagtgactatttacacatttaatgcgatttgttaacagattttgtctaaaattgaccaaatgacgcagtttttgactcaatttctacaggattattaagcaaaagcctatccggcggtgccgataggcgccgccgggaaaatttcacaaattttgaatgaaat

SEQ ID NO: 27657 - DNA, 1151 bp, Heterodera glycines
ctaaaaatggaaaataggcactattaacctaaatttatggggtgtaaaatgacaaaattcattcaaagaggtaaaaaaataagtcaaatcagtattgagttaccttattttttaaattcaaaaattgtccaaaaaaaatttttaaagacgatttttgagaaaatttttcatttcttagggtgtttattttcagaaatttgggctcgatttttaggggtgtatatttttaattcccaaaaatcgaattcttaggggagtattttttgtttttattgcattttaattaacaaattttgggcaaaatgccaaaataggcaaaaaaaggctctttcaaaattttttaggctttttaggcgctaaaaataaaagcctagaaaattggcactaataactcgaaaagtagcttaaaaacagcccaaaaaatgtcaattatttttttattatgaatagagaccggaatttttaaagtaccgggaccgggaccgggacttggaaaatggacccgagcgggacccccggtcaaaaaaaagcccgttttaccgggcgtcccgggcccggtccaaaattttgaccgggcgcctattttgattaaaaattcgaaaaaaattttaaatcttattttaacttagaattatatcaagcctgtaaatcaaccttttttgcttttcaaaacacttttttatggcgcattttctcaaaaaagaagttgaagtacaagggggtgggggtcgcggtgccgataggcgccgccgggaaaaatttaaaaaatttgtgtgtgatttgttaataggtttacactaaaaaatgactaaattttgctattttgagcgaactttttcagaaaaaaagcttttgtactaggcgacgctaaggaaaatttttgacttttaatgaaatttattaagaaaatttattaatcttttttggtaaaaaaagttatgaaaatgttattcatttcgtatggattttagggtctttttagcggttgaaatttctccaaactttcaaaaaattcaaagttcattttgaaaattttgaattaaagccatttcgacaaaaataattattaattttttcaaattttgggcagtttcgctggtgaaatttaagcccgtattagcccggtcaaattgaccggtcccgggactgga

SEQ ID NO: 27658 - DNA, 1442 bp, Heterodera glycines
  misc_feature (1431)..(1431): n is a, c, g, or t
ccatctccccccccccccctctccgattggatgctcacttttctttgctggtctcactttgtactattcagattggactcatttactctgtgcctattaatgcattttgttgtgtcttctttataattattattattagtaattttttagcattttatgatggcaattaaagacattccatttaaaaataaatttttgagattattgcaattgtacgtagcattttgcacaaaacccaaatgattgggtatcaattggaggggtcccccttccccccccctgtcattttgttgtgctattttcctcctttcgcctcccttctccctttgtcaaaatgtctctgatcagttccaaagtgcgctggtcgttcagaatgcccatgtgatcggtgccgttcactctgtgcacttcgaccgttccgtccgccgtttccttcgcccaccgttcgcacacttccaacgaccgtatgtttaccgttccgtcgccgtcgccataacttcaaaaatattagcacgcacgccaattaagcgattactcaccgaatgtacggctgatagtcagggaagaaccaattgtgagcccattggaattggtcgggggtgtccacgccgacgccaaaaatgcaatggaccttaagaggaaggtcactcaaaatgccgctgaaaatggtcgaatttgtgtttgggaattcccttcccctcccaaaaaaaaacagttacgaaatgcctaatttcccgggcccattaaactcgccttcactcccgggggttcgagtaccaacgcctcactggcacttttccactggtcaaacccttgagggtactgaatgtccgcgaagaatttgtccaagttggacaaactgtaattctgcctaaaaagggcactcttttgccgcattccctaattgccaattagcaattaattaattgccttggagtagtcgccaaaatttcgtccgatttccaaagggcggcggacggaaagagaaaagcggagctggtgaaagagcgttgcatggcacggagccgcgaggggggcaaaagaacgcggaaatagtccatgttgtagcccgaaaaggggcaaagtgaccccaattataatttccgcgcatttccaaaagtgtcactgacccgaggcgaacaatttgactatttgggccgacccgccccacgcgccggccaacgaaatgtgagacaacagaaaagtgtccttccaattctgaacaacattcagtttggtccttcctcttctgaccacttttgccccttttctcactttgtccacaattttattgtaaaaaaagttggccattggatttcccatactatgcgccaaaacgatcactttgcggttgccatttgcgtggtaaagttgctcaatcagtgaacgcaatttaacaaaataatgaaggagttcctctaaaataccaanaatattttcgg

SEQ ID NO: 27659 - DNA, 1988 bp, Heterodera glycines
taccatgatttatgctatataaacaaatctataaaacgatacgattgcgacaaaaacttttgcaaatgtttgtatgaaagtgctgaatgttcattaacaaaagtctgtatttattttgtattttaaatagtatattttttagacgttgttatgcttgacagttcatgtttttggtgaacactttaaagaataagaaacttttaaaaatacagagatttatattaatttattataaatgttgtataacaataactattttttatatttattgtctttaattcacttcgggtggcggtttttaagaaacgcccatggtggcggatttaggaaacgcccatgtggcggtttttaggaaacgccctggcggatttaggaaacgcccatggtggcggatttaggaaacgcccatgtggcggtttttaggaaacgccctggcggatttaggaaacgcccatggtggcggtttttaggaaacgactcagcacgtttttaaatacttacattagaataaaaaaatatatattaaaaaaaaattattaataatgagaatatttaatataaaataattaaatattaatgtcccgctattgaagataatttatttacagagattacgctctaatttctgaaaagaatgaattttaattataattaaacaaaatttttgaaaaaataattatctattatgatatttaatcatttttccaatttttaattttatatgatcagatataattaaaagaaaaagcttcatactgatttttgtttgacagaataccaaattatcggacaaattaaaagcattgaaatcattttacaaattaatacaaattatttaatttaatctttgttcaaacgggaaaaggccaatttttatcaaaatttttaaatgatttaagagtacaatcgctaattttttaaaatcttcatttaacttaaatacaaataataaaccaaaaacttgaaaaagaattttttaaacaataacagcacgcgaatgaacgtaaactcactggaacacagcatgagatttaaatataaagaaagcgaaaacataaaataaataaattattttacaattattaaaagtaaatccatgaataaacaccaccaataaatgaataagaaaatcattcattaaatataattagagtcgatcaaaaaaaaaacttagtgtgggcgatccaaaaaaaaactcagtgattgataaattaaataattcaattcacaaaataacgatgccgtccagttaactctaatgtacgtcgggacgcaagtcattttcaattttttgcatcacttctcgccaattttctccatatgtagtagacactgccggacgccattgatatcgttttgtagagctcatcgagctgtacaaataagccgctgataccggcacgctcagcttgggttggccatcgaccgggtcggggggaggctgagtgtcctccggcagatgtgcccgacccatgacgggttacaagtgaattgatcaaaaaccggacccggcctgggagatagcccttgaaaaactgaaaaaaaattgttcgtaaccgggccggtccgggttccggatcaggcacttttggtgccccgaaaagggtgcgatcggcttccggaaaatgaccaatcaatcacaaacacaagaactgacagaatattagaagaaagaaaaaaaaattcttttaaattagcaaaaattaaaatgtgcataatatttaatagaaaataaaattgtttctcctgagatatcaatttaatatgaatttttattgcctgaaaatactaaatgatttttaaacttttaaaaatatttcaaaatctaacatcattttatatataatatttttttaataataagagaaatcactaaaaaataaatttattatcaaactaaaataagccactgattatatgatttgtttcatagattccaatcatgaagtcattaaatatatgtttcgatttgatttaaaattaaaaaa

SEQ ID NO: 27660 - DNA, 899 bp, Heterodera glycines
acatccgtcgcgaggggccgacctggaagccggccacccctttgcgccggtagtcgaacagaagcgcattcgttgtctttaaggtgggcggtggcggcgattgttggcggagggcaatggcatcgcaaaagtcggcggttgccgacgacaacgatcggttgcggaggtgaggcgattgctgatcagcagcggcactcattagcattggcagagaaacttcgaaaccattggcaccatctgaacggacaatcgagtgagtgatcactgatcagcaatcaatgagttcaatttgggattccaccgaccgtttatcggcacactgatttggttgttctcgagtggcgatgtttgttgctgctcgtcggtttgttcgtcaaattcggcgccgtttttggcgccgaaagcagttgaattgaaattattattattcatcagcaatttaaatttatttagtcaatttttgtttttcgttatttttacgggaaaaagcgacggcgaatgaaatgaaagggacggacgaaccggtggcacggctttttcccatcgctttgcgccaaagcggccaaagtcttttttttcgaaaacactgtccgcctccctcccccgccgttttctccgcgtcacagcccaaaggaatggccaaatcggatgaatgttttggcagcacgacaacgccggtgaacaaattaagaaatgcgcaagttaggatgatggtcaagaagaggcgattagggggagagaagcggcggagggaataatcgccaaaaggcatttgtgccaaattcgaaaatggcgacggaaagccgctcatcaacaaaccatttggatggggaagcggatttaaattggcataaatgctggacaaaatttggcacccagaagatcatcggatttgtccg

SEQ ID NO: 27661 - DNA, 1148 bp, Heterodera glycines
  misc_feature (1020)..(1020): n is a, c, g, or t
ataaaataaataattgtgaaaagtatgtataaaattgctattttttattttccaacttgagccgaatgaattgggcggctcaacaaactgctgagcattggagcctaaaagcaaaaacaattaaattttatgatgaattaaatataatggaaaattaattcttaccggaagaaattggtcaagcaatttattctccaattttgctgccaaatcaccacattggtcaccgccagcaacttcaatgtcgtcaatgatcacaaaattttcaaaatcaatgttaacattttcaattcggaaggcaatctggaaatgatttttgtttgaactttttagaagaagccgagcaataaacgaaaagcccaaataatttaattgcaaaaacgacccgttttacgtagaaaaattgaaaaactttcaacagactcatttaacaaattgtactagtgataaaaatgaataaaaaatacattgaacaataaaatattattataattattttaatctatgggttttttaaatattcgggcccgagaaagggtcccccgctacacaacgggtgttagtgcaattaccgcaaaattcaaaacggtcgattgcaaattgagttgaatttgtgccggagaaagcgaaggaatgatcggatggcaaatgtgcacgtttagtgattccgcttcgattaaacaaacacttagctgaattgcatttgatcatatgtgcttaagctgtgttggttaagctcctacgaaattttgaagcatcgcattccagtacagaaaagttttttaaaaaacaaaattttccaaatttgattctaaattctttaattgtctaaaaaaatgtttgctggaaaatatttattaaaaaattatattttgggcaagggcgcagccagaaccttggcttcaggggggggggggggggctgaagtcaaaaattcgatttttaggagtgtatttttcttttttcatgcgatttttaggggtgtatttttcgcttttttgaaatcccgaattagggggngggggggggtgtattttacaaaatttcgccgtttttcgttaaaaaattagaactttttgccattttggccttcatttttcaaaaatatggtaaactggggggcccgcggcgccgataggtgccgccgg

SEQ ID NO: 27662 - DNA, 1234 bp, Heterodera glycines
aaaagttcgtcaatgtcaccaccatggatgaacgggtagtactcttgcgagttatgtttgtcattctcatgtttcgtgcgcagcgcatatagttcgctttagagtttggtaaaattcctttctataaaataatcagttgaataattaaatgccgacagaaatgttggcgtgagtggtgggcaattcgcagtcgttatcgttgatgtagtggtacaatagcagaatttgcgactgcaaatccgcgatgcccttgtgtttgaacctgtcccattcttcttaacacacaaaaaatcggtggtaaatcttacaaaatgttttccattgtcacttttgagcagttccgtctctttccgatgcttttcctcctcctccttaagctgtttctccatccctttcatcttttccattgcttcttctcgagtgcgttccgttgagcgaagttcgccattaatgcgttcaatttctgtcactttttctgaattcaattcaattttgttcatttccttgggcttttgcccttttcttcgccacctttcatttgtgcttcgatttgcttcagtcccttcaactccctttttacgcttttcaattcgagtttcaaatgtcccttctcttcctcaaatgcaatgatttgctcccttagcttttccacctaaaatcccccaaattattgggtttgttttgctttcttccgcaattacctcttcctttcttccgtccctttcctttttgatcgcttccatttccaaattcatttctcttttttccttttccgccctcctcaaaatttcctctcctttttgtgcctccttttctccctcttttttcatcttttccaactttgcttcgaatgtctccttttcgtccttcattttcatctccaattcgctaatttttccattttcttccttcaatagcatttcagttttgctcatttgacattgggattcctgaatttgttgtaataatttatttgagagattcatgtcacctttttcaactcatcgataacataaaaaagccttgaattttcctgaaaattttcatcattacatatttacacactaattgtcgaaaatacttcttccgcagatttcaaattggcacgaaatttttcgatttgactctcattttgggctaatgatgtttcaagctcatcttttttgctttgcaattccgctaccaattgcgtaagcttttcagattgttcggatagttggactttttgtgaatc

SEQ ID NO: 27663 - DNA, 938 bp, Heterodera glycines
atataatctctccaaatttggcagactttctccatagtaaagggctatcttaacctgaaaaaatgccaacgcttgttgtttttaaaatttttcgaaattctgactgttttcagtacgtatttattttttgcaaaattaattcatcagtattttttcagaaagtgctctgaaacgcaccaaatgttaattaaaagttaaataaggctctctgatgctttttctatcaaaagggagaggaataaatattttaaaactttttaattcctttttaaatttgcgaaagagtttaggcttatattttaaaaagtttcatcgaaactagcgcactaaaatcgatataatctctccaaattttgcaggccttctccattgtaaaggactaacttagcctgaaaaaatgccaacgcttgttgtttttaaaatttttcgaaattctgactttttcattaattatttattattttgcaaaattaattcataaatattttttagaaggtgctctgaaacgcaccaaatgttaattaaaagttaaataaggctctctgatgctttcactatcaaaaaaagagatgaataaaaaatctaaaaatttttaattgctttttaaatttgcgaaaaagtgtagggtaaaattttaaaaatttctttgaaccaagcgcattaaaatccgtatggagggggcgaaaaaaaagaagactctttctttatttgtaaattgatttcctttatccagaaaaaaaaggcaacattttagggggggggggggggaaaaaaaaaaaaaaaaaatttttttttttatatataaaaaaagcggggggggttttgtttttttttaaaaaaaacaacaaccgccccccggggggggggggggggggggggggggggggggggggggggaaaaaaaaaaaaaaaacccccccctctccccccccccccct

SEQ ID NO: 27664 - DNA, 1133 bp, Heterodera glycines
atgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattatagttacaacttaattttagcactctgatgctttagtat

SEQ ID NO: 27665 - DNA, 1434 bp, Heterodera glycines
ttttctttcgtccaccttaaactgttgctgatcagtgaccgattgttcactgttttttccatcaaattgtccatcattgtccaaactaattgctccgccattgacttctaaaaaatatacataaattaaattttgaattaaatatttatttattttcaccccaaaattcaaattttctcccattttgccttttctcataatttacctccattttctgctggtgtgaaatcatctttataatttattgaattggtcgaaattgacattttgaatttgatatctctaaaataagcttatattttaaatttcctttaaagaattataataaatgaccgagaataaaaagattaataaaaaataaatgaccattcattccgtcaattttgttttaatttttatgcaattttcggcaaaatgatgacccaaaaagcgggaggagcaaaaatcaaacattcttactgtaaacaattattttttgaattcttatgggagggaagaaaagattcaaagcagaaatagaattggctagacattttaagacaacgggaaaatagagtaaatagagaaaaatgaaggaaaacacataacagtgagagagaagagagaaataaagataatcatgggaagagaaagagactgggaaggagaatggctccctatcatttcttcactgggaaataattttttaaaaactatgcggggaaaagcgcctttcgggcgccattccccccccccggtagtgtacgatgtattattgagctatgaataataaaaccgaaaatggctcggccgcttcgcggcctgggactcaattcttcggcattccaatcacttggaatcactcaatccacctgcattccaatcaccaacaataaatctcgccgattcttctgcataccaatcgctgggactcagttctacgacctttcaatcaccgttactcaatccatcagcactcgaaacacctggactcaatctcaccaattctacataggcaaaacattttaacattctactggcctttttgtttcttgtcatttcttaaacaaccctcggcatttcaatcatcggaactctatctcaccaattctccggcattccagtcactgggaccaacccaccagcattccagtcactgggactcattctcctgcatttcaatcaccgggactcaaccctccagcatttcaatcactgggactcaatcctccggcatttcaatcactgggagtcaaatctacggcatttcaatcactgggagtcaaatctacggcattccgaacactgggactcaattctcctgcatttcaatcaacgggactcaaccctccagcatttcaatcactgggactcaattctccagcatttcgatcactgggactcaatcctccagcattccagtcactgggactcaattctcatgcatttcaatca

SEQ ID NO: 27666 - DNA, 1203 bp, Heterodera glycines
tcatggacggtaaaaaaaaaaaaaagcgacaataaatctttttatggataattatgggaaaaaattggcgttctgtcacatttactttttatctttatttctctcacttttacgtactatctcttcattcttaataatgtaaagaacaacatttacttcgtgacgtttaacttttttcctgcaagttaaatccactccaaattttgcatatcgatagagaaaaaaataaagaatttttcaatcgcttttttaaacaaaacaatcgcttagttcaatagttatagaacaacacataaaaacatatttctttttctctctttttggcgtactattttcatgtctctagcacatgtaaaaatcgaaattcgcaaattctactagttttgattagaagagtacaaaaccactttggaatttagaatcaataaaaaagtgattagtttccgcattttggttgaaaacagcggcctcggacctgagttataacgtaatgaaaatttgaaattcccacaacttttttcatatgagttaaattgcttagcatttgcttagaaaaagattctccttttcaaaatctttttttagataccaaatttgttcatttttgttgggaatgaagcatattatgactgatcaaaataaaaaatacaaaaaaggcatttaccagtgtaagtgcatatactttgtttttgcgtgtgttggcgttttgttttacgccaattattttttggcaatttttttcgttttttaccgtccatgcgccatctccgacaaattttttcgtggaatttcatttcatttcctcatccttttatcggcagtgaaagtgttgggttttcagaaaaattttgaatgctttttttcaccaacattcggcttgggttacaactttctacagcttaatagggtatcgatgaatgccctaaaaacagggcatttgcccagttttttatttttcatgtttttttagagggaggcttaaccagcggcggcgtgcgcgtatagcacagcacccagaaaagttgttggtgttgtcgtgtgttgggcgactctctaccatatcaattaccatactgtatacattttctatgtacataatactgtgtttaccaaaaaactaaaaagcattctcaaacataatgtctaacttggcgtacattcgaatgaaagccaacgactgtccgatgatcggttttgtccgat

SEQ ID NO: 27667 - DNA, 858 bp, Heterodera glycines
cgccctttcgtcgggcagcgcggacccctccccgctcgtcgccctccgcccttttcgccgggcagcgcggaccccctctcttccgcggaccccctctttccactgccgcggacccctccccaccattccgccgtccgggcggcgcggaccccctctcttccacggaccccctctctccgtcggcgcggaccccctttcttccacggaccccctctctccgtcggcgcggaccccctctcctcgacagaccccctctctccgtcgtcgcggaccccctctcttcaaggtacggacccctaccctcctttgccacggaccccgccgctcgagttttggtgcgcgagtctcggggtgcgctagggggcggggcgtcgggactcataaaatttggagtcaatcggacaaggggtgcgcgagttttgctgcgcaagtctcggggtgcgcaagtgggcggggcgtcgggaatgtaccgctcaaaattgtgcctgaagcaaaattcttttgccgttcagcttagggggtggtggaatgacggcccgtaaaatttgaagtcaatcggacaaggggtgcgcgagttttggtgcgcaagtctcggagtgcgcgagggggcggggcgtcgggaaagtaccgctcaaaatggtgctagaagcaaaattcttttgccgttcagcttagggtgtaatggattgacggcctgtgaaatttgaagtcaatcggacaaggggtgcgcgagttttgctgcgcatgggggaggggtgcgcgagtgggcggggcgtcgggaaagtactgctcgaaatggtgcctgaggcgaaattctttcgccgttcagcttaggatgtcgtgttttgcaattcataa

SEQ ID NO: 27668 - DNA, 484 bp, Heterodera glycines
aaaaaaaaaaggtcggggtcccccccccccccgaaaattttttctagatacgcccctgcctcgacattttccaaaaaaatcactgaaaaatccttcaaagattttttcttgcaattcttttattcaagatcattttcttgaaaactataattttggatcacaaacaatatgcaacttgttcaaaattaataattttttgcacattttcaggcagttccggcgcccgtcagtctgtccggctacggcgtcgagttggccatcaaaagcaccgagtacaaagccatcgacgactccaatgatcagaaaactggcggcgacgagccagcacagaatttgcacgggttcaacttcagtcttttacggtaattaaattattttaaatcaatttccgataattttttatatttctttaatacttatgcagtttaagggacagatttcacatacattttcaaaagcttataaatgtgttttagaaattagt

SEQ ID NO: 27669 - DNA, 1259 bp, Heterodera glycines
gctggtgataaaaggttccgtccgctgatggagtcaaaaaatgcgccggaggcaaaggtcgtcgcctaattagacaattaattaattaatggggaaactgacaaagaagttttagtaccgtttaaaaaaaaattatgatttttgaaaaaattaccaaattttggcaacgcttttctgtgagttgtgtgaggaggagggcggtggaggcgaaggaaaagcggcggctgccgaagtgatgaaatggttctgatggtacggtgccaaagtgtagtgcttctcgtcaacggtggcggcggcaccagcggacaaatgcaaattgtcaatggacgacgagcaacagcagcttggggaaaatggtggcaaaatcagaggaaaatggcatagaaatgccggcaaaaatgccatagtaaaagctcgacagcctcgaaagataggataaaaattcgcgagattgggaccagaattggcacaggatccagaaaaatgagccgactcggttggacatagaatcggaaaacggcaaaaaaatttgtgttaggtttcgggtcggcaaaaagaccctgattccgtgccagaaaatgtcaaagaaagcaatagcaaagcgaagacaaaatttaattaatattcattttttataaaaaatatatttaatgaagcagcacttaccgtaattctctcccctccataccgtatccatccattttgtcgttaaaatgcattcactcttctgttaaaaaattgtttttcaccattatattaaagtcacatttaatatatttgcaaatgtaggggcgaaataaatccgaaaaaccagccaaaaatccaaatcccccccccgccccgatgaacatttttttgttcgtggcggcgagatgcgtttttgcctgggaaatgcgtaatttgctgcgttttgtcccatggcgcgcttttcagttacggcatttttagattttttgccggcgtattcgactcaatttccatctttttgcttggcaccttttggactgtcttcccctaaaatcccttgaaattcttaaatttctactcaattggtaaaaatatggccattgttgcaattattacaaataaatagttttattattttcaacaatttcagtctttaaaaagaggctaatttacaattaaattattttaattcccgaaattttaattaagcctttaaattttcatttctttgctaagctcacagagcaatggagaaaaagcagcagccaaaaaggagcagaagcagaaaaagg

SEQ ID NO: 27670 - DNA, 1687 bp, Heterodera glycines
  misc_feature (784)..(784): n is a, c, g, or t
aaatggcattaaaatctacaaaaaatttaacgaatcaggctaataaaaacgaattctccttttattctgtttggccactgtcttgaaaagttttcaccattatttatgtggcgacaaaaccccctcactgagcaactgatcagtgccaagaaactgaccacagtttgtagaaggcgaacagctgtgaccagtcgaacaccccgcgcacccacgaccaatggtcgcgctcgtgcagccgcgcgccagtcgcgttggcgtagcgcacgtactcgcgcagccaaaattctgtgcccgcgctgcctacgctgttcggcaaccgctcaaagtcggccacaagttgttcaacgcgcgcgcgattctcgcgcattcgcaagtccggcgcgcggaccacggcaatttcaacctgcgaaaggggcgacgtttgagcaactgatcagacaaagtgatcacagtcagttgctgatcaaccaaagtgttgtgattaatcatagagaaacaccagagattaattattcgaatggtcttgaatttttaaatttccaaaatgtaaaaaactaacaaaaaaatcagttggaattttaaattaatttttggtttttttaaagtaaaataaattgtttttaaataatttccttaaagcatatttacactgataaaagcaatcaaaatgagcttttctccgatttcacctggtcactcccgtggaacagttcgatctccactccaattttctcaccaaagggtccgaactcagcaaaagcttttcataatccaacccttggcncattgacacaatgccccacagggaaatggccaaataaacgaagaaaatggtgccaacggcgaactttgtgcgccaatccaacagaaaatcgacataaaaattcctaaaaatataaaaaaatatatttaaatttataaatcaatttgagcacctgaaaaactttcccattggccccttttggcgcattgccaaattgaattctgacgcactgagtgcagaagagctactgctcgaaattggggccgaagtgctcgaaaaagactcggagaagccatggtcaggcgatggggaatgttttgacctgaaaaaattggaatttcctaataaattttaattatttttaatttattttttttgaaaccctttttcgtctctttcttcataatccattgctttgctcgatttgtcatttttgctgttgttgttgttattgttaagctccgttttgctggacacactttcatcctcctcaaattcgaatgggtctttcgccagcaaacagcagggcaaacaagcatttccaaaatgggagggagaacaattaattagttaattaattaattaaatagaaaaactaattacgaatcaattaataccgttgttgcatttgcaaacgcgaactgatcaccatcaaagcagcaaaaaaagtgatctaatcgatggggagaaaagaagcattttataaaattgaattgaaaaacatggcatacggtattactacggttattaaattagcaatgttttgttaatacaagtcgggcacctggtagagaaaggtgaacatcatgcaagcggctgtcatcatgcaaaagccacggaccgccaaaatgtcggagtaagtgccagcagcgaaagagacgacatcggtgatggaagtgatgaagatggccacgctggactcac

SEQ ID NO: 27671 - DNA, 1599 bp, Heterodera glycines
  misc_feature (15)..(15): n is a, c, g, or t
  misc_feature (48)..(48): n is a, c, g, or t
tttttattatatccnaatgattacaaaataaatatcaaaaataataanaataagtgtattttattattcattgattatgaatcatttaaacaaaattaattttaaataagtaactgtatttttattcaattgattattagattatttaaaataatcaaaaataattttttatttttcaattgattataatttcaaaataaattaaggaaaaaaagtaattttatttattattcaattaatctttaatgtttagcaagtgatctggcaacattttccatcatattaggcaaatcatttaacaatgatacaattgtattggaagttgaactgcgtgttttttatgtaatttttaattaaattattttaaatgttttttaattaaaaaaaatatttccaaaattttaggacggaaaatggcttgaaaatgaacatcgaaatgcaacaattacattcaaaaacatttctgttttagaactgttttttggcatcaccaatggcaatgatgtgataaagttgaacggtgtgcaaatgtttgaagaatattccaattcggcgccatattgcgacatgaaaaaaatcgaggtgacataattaatgaactaattaattaatttattacatggaatgcatttttttgcttgaatgaaaactggctgaaacgcacaagatcttgtttttataagcttctcttctatgacgcattttcatatgcattttttaaaaatttaatttttggaaattttcttggaaaaataaataaattaactaatttttaccaaaatttacgcaaaaagaaaattatttattttattattttttggtttgcatcgataagagttgccggggaaacttatgaaaatttttatgtttttctatgtgagagattttcagccataaatttggagaaaattagaaaattttcatcataaaacatctaacataaatttacatgttttatggggttttgaaattttacaaatttgttcaaacaaaaaaagttagccactttagaatcatagtttaaaaaaatttattttatacttgtatgatggctttattaatttttctaggtaatgggagatgttattttattagatgaacccgagctgaatgtgccaccaccaaaagtattttatttttttgttggaaattatattattaattttttcatttttttctcatttatttaggaaaaaatggggagcgcaatttccaattttgctctgaagaatgttgtaaattatggccaacaaattattgttattactaaagagcggctcacagaagacgcaaaaattattgtcagattgacacacaattcaccggactgttccaaatgttcgtaagaaaaattaaacattaaaataattaatattctagattttttttttgataattccacgcccaatttttcatgttcaattacgaattgaaaatgaaaaaaaaatttttttaatgttcataagcagggcaaagatttttaaatttttaaaaatcacaaagtttgatatgatgattttcttattcattttgtagttttcaaaattaattgaaaattttcaggaaaataccttagcataagggcttataaaaatgtta

SEQ ID NO: 27672 - DNA, 1109 bp, Heterodera glycines
tttgaaaactatttttaggtccccgattttctgaaatttcttatatattttcgtttgttctttgaaattttttatttccctttttaaaatttacattttaaattcttttttccactttttattatttattaggctaattttacaaaaaattctcgaaattttttataagaaaatttcaagaagaacgtttcatttttttgaaaaatttaatttttaatccatttttaattttcattatttatttgggtatttattttattactggtttttttaatttattagactaaatttgggttttattttttaaatttatattttaatccctttttctccccctttttcagttgggtgtggacggaggcgggccagcagcccgacttggagcagtcctttggcatcggcggcttcggctacccggcaatggtggcggtgaacacgcgcaagctcaaatacagcacaatgaccggtgagagagttaccgtatcagtgcatatggtaaaccgaaaaaaaccgactttttcttgaattttctctaaatttttaaatttgtttttgcggcgatgtttcggcctattccgtgttctcccccccccccacgaaaaacttcaaatttataatttttttaattttcaggaaaaatagcaactcttttttttttactatttttaaaggaaattcttagaaaatgaaaatttaatggctttttaggttttgggttttcctaaaatatttttttaattgaaaatttaaggctcgtttggccagtctggcatttccgagtttctgcgcgacctttcctacggtaagggcaaaacgtcgtctgtgccgggcgcgaatatgccgtcgctggccgacgtgccggcctgggatggccgggatgcggaactgccgccgatggaagacgtggacgacatcgacttgtcggatgtgagcctggacgacgaggaggaggaaatgtcaacgaaggaagcaaagaaaggggtggatgaagaagagaagaaaaagaaaggcaccaagacggaggaggaagtgagtgccaaaaagacgaaaatgccgaagaaaaagagacgcgacgaactttgatcggaggaggcaaatgattgattgat

SEQ ID NO: 27673 - DNA, 978 bp, Heterodera glycines
attcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccctccccataattgtttgagtaccccaaacggacacttgaataaatcgattttttgttttcggggcaacccccccgaaccg

SEQ ID NO: 27674 - DNA, 1381 bp, Heterodera glycines
ttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtctgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactacagcgaaatcaacgcagagacgcctttccttgacctttttagg

SEQ ID NO: 27675 - DNA, 1080 bp, Heterodera glycines
  misc_feature (22)..(22): n is a, c, g, or t
  misc_feature (31)..(31): n is a, c, g, or t
  misc_feature (1073)..(1074): n is a, c, g, or t
tttgttttcgattgctttgcgncgtcaagangggacttccagctcttaggaatgcttttgccgattacattaaagtaaatttttatcctcaaaagataaataaattttatgccattgacttttttaaaaaacgccattttatcattttaaaataattattttgataagtttctttatgaacatttttaagggctaaatccaggctaattgcaaacccaaattatattaatagcaaagagtttaaccactatctcggtttttatttggaacctaaaattgttttcccattaattttttagaaaaaaggaaaaacgatggtaatggactcggaccgtgacaaaatattggtgtccgaattgatgactttcaaaggcggactggacaaggtgatcagtgactgtttcaactcaaatgagaagtttctgcacgcgctcaaagattccttcgactttttcatcaatacgagggcaaacaaaattgcggaacttattggtcagcgtaaaaagaaagactgaaaaaccgaattttaaaatggaaatttagcaaaatttatggactcgaaattgcgcaccggaaacaaagaatgttcggaggaggaattggacgaggtgatggaccgcgtcattgtccttttccgttttgtgcaaggcaaagacattttcgaggccttttacaaaaaggacttggccaaacggttgctgctgggccgaagtgcgtctgtggacgcggagaaggcgatgctttccaaactcaggacaggtgggtacttttaaaatagttttttatttcagaaaatttgctttttcagagtgcggtgccggccttacacagaaattggagggaatgttcaaagacatggatttgtcccgagacttttgcaagacgttcaaacaagtcgcaattaaatggattttggggatttgtcttttgtttttcagtatctcgaggcaaaccacgctagagatggtgactttggcaaattggaagtgaacgtttgcgtgctgaccatgggcaattgtcagagctatccgaagatggaggtgaacattccgccgccagttgggacctgcagnngcatgc

SEQ ID NO: 27676 - DNA, 925 bp, Heterodera glycines
tgacaaattttttgaaatatttaatcagcgttagctataagcaaaatgatttccgagtgatcagtggccaataataccgatatagataaccagatacaaatttaaaaaaaattgatggatttattgataaaaaaataaaataaaaatcaggctttgacgatgtccattgaaacttagcaatgaaaagatttctgatcaatttatcagaagagatcaaatttcagctgtcagtggtcataaatcagttaaaatatccagatgtctcaccttttgcaaattttgccaagtctctgacagtgcctcgatggtgaaccacgtgtatgggttgggcccaacattgtacgacttgatctgacggtccaactcctgcaactggcggaagtcgtcctcggcgccaaccaacgacttttggaattcggtgtgcgcctcgcgaagggcttaaaatatatatatttttaaaataaataaaaatatataacattttttaaaattaccccgaatttcctccaatgaattgcatcggaccgggtccgtcagatcctcttccgcattctcaaaccacgagttgaaggcggacgctttcttggcgaacgtcagatactgtaatttacaagaggaggtaattatgctattctcggcatttacaagattcaaaatatgccattcttgaattaaaatgtacactgaccaggtcctcaatttgtttgaagtgcgcctgggcctccgtcaatttgcgacgtcgttccagcgaatttgctaataattgctgccagcgttggatgaccgcccggtggcgttgttcaattgcggcggattgttcatgctccgcctccagcaattggtccttcagctcggtcacccgttggatgccttcgtgctgagaaattaaaattttgaaaaataattttagaaataatttaatgaa

SEQ ID NO: 27677 - DNA, 647 bp, Heterodera glycines
gcgcagtagcgctccgtgatttcgggtgcttaaaatgaatatcaaattcatgaatcgatctgtgatccaaacagctcacagtccttttttattgtctgaccatttttgagggactctaaactataagtctgccctaaggcccccaaacctttgctttcatctttcgacccctattacttttatatcagcgtttaacatttattctgttttatatacaaattgtacatacatataatttaaaaggctcattagaacaacacaatggacaaggacaaattatgtcgtatatacagcgatcgtttttcactccgtcttagaggtgttgccactccagtacgagatgttgtcctgcaacagtcccatgatcgtgacggactccgcgcaaatactctcgcccgttgtctgcgcatcggaagtcgcgtcgtcataagcctgtaaaaaaaattcgagcggttaaacttgaaatacaaattttctgttcatcacccgttgggcagtttgacaggcatcggctggtgatttctgcacttcgaattggagaatggcaaagttcagcgccacggtgagacgaatcggatgcattggccggagtttgttcttggcgagttcgaacgcttcttggtacgcttgctttgccttctccgcaa

SEQ ID NO: 27678 - DNA, 1117 bp, Heterodera glycines
taaaaaaattcaaatttcgtctaacttttttgcattttctcccacgaaaatgccattcttaggggtgtatatttaaccccgaccccgatcggggttaagggtcggggttgtcggggtatgaagcgtcggggtttggggtcggggttttccccgaaaatggccaaaaatgtcggggttcgggggcggggtcggggttgcaaccctaacaaaaaccattgaaacatcaaaaaatattattctgtgcagatatgaacgtaaaagtgaattttgaaattttttaattttcgacttttgttcgaattcgggtccggggatcgaaattggtcgaaatggatgtcagattcgtgatcagcaaccccgaaaacctcctaaaaatatttaaaaagaatttttatttttatggtctgtaaagtacataagtaccgaaaaccaggcctggataaggtccaggttgataattgtgcagcaattgttctcgaggaaatcatttaactttgacttcttttaggcaataagtccctttaagtgtcaacatggattcacgacaggttttattaaattttgacacatttcctttgcctttgataacatttcgggattcaatgtcaagacgtaaacttttctcgcgaagtgatgccgtaattgcggccgacgaggacaaaaaatcggaaatgcctcgcagcagagaaatccacgaattccgacggtcgtccgtcgcatcgatttccaaaggttcaaatttaaacaattgattagtcactttgaacgttatcttctgtcacttatggcctctccaatcgtttagactcattttgtgccgattcgaccggcatcgacattctccgttttatcgaggacactttgcacaaaaattcaaaggaccgcgactttttgctggacactgaaagaaagctgagagagcttttggtggacgaacggtgagcggagggaagtggaaaaagcatttttgtccttcatttactattcggtttaggcagtcttttctcgtcttcccgagtctgtcctcttacaaccgaatggtaatgcgttggcattgccttttcagcatttgcaacaaaaggacgcaattaaccaaaagggacacaattgcattgaa

SEQ ID NO: 27679 - DNA, 964 bp, Heterodera glycines
  misc_feature (860)..(860): n is a, c, g, or t
tatttcgtttcaaattgaatcattttttttggctttttgaaataaatgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttagcttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgaggtgcgctcttttctaaaattccntcttgtcgtctaaccatccctcccttttgtgcactatttcgtttcaaaattgaatcattttttttgtcttttgaaataaatgtgaaaaataacgaaaattattt

SEQ ID NO: 27680 - DNA, 1079 bp, Heterodera glycines
cggtaattttgaataaattattattatatcaagcataaccaacacaaaaggataaaactaagatggattaaagccaataaaattaaaagcagaaaaaagcgattggtggttttctattaaaaataatcgggcaccaaactaaaagaaaatatttgaattaaaacaaaattaaaagaaaattgtttgtataaaagaaaataaatacataaatgaataatcctcgcagtcaaccgcctgtggcgctcgtcagactttttcctccgccctccgtctcgccccactacttgctccgtcttcgcatgctcccttttgcgtaattttgcaattaattattattttattcatccattatttctttggtactgaactgtccatttttcactgggtcacaaaaccgaaaagaaccaaacagaattatacaaaaatatgatgaaactatgatttaattagaagtaaaaaatgaaaaatcatttaaaaaatacgattttttaaagtttttgaaaaaaaattcttttaaggatgaactggacaaaaagcaaaagctccaacactttgtgcatcagcaattaaagaaaattgaagtttcgaagcaactgaatgcccaccattatgaggacattgcgatgaaatcaggccatagtgaagcagtggaagtaaacaatgcaaaaataaaaataaaatatttaataatattttattagtatttaaaaatatttggaacagtgccgaaaatgagtaatttcattctcaatcttggtgtcatgagaactcgtacactttggcctaatctttaggctaggcctaggcttaggctttattttgtaaaatatgagttgacttttgtacgagttgccattaacctctcaatcttaaaaattttaaaatttattttacatttataaagcggaattccattcagttatattagttttccaggcacttattcaagtagcagacaagcattacacaaatttgtacagattaaagcgtaaactgttgctggaccgtgagattgaagtaaaatttgaggctctttaaaaaaactatttaaaaaatatcgtcaatttcgaattaattac

SEQ ID NO: 27681 - DNA, 756 bp, Heterodera glycines
ctctctgcgtctatgcctcgcaaaattttttcatttctttctcttcactcccattgttttcttgcttctctgctttctctggctgtctttctccatctgtatgccctttctttgtcctctaactatctgataaaagctaaagcacacagtctctcagccaccaaacgtatctctgtcgtctctgagtgcgcaacttcaactttttctcttcctacctctcaaaattatacactttctagctccctctccttgtctccctaccctttcttatttctctaaatgttatttgggctctctctaactggtgcgcaacttcctctccattctctctcaaaattatacactctctctccccctctccttatctcctcttctctccgtctctcctctatccccccttctctgctatgccatttcctttttgtgtctgccgttgtgcacaagcccgaagcacatcctaaattgaaatgtgatgaagaggaggatgatttgctgctgatgactgactgatggtaatcaaagggtatgccgcgggctacggtaacgcgcgcaatgagtcacaatgaaactacgaacgcattggcaaattaaatgataatgagacataccaatgtcctaatcacttccttcttgccgaaaatgaaaaaaacacacaaaatggacgcaaaattggcacaaaaacgacggagcccaaaaagtcgcacaaagccccaaacggaaccaatggcattttagtgaaaacattgagaaattgga

SEQ ID NO: 27682 - DNA, 1328 bp, Heterodera glycines
ttatgcactgacggatgtttgattacggatttgtccgggagccgatcgctccttttccccagagaatgaccaatttttcgagagccataaaaagtggccacattaaattactccagacaactagtgttttgttggtactctcttctgccttggtcattcgtcagacctcaaaagtcgtaaattgtacatagccccatccttccggttgttgtgaagaaaatgtgcgcttaaattccctgacgaggtccgcttttccttcttttggtgaaacaatacgcaatgttgccgaacaaggacagctccaatttgccccttaattattaattaagaactcggtgtttttttaaatttatattttctgattacctaaaacactcaaaatgtttgtatttttataactaaatttattatttattggtttattttttttatattaaacgcccaccataattttttgcgtcacattggacgaaaaagccaaaatatttgatggcactttttgtttcaatttgtgcaaaaattttccactggaatccgtcaatgcatacagtatcgctatattttctgtccttgtgccatgcagaaaaattgccaatttttagcaaaagttttcccgcggcggaccgtcgacggatgggaaacggtaggggatacggttcggagaaagaagcagatgaatggtacaacaacacactgaccaactcggcactggtcaacacgccggacgaaactgttttaaaattagctttttattagagaatttcgtcattcaatcaaatctttaaaaaatgaaggaaaagaaagacaaatttaatataaaaaatgtctgtgacgggaatatttcaaaaaaaactaattttcctataaattttggggaggtggtcggatttttaaaaattttaacccggggtggaaggcctcgcaaaatttagaaatatccaaaaaaaataattttgaaaatttgttatatttttggttcccttgaaaattttctatgcaacggtgacgttgcagcagcatatttgtgtgctgcttcgatgtaccaagcgtgtgtccacctcccaccactcccccctcccccgccaccaggaccgccgtgctttgggacagttgaaaagcgttttttctttttctttattgcaatgccatcccaaaatgtttgttaaatgatggtctaccaatgtttgccagacaatctttgtgaataatcggaaaacgaattttgtaaagcgctgggccaagcatttcgcgtcgatgcaccccgaaacattccttgccattttgggcacattgcttatccgcccaacgtagtgcctaatattacatag

SEQ ID NO: 27683 - DNA, 1451 bp, Heterodera glycines
tcactcggacccggcttcttctccccgacggtctctggagtgacttcttcccgtgtggtttggcatgtccatcgcagctgccgtttcgtcgtccatcgccatgcttccatacgtcgaacggagtgagctcagtgacgcgtgagcatgcgaattgccagaggtgcgctgctttgttgctgaattccacggggcacttgttcctaaatgatttgacatttttttgcaaattaattcgaccctcttctcactgatgccgtatccgtggcgcatgccgcgtaaccattggcccttgtacatcccttaacaacagagtcgaaatattgcccaaaaatgtccccgcgtaatacctccatccgcgtaaacttcagtgccgtatctgtacagattcagcacagttagataaaaagcgataaacggaacattacccgtcgtggagtccgctggaccaagtgcccaaataatgtgccaccgaattaatcgcttcccttcgtccgtaccgtcctttgtacccctgggtccactcgccctgaccagtcatgccgattaactttctgttcacctcctcttctcaccttgtacagccatcggcctctctgttccacgcccaatccgtgcctttttccgttttgccattgcccagcaaattgactccccgaaggccatgtgtacacgccggaaaccttcagttctgtgtttttattgtgccaaaaatggtacggcacattaattgcaagcctcgtcatttattttcaaattcattcattcatttcccatcactcgcccagttcaatggttgccaacctttccctctcctttgccaaaacaaccaattgccaatgttccatgtaaaacagtgggctaaaacagacgccaacatgcacccgtttctttaggtacggacgttggacctatgaaaaaataataatttttctttatttttggaatttaaaatgattataaatttttcgataaatttttaaattgtgaaatttaatttttcaattttatctaatttaaatgatgaaaatttatgtttaaataaatttttaaatatttaaacttaattatgtcaaaaatatatttaagtaaaaaaaaaatataaaaccctcaatttaaaaaaaaattttgcattaaaaatacaaaattttcctcagaattctaggggctcaattttccgaaattcggtaatttttcctaaggtagaagaccccctctactgaaataaagccccccccccccctttcaagggttgttaaaaaaaataattaaaattcactgctaggggctctatttcgaaaatacggtagaatttttttccacttttacctcaacattcaccaaattgtacccgtttgtgccaatttgaagtgcctttggctccaccacagaatcaatgaccgctatataagcaaggcaatggcacattggtaaggttggcgatgcttggcgaa

SEQ ID NO: 27684 - DNA, 535 bp, Heterodera glycines
tcatcttgtttattttttaaaaaacaatctttatcttaacctttagaatgtatcacttacttattttaatgccagatcagacttatgaaaattcaatttacctagatatccttaaaatattttttttattgatgctagccatttttaatagtaaaaaaattcagtatctgtcgtattgtccactgtccaattgtccggttctgtccaaatgacttcattgtccaaatgtccactgtcgaaatgtccactgtccagatgtccactgtccaaatgtccgggagccatgctaggtcatttcgtaaaatccgccaccttgggcgtttcgtaaaatcctccatttttgcaatttttcgcaaaacacggtataacgttgcttaagctcaaccaaattttagatttatgttaccattcgatagccaagctttttctctcttagctggaaaatttcaaacaaaattatcaaatttaaactaagttatggctgaaatagttcttattttcatacaacttttttaaagttgaccaaattttttaa

SEQ ID NO: 27685 - DNA, 825 bp, Heterodera glycines
cagggatgggctttcgcttccgcgttttgctttcgcatatttcgcttttttggcacgttcgctttcgcgtttcgcaatttggcgcgaaacgcgacttttacacccttaaggattggattaaattcccctaaaatttttcaaaattttacctataaaatggctaatttcagtgaaaacttgtttataaatgatcaaaatttccaatttttcctccggcggcgcctatcggcaccgccgcgccccaaaactattatttttccttagaaaaatgatacaaaaatcgcaaaaattgatcatttttaagtgaaaatctagcaacaaattttattaaattttcaaaaattttaccggcgccgcctgccccaaaatatgttaatatatacgttatattgacaaggagtttcgttgctaaaaccattttctcccggccgaaggccgggagcgccctgaaagtagtggaagggtcttacaactttttgaggagcatccgggaaaactatagagaaaaattcagcgcggacgactgagtcccagggacggatttctcattttttcgtgcgtttgacggcccataactttttttctgaaactcagatcaaaaaattcccgctgtgagggcactccgcagaagtgtcctctataatccagtatttttaattttttgatcagaccaaatcccggacctgtacagacacggagactcagttaatttttttttcccacttcagtaccaggtgaataccacgtccagggtttgacctgagcgcagggtggccagcagacttattgtagagtttattgagctcgatttttcaaatttaaaat

SEQ ID NO: 27686 - DNA, 1561 bp, Heterodera glycines
ttttcatgtaacatgtaacaaatttagaagcgggcgcgatcaccgaggccacgaagtgttcttatgagccccacaaatttagaaatgggcgcgaagcgcccataaattacttcaacttttcactatgataataaatgttatatgttaagagaagaaattcatgaaagcactgaaacatagccaactgtgcaccctagttactatatacgttatattgacaaggagtttcgtttgcaaaaacaaaatctcccggccgaaggccgggagcgccctgaaagtagtggaagggtcttacaactttttgaggcgcatctgggaaaactatagaaaaaaattcagcgcggacgactgagtcccggggaccgatttctcactttttcttgcagtttttcttctacgaaattttttctttggaccgggatcgcttagttcttgctggtaggattttaagtcagactatccccgacaactttgccagcaaaacctaagccctacgttgggcgcccaaggctgtagccttggctaattttttttacccaaaagtgtacacttcagtaccaggcgaataactcgccaggggttgctttgaccgaaaaattgtttctgagcaaaaatgtttagtatttgaaaggctatccaaccaagttttaaaatttcgaaatttttgaaaaattttcaagctaggcctaaaaaacggttttttggtttttgaattttaggaatttttaacgaatttttcaggaaaaacggagaccacttccaaaacatcattttttgagctctatcgactggtaatttttttggaaaaatttcgatttttttccggaaatagaaaaaatttttggcctgagcgggacatttgagtcccgggcccataactcgtcaggggttggttttagccaaaaatggccttagagcaaaattatagagctttttaagctctatcgaacggtgtacttcattttcgaaaattttcaaaaattttcgagctaggccccctagaaattttcaaaaattttttttgggttgaaaaagagggtgaaaaaattttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatggaggactggtcaatttaagtgaattaaagccttaaaaatagagaaaaatcaggagaattttatgggatttatttggaatttctatcttcaaatgaaaaaaagttattccagaatttctggaaaaatccgaattttcagaaaaaaattcagaactcgcttctgaaaagtcattctgtaaaagtaaaatactacaaaaatccgcaattttttgctctattatataaattttattttacatttttatccctttttaaaaaaaagttataaaaataaaagtgattttgggattcgggaccaaagggggtggacaggatttttgagtgaaaaattttttcgacaaaaattcttccaaaaacccatgtc

SEQ ID NO: 27687 - DNA, 1278 bp, Heterodera glycines
aacaacagcaatggcgctactttcaccagaggacgtcgcaacaatgccaacgcagaaggtcgtcttcaacgccccgttcgacaacaaggtcacctactacatgcgggtgcgtttggcgtggtgcgcgtggcatgcggaataacgcccccccgcccccttttcaggtgattaaccctgggacgaagcgcatcggctacgccttcaagaccaccaaaccgaagcgcatcaacatgaacccgccgaattttgtaggaagggggggggggggcgggggtggtaaaatttggcgtctgtttggtcggagggttagctcgcgtagaactcggtctgctcactccttgtaaattcaggtcaaaatgagttttagacaaaagtggtccttcctataagtctaccagtcacacatttcgtttggaattcgaatgttagccgcccaaatttggagataaactgaaattcagagtgtgcccttccttctgtttcaattcctgagataacactggtacaaagatgacgagatgagcttgcaaaattcacaaaaaaggaatgctcggcccaaaggagtccgccaacgtggccatctcctgcgtcgccttcgaccccggcagcgaggacaccaagggcgaccgtgtgaccgtggagtggaccaacacgccggacccagccgccaccgcgttcaagctcgagtggttccagtgagacgggatggtgcgccgcaagaacttgccgatcgagtacaacgtctgatggaaggatgcttcgtcacctcaacatggacatgataggatcccatcccaccgtcccaaaattgtcattttgtcccccatcatgtaaattgttgtatctgtatgtaaatttctgtgatcatcacttcaaaggaatgtatatttaattgttgcctatgtaattgtattgttgttgtgcttaataaatgctcatctgtgcttcaattcaaatgcttttgtaggaagggggggggcgggggtggtacaatttggcgtctgtttgtcggagggttagctcgtgtagaactcggtctgctcactccttgtaattcaggtcaaaatgagttttagacaaaagtggtccttcctataagtctaccagtcacacatttcgtttggaattcgaatgttagccgcccaaatttggagataaactgaaattcagagtgtgcccttccttctgtttcaattcctgagataacactggtacaaagaatccttcctttgaaaaagtcattgcttgccttttaattggaaaaattggcctttttta

SEQ ID NO: 27688 - DNA, 1336 bp, Heterodera glycines
tagagtagagcgggaccgggccgggaattcccggtcatccgaggtcccggttcccggtcccgggttttgaaaagctcaggtcccggtcccggtagggcaaccgggaaccgggaaaaacaagcactggtaagaatgggggtctgagtgaaaaattagtgaagaaaattggagttaaaggaaaaaatttagaaataataattaaatatattcataaagtagcaagaccaactgtgcaaatggcctagtggctagtctccttcactttcccttcttctttcccctggttcgatccctctacagaaattaaaatatttttaaatttctttttatatatactcatggctttcctatcgacaaaatatgattattaattttttttaattgtattttatcatttttaaagaaaatccgtacaaattgagcctagtaatcccaaaaccagccttttttgttgaaaatctgttaacaaatctcactcaaattttcaaaatttcccccggcggcgcctatcggcaccgccggtccccctttcttccgctaagttttttggaaaaagcgcgccgaaaaaatttatgtgaaacgtaaatctgaatttctaataatattcgatcacttagtccaaaaatgattaattgtttgaaagaaatgaagaaaatttgatttgaaaattttcattaatttattagctttaacttttgggttttattaaataaaaaactaaataaaaatttaattatttaatattttcacttgaaataaattaaaatttgatttttttttaattttttaaattttttgaatttttttgaatttttaaaaattcccggttggtcccggttcccggtcccgaagaaaaatcgaggtcccggtcccggcttctcaggtcccggtcccggttttgcccaaaattcccggtcccgctctactctaattattacttctaatttggcattcttttgggcttacgcttgtatttgaattacataaataaataaatttttggtttttagccttttgttacatacaaacaatgggacaagtactgacgatgcgaaagaatttaaaactcccataactttaacagttcaaaaaaacaaaacaagcgccaatcagtccctccctccgctacgatcagtctctccctttcccttcgctaatcactgtccgctgtctctccctctgtccacggctttcgtttcgatggttatcccgtgcatatctctgatttcacttcgcaacacttcgttgatcattttgtgttggttgacgcgggacactccgctgaattgaggcgactccacccgcacgtgaaacattgcgccgcaaccgccttaaa

SEQ ID NO: 27689 - DNA, 1068 bp, Heterodera glycines
  misc_feature (822)..(822): n is a, c, g, or t
ttgatcgaataaattgtaaaaataaaagatttgaagcaattttgcaaaatgttctgattttcgaccccaaaatctgattttttggacccgatgttctgattttgaaaatttttcgatccgaaccctgggctataatgcccgcgtggctgccatggtatttactaaattattgcctctctgattattaatatggttaagcattgcaactattccccaactaataaatactaatgaaacaaggcataacatgggattcggaccctgaaaaaaccagcatgggaacagtgattgcagtcttttgtcgttcattacaatttggaaaattctattttgacgaatatttttagaaataataaatttgaccgttcaatgtgtcccccgccaaactttgcaatacatcgctccgaaagattcattaggccgttaattgatttaattgacgttttgtccttagtaagccgtttctttaaggtatctaaaatttattacaagaaacgcaattaaataaattaataatgctaataaaaccataaatttcaaaaactaaaaattgatttcctatccaagttttattaaactacacgataaaaagaatataatttttttttaattttctgtctattttttctgaaaaaaacttttttttaatttcttaaaacgggtctaggcctcgaaaaattcctgcataccccatcttattgggttttggcaattgagtgccacacagctgagcccaaggccgccagcgaatggcattgttgaatgtgccgcctttgtgtaacgccgaaggcattcaatgcaaatgggcatgggtttctttanaaatttgaaaatggccaaattttcggtgtaaagaaattcgagatttataaatactcgtttacgtaattataatttttttttaagaaaatttcaccttctgttctatcgttatcaggtttatcagttttacatgatggatcttcacaaaaacagagctgatcaattttaatgtcatcaaagcatatattgcatgccatttttgggcaatcttcctcatttgaagtgtcttaattagtgagtcaatta

SEQ ID NO: 27690 - DNA, 661 bp, Heterodera glycines
cagataagcacgagaatcgcgttttccgcttggtttggggtgtctataatgacttttataatgcctattttttgcctatttcgggctttttgtgcttaatacgcctattttcaagattttcaaaaaaatgcttaataaaaatcaataaaagcgaaaaatacggcggtacgacaatgcggatcggcaattgcggaccggacaattgcggacgacaattgcggatcggcaattgcggaccggacaattgcggacgacaattgcggatcggcaattgcggacgacaattgcggaccgtacaattgcggacgacaattgcggaccgtacagttgcggacgagaattgctgaaaaaattaactggaaggatgggcctcgtcagtacgatcccttccgtattacaaattaaaaaaactaagtgtttcggcccttccatagacacaccaaacaagaaagctcacagcaataaataaataactaacaaataagaagcatactaatatggtctaaatactttgatcgatcggttcatcactctgatcgaatattgataccattcatttaattgctgcatcattttctctatacttttttgcacttgggcgaatcgaagattcgtcccccgtgtgttgtgaacttcatattttcgtaatctatctggtgca

SEQ ID NO: 27691 - DNA, 775 bp, Heterodera glycines
catcctctgccgtatccgccaccgcaaccgccgccgcatcctccgccgcatccgcatggggcaggcgcttgaggcggaggcccttcgcatccgagcgtcagtttgatggcaccgccaccgcttggtggaggagcaccgcaccctccgccgcatccgcaaccgcatccactaccgcatccgcatggagcaggcgcttgaggcggaggcccttcacatccgagagtcagtttgatcgcaccgccaccgcttggcggaggggcaccacatcctccgccgtatccgccaccgcaaccgccgccgcatcctccgccgcatccgcatggggcaggcgcttgaggcggaggcccttcgcatccgagcgtcagtttgatggcaccgccaccgcttggtggaggagcaccgcaccctccgccgcatccgccgcctcctcctcctccgcatccgcgtcggtttcgaaaggcgttcggtgcaacgctaaacatgcaaggctttcaattagccaatttaaaacgataataagtaatatttacttaaatgtcgtgaggaatgcttgtgccattgtggcgccgagcagcaaaagcgcaacacaccgagcagttgagccaatcatttttaagagcagagagagaagagaaacagctaaacgaaaaaggaactgatcagtgagtgatcaggtgatcacccacctgatgagtatgaatgaagaagcaagcggagaggaagaagctttgattgaaattgccagcagggcttgactgattaccgactgatgccg

SEQ ID NO: 27692 - DNA, 916 bp, Heterodera glycines
cgctttatgtccgagtcggaagcaagcgaatggagtcgcgggtacaaccagcaggagcagcggcacttctcgtcagcctcgtcatttgcaagcagttgaaactttggcgcaccgatggacgcggcgccggcggcgccattccgcgggtacgcgtcgacaacagaaacagataaggcaagttcatccgtgccgcccagcagcagctccagcaataaacactgtcattacccacgtgccaaagccaaaggattcccacggatatttcggtatggtgttctgttgcggccgcgaaaaaactgcatgcaattgtagattgtcgaattagcggctttttgggccctggaaataacgttttccgcatttacattgaggaaattttaaaaaaatttaattaaaataatttaacgatggaatttgcaaattaagcctcatctgttttagggcatactttagtttatggatttatccaaattattataaaaggaaaacgaaatgtttttactaagttaaaatatttttttattaagctttaattgttcatgttaagccacagattcgtcttctgctggtcgtttgcaaaaaggcggcgccaaaatcgatttggcgaaaagcgcactattaacaatggcacgggcaacggcaccgatgcaaaattgcgcaaatcatgaaaagatttgttggagagttttgagggacaacaaaacatttgagcaaatcgaattggaaattttgaagaaatattctgtttctgtcaattttgaattcagtaaaattctttcgtttgggaatcaaaagtttcttgtccgaattcactacaaaatcagtcggatcatggccctaaacccggcgtgggttggatcgcttgtctctctgtcccggttcgggctctccttggcattatctgagatttgattta

SEQ ID NO: 27693 - DNA, 932 bp, Heterodera glycines
ctataggggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaataaagtacagactatagggaagctattcccgaaggattcggtctccccataaatctgggcgcatcggttcagggggactgccccgaaacccaaaaaaaaaaatttttttggataaaattattt

SEQ ID NO: 27694 - DNA, 1258 bp, Heterodera glycines
acacattggaggagggcaaagtggatcgggacgaccattgttggagacggacaccgtcaaataactgaagaaaggggcaattaattagggaaattagggaatggggtgggggggggcaacggactggccaatgaacaaattgaacagggcgaaaacgaagccggacagaacggccaaggacaagtcgcagctgtacagaagcaattcgcccaacggaaaaagtgccgccatcggagcaaaagaagagaaaccaacgaccgatcaatgggcaaacagagacaaacaattaatcagttattaaatgatcgacccttaccaatcacggggagagggtggcagcagccgaagtaattaattaattaattattaattgataccctcgccgagaagagccattaatggagatgaccgattgaagcacagaattcagagagtgagggaagagatggccaaattggaaattgatcagccaaagtccaatgagtggcagacgaaataaatcaccactcaatggacggtttgttgaattgcgcaacgcaatgaattttgactttggtttcgaatttgtttttttttgatgtgagaataatccgattttgagaagtgacacaatttcaaacaaatggaagcaccgacagaaagaacaaaagtggcaaattcagtgaacaaaataatcaaaataaatgtgaaatgtgcgacatttattaaaattaaattttaaaacttacggaataaaaatttaatgcaaaaatgcgattttcaaactcaaaatatgtaaatccatgcaaacattaaaaaatattcgcataattcaactgcaacagcatcgaatatttatttagcatatttattttttattgtttgtttttttatctttttaaattttgtcgtcccaaaatgaaacgcttttcgttggcattgtccgtgcgcgttcttttctgccaatgtttgcgctttttgtgctttcgatcagtgaaaccattcttttctcgtcaacatttgacaatgcctttggctgaacaaattgttcaaattaatttaaataattatctttttatttttccattttttcattttccaatttttctgttcattatttggcccatttttgtccaaatttcccttaatttggcccatttttgtgcattttgtcacctttctctgttcgtcgtccatttgccatctttcgttattttctccgaccattgtcattcccacttttctgctacccattttcttttttccttgattttcttct

SEQ ID NO: 27695 - DNA, 1175 bp, Heterodera glycines
gctggttcctctgcttcttcaaagggcttcatttgcaaagagttcggccccaatttcaccttcttcgggaccactagaaccagaagacatttttcacagcaattcaaaaatattttcagtaatagttatgaatggcatggtcactcttttttgggccggtcgagaaacggagttatttattattgataagaaaaccattcatgagaactccaaaaatgcagtgcaataaactaaaatgccttcttaaaccccgctaaattaagatattttataaaccagtaatttataaaaatatattttttaattaaaaattcttatttcacaaataataaaataaaaaaacaagattaattattagaaattatttgtttttaatgaaaaatttgatttgttagtgtactgtcgaaaagtccttcactgtcgaaaagtccgctgtcgaaaagtccttctgtcgaaaagtccttctgtcgaaaggtccgctgtcgaaaagtcctagcgccatccaaaccacaggagaccgatgaaccccggaaaataattattcctaggaaaagacttgaagagcaaactcctgatcctgaatcaaattttgatagactaaattctttaactacattattactgacattctctcccttatttgcactatataatgtcaaaaagtctgcatcgggaattttggtattcatcctatcaaaatgattttaacgccaaccaatggtcttggatgatcaacagagttaggattccgttttacggactagcccatctgatcaaaaagcctaattgttgatcaatcatctatttctaattttgccgtacaacggtgccgagcattgcgcccagcatcaccgagaccagcgtggcactaaccattgtttttttgcgcaaccattccataacggcggcaccagcggtgcccgggccaagtcccgcgggcggcacagccattttatggggcggatgagaagcggcggaacgcggcatgcaaaagatcggtattgtagagaaaattattcaaaatacttcggctaaacaaatgtctattttaatatggagataatcaccgtaaaaatgtgtgctgttaaatctaaatgtgtcaatttttgcgggaaaaaatgccgcgtgatatttccgcattaattaaaaattcaaattaaaattaaattattttt

SEQ ID NO: 27696 - DNA, 839 bp, Heterodera glycines
  misc_feature (78)..(78): n is a, c, g, or t
aaaatctcctaacaaagcacacccaaaactcacaaagttttccccggcggcgcctaacggcacagccggcccccctgnttcccgaaaattttttggaaaaagcgcgcccgaaaaaaaacggtttttgaaaagcaaaaaaaaggtcatcggcagccgaccccccttcgcaaaaaatttttccgacccacccccccctttttaatgtatgtgccaaatgttgttttattcaaaattttagcattgcctggcccccgccgcttcaatccgtcgtgcgtattcaatggttgaagacaaattgtgcagcacgcgaattttagccgaaattggaaggtgacaatggcgatgaacagcggagatcatcgactcgatcagttcaggagactccttaaaagaaaaccaaaaaggcggaattaaaaaatctttaatcaaaaaggattctttgactttacgatactactggataatttgatttaatttttttcagatcttaccgtaaatggtccaatttttatctcgttaaattttagcatgtccataacattctttattctttgggtccgctacttttttgtgcctttttctccggccaaattcacctgcaaaaatgcgccataacgcccttttttggcgatcagctgagggcagcccaagttcaggtcaacaccgtcgcactttccctccaccaaacggcacgcactcagcaaagtttgcggatcattggcacaaaattggacaatcagtggcctacagtttgcaaatggagggtaaaggcaattttagagaaatggaaggtgggaagcagggtaagtcccagggggggggggggggggtacgcgcgt

SEQ ID NO: 27697 - DNA, 1513 bp, Heterodera glycines
tgctcaggtccagcctctcccacctgggcctccgttgcctagtaaagccaaaaagcggaaaagcaataaagttgatgaagataccgaaagaaaaagaagcagaattgactctcgaaagagggacttactggcagaggcagcctctgcccctttgccggacgactttgaactctcacaacaacccgggacctcggctcaagtcgagcctctcccacctggacccccgttgcttagcagaaccataaagcggaaaaccaacaaagctgaataaaaatataccgaaagaaaaagaagcagaattggttctcgaaagagattatcttcaccaagtgttaccaaaaatctgccaaaaaggcaaaagaactcgggtagcgatgcactctccgaagagcagcgtcgtcagtttgcagaggatcaacatcttttcagcattccaaattcgcaacttaccaatgagcaaaagagaagacggcttcagttcgtatttaatagaaaccccgccaagtacggtgttcagggtgacaccattttgaacagcgcaggaaacccaataaccgacagcagtgtcgcccaagcattagactatattatcgaacgcagagagggacgaattcctcaattcagacagccaccaggaacaaaattcattcgagatcgaatcaaccgagaacttattttgcgaacatggacggctccaccagtaccaccaagaggacccaaacggaaattgatacaaacagaccaagcgccagaattaaagcaaaaatcacaaaaactcagaggaatgagacaggcgagattcagggagcaagaaggattgatgcttccgtttccaacgaggggagtcaagcggaagtcgacggtcctgccaacagtagaaacggaaatcccaaccaaaagccagcgtctcaggccacaaaaatggaaaaatcaatagaaaatgtgttagaacgcctctacaatgacccaaaatcccctgctgcgttcgccggtgttgacagactgtggctggaagccaaaaaagaattaggaaataaaattcgtaaaaatgatgtaaaacattacttggagggacatcgcacctacactttgatgcgcccaaggcgcgtaaattttctgcgcgctcgaacgactgcagccggttttatgaccgattgtcaggtggatttggctgactttcaatcactttctcgacacaacagcggcaatcgttatttaatggtggtaatcgatgtcctttctaaacggattttcgtaacacctcttcgtaccaagaaatccgatgacatggtagaaggctttaaacgagtgttttcaactatgccaatgaaaccacacagaattttctccgacaagggtacagaattcagaaatcagcagctgaaaaaactttttgatgaagaggaagttgagaaatatgagagcacacattctgagaagaaagcagcattagccgagcgcgcaatacgacaaataagaaatcgggtgtatcgctactttgcacaaacaaaaa

SEQ ID NO: 27698 - DNA, 1207 bp, Heterodera glycines
taacttttgatgctgatcagaaaatcttttataccaacttgatcaaatcattccttcatggtgattagaaagtcaaaaagggcttgaaatcgggataattttagaattcctaggggctggaaaaatttttctggaaattttggatagggctgccagaaagagcacaaaattctctatcgaatttccttttgaatggtagggctacgacttgtatataaaaaattatacttgggttgaaaattggacaaaaagcggattgaaattaatttgtggtggcccatgtactggggtaaataaataatatacataaacaaaaaataatcagctaaaattccagtcgaaattttaattgtacaaatcttacatcttaatcaagacttttttccaccattgtagttattaggacaaataccatggacactaaatgccatgggacgcttaattaggacaaaccatggacactaaatgccatgggacgcttaaagtgtcttgggacgcgtaaatgccatgggacgcgtaaagttccgattaaagtaaactttagttcataacttattgtctccactttttcgaatggaaaaaaagtggggagagaaaagaaagacacgaatgtattggtgggatgtttatattccaatgcaggggtcatcaatgatgcacggaataggcactggacatatgaacggagagagggagttggagctcagaagggtgtgggtgataatgtgggtggcatggcgtcatcattctttcagataaaaattagatattggagtaatacttgcttctgcaaattcgttaatttttaagctacaagtaaactacctatacataaaaaaaaataaatttgatgaaaataaaattcttaaagattggagtacactaaaaaaagttgagattcaaaccctgctaaacattattatgcaccatgaccgaaaaaagaaattatacaccgcactgtgcataaccggagctctatttttcaatgccctcaggggggggcgggtctctaattgtaaggcaataatgggggggggggcttaattttacaaatcccttcttttaaaaattcgagatcaacttaaaataataatttgcattaatgatgccttttcattagtttcattttcacgtatgtacattcatggtcataagttataataaataaccgtctttgccggagtaatttccataataaagtgaattt

SEQ ID NO: 27699 - DNA, 1448 bp, Heterodera glycines
  misc_feature (43)..(43): n is a, c, g, or t
aatcgctgggaaaagcattcttttatacgttaacctgcaaaanagcgtccgaaattggtgctgaccattctattccctaaaaaaagtctcacacggaagcaatagtaggaacgcaagtagtacttttgccagtcttaaaaatacagcgcactgattcgtgcgatttatcagttttaaaatatgttggaagtcaatattgatgggttccgcgggttctaaattggccaggttgctgttttgaaaaactggcacatgaactccaacaataaaaatttcaatattcgtgaataattaaccctcgcatagaagtcaacatcacttttcttgcaaagcttcatgagcaataatttaaattgcttgtgattatattcaaacgctggaaaagcattctttatacgttaaacctgcaaaaagcgtcgaaattggttgctgaccattctattccctaagaaaagtctcacacggaagcaatagtaggaacgcaagtagtacttttgacagtcttaaaaatacagcgcactgattcgtgcgatttatctgttttaaaatatgtttgaagtcaatattgatgggttccgcgggttctaaattggccaggttgctgttttgaaaaactggctcatgaactccaacaataaaaatttcaatattcgtgaataattaaccctcgcatagaagtcaacatcacttttcttgcaaagcttcataggcaataatttaaattgcttgtgattatattcaatcgctggaaaagcattctttatacgttaaacctgcaataagcgtccgaaattggttgctgaccattctattccctaagaaaagtctcacacggaagcaatagtaggaacgcaagtagtacttttgacagtcttaaaaatacagcgcactgattcgtgagatttatcagttttaaaatatgtttgaagtcaatattgatgggttccgcgggttctaaattggccaggttgctgtttgaaaaactgattttgagtgtccccgaagtccatatcaaatgaaatcgaaatggacagctaatacagatcgaaactgaataaaacaaatgatattgtttgaattttgccccatttatgctgtatccgcagcattctaatttccatattttgtgcataaagtaaattgccctattcctcgacccaatcccgtcataaacttgatccgtctgttcatcccaatctcaagccaatcctgtccctctcatttatcgtgccgtttctattcccattcaccctttgttgcatatgccatccctttctctccttattcctgagataatgccgccatacccctcatcctatccaaaagacctacccatttgtgccagtatataagtcccactcaatttcccccctcgggggcttgcgacattgtctgcgctgaatcagtctgagccatttcttgactttggcaacccttctccaaataac

SEQ ID NO: 27700 - DNA, 945 bp, Heterodera glycines
ttggaatataaaaattgttccgaattgaacccggaccgggttataggaactagcccatttttcttaccactgatcaggttgtatttttccagtatttcccggttaaggacaaaaaccaattgaaaaccctgacaaactctccgttccaaaccctgtctctaagaattattgagaaaaaccttttgattgaataaagccaatggagaacagtaataaaagcacaaataatagcatttttaattgcatatagagtttatttattttatctgaatatttatttttaatggaaaataaatttaaaatttatttataaataattaaaataaatggtgagcataatttagccaacaaatatttgccataaaacggaaggaaatcgcagtcgaaaaacagaaataataaataatataataataacaaaataataataataataatatccaataaatgttatggaatgattttcacatgaataactcataaaatggaaaagaattttaaatttattagttgaggcaaccgaaatcaaaaataagcgagaaacggaaattcaattatttttttcgctacgaatcccgaatttatcatttttcattgcgagcacttccctaattgataattaagtttttgcaactcttttgtttatcttttctaaaattatgagttagtcgacttctgccaagcgtttttctgtccaaatgatcccttcccaaaatggtttcagctttgttcgttcacatcaagcacggatttgtttgtctcattcaccaattcctcaattcgatgctcttcaacaacggataaactaaaaaatgtaaaaattatatttaattatatttaaataagtgattcaagtctttctttaatttacattttgtttaacgcaatgtatgcaaaaaattcgcacataattcctgccccaattgcgctgatggctggttcatg

SEQ ID NO: 27701 - DNA, 963 bp, Heterodera glycines
tgttaatcatgtctactgtaaaatgcactattttcttgagaaatacaatacttttttagacaccgaaaatgaagatgtccatacatatatcagcaggtataagccgtaaagacttttgagatcattttgtacttattacattgggcctgctcaaaatttcccagaactcctaggaattttttttcaaaatttttcaattttcaatgtaattagtagggatgatatttttaggtgctaaaaactggcaaaataggtaggttttaggttctaaaaaacccgcaaaataggtgctaaaaatgggaaaataggtgacaaaaagttccgaatttaggggtctaaaatcgaaaattttcttttaaaagcaaaaatattttgtcaagtcattaaggatatacataattttcaaaatcaaaaactatcgacaagaaaataaaataaataaattttggagataaatttttgagaaatttttcatttcttaggggcgcatttttgaaaattttctggtcgattcttagggatgtattttttgaaaaaaatttttgggtcggttcttaggggtgtatttttcttttttattgcatttttgttaacaaattttgggcaaaacaccaaaataggtgaaaataagtttttaaaattttttttaggttttttaggtgctaaaaataaaaacctagaaaataggtgctaataactcgaaaagtagcttaacaacagccaaaaaaaaacatgtttttcgtgcatttcaggctacggggagctcaggaaaaaataggtaaaaacctaaaaatatcatccctagttataatttctcaaaatttcttcaaattcgctaatgtaacttaaaacatggccaactactttattagaaatcattttagaagataaaaacatgataaatctaaaatttactcatttttacgaaaaatcaacccgaaaagcgaaattttcgtttttttg

SEQ ID NO: 27702 - DNA, 1024 bp, Heterodera glycines
tttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgcgaacatttgtatggtacaaaatttctcgcaaaaaagagatagccatttttctggcatagagaataaatttaaaattccctgtagaatagatggccattgctctccgcgcccctctgcccatgctgggaacatt

SEQ ID NO: 27703 - DNA, 616 bp, Heterodera glycines
ccccgccactccttggccaaagtcaacgtcgtagaccaaacggcggagaatggcaacacccgaaagaagggggggacagagaggaagggaggggcgagcaacccaaatgtccaaacggttgagctgaggaagcaatcaattgctcagcactcgcagagagaattggtgatgaacggacgccccccccccggctatgaacggacgccccaccccggcgatgaacggacgccccctccggcgatgaacggacgtcccccgccctcctctctctctcttttccctaaagatgatccgttagtgagtaagaaaaacaaaattattgcaaatatgagacagagagcaggggacggataacaaatagcaacaaaatagaacataattttgagaggtctataagagaaaaagggtaggcaaaatagcataggaaagcacaggtccatccccccccccctccgtcctctgaacacaaaacaaaaaaagtcatgtatggggcagcgaaaattgtgcgctaaacacaagcccacaccccaccccacccctccccccaacctcaggcccgcagctgcacaaaacagaaaaaaacaaataggggcagcaaaaagttgagcaccaaaag

SEQ ID NO: 27704 - DNA, 737 bp, Heterodera glycines
aggaataaaagaaagcgtaagtaagcaatgaacagagaaaggcacagattaagtcgacgattaaagctcacaattagcacccaaaaaagacagtgaaagagaaagacattttatgcaaatttttcagcccattgccatttttgcaattcgttggacgcatcgcattccgaaaaagtgagcaccgaggaggacgggtccttctcgacgacgagacatttccccgattgtttgttgcggatttgtttcgtctcctgtaaacattatagcataaaggaatttcccatccgaaacacaacaacactcactctatcgtatttgaacggtccgtccaccgttcccttcgtgcaatggcccgtccgcagccgccctccccatccgtcagtaggtctaatgccttaattaacatttaatgagtttaaaccaatctctcccccgcattgttagcttacaccactccccctgcgtcatttgtccctccgtgttcagtttgattaattggtttccgccatatccgtggcatggcgtggcgcccattgtccctggcaccgcttggcccattgtgtcgatacattttcctgaacattcaacaatatttatttatgatagagaggaggtataacctgtggcgggatttttggcctctccccacacgtcatttggcggaagaaaagggtaacttacgaccacgtcataagcaattcgttcaagatacctttaataatacgaaaatttgacta

SEQ ID NO: 27705 - DNA, 2778 bp, Heterodera glycines
  misc_feature (962)..(962): n is a, c, g, or t
  misc_feature (979)..(979): n is a, c, g, or t
  misc_feature (988)..(988): n is a, c, g, or t
  misc_feature (1032)..(1033): n is a, c, g, or t
ggagagaagaatttatgagtttttattctttacccaaatcatttttattataaaaaatgttgggaatattttttctctttgctttatttgccttttctgatggagtattaaaagcacaaaaatgcgaagattgctcaaatttgaatcggttttggaccaatctctgtaaaaatgccgtgccaatgtttaaaaatgccgtgaatggggtacaaaaatttgtgtgccgactgagtcaactcgacgaattattggacatcattttacaagtggatttcgagaaatcggtgagaaacagggcttctttttttgtaaatacatatttttcctggattctccatggtctaaatagtaggaaaacatttcttttgtttgcgaacgaaaattgggacttttatttgtatattttttacatttttcatggtttttctacatattactatgaagaattttttccaaaaataatccttttaagattttatttacttatttcgcgatttttattacataaaaaaagaagcccagtaagaagttattattagggatgcgatttttaggcaaatgcctaaaatttttgcgcacttgatacgcacagataatcacgaaaaacgcattttccgctagatttggggtgtttacgatgacttttataatgcctaacgttgcctattttgggagtttttgtgcctaaggtgcctaattttagggtttttgaaaaaatccttaacaaaatgcaataaaaacgaaaaacacacccctaagaaatgaccaaaaaaaaattcagaaaatacacccctaagaattgaaaaaattttcaaaaaattgatcaccaaatttactatttttttcatgataaaaatttttgactaaaaatttatccttattcaaagaactttaaacaattgaaatataagcaagtttaagtttttgattaagtttttacgttgctacctaaaaaaacgttnaataaaaaaattctatnttgcctatntaatgactatttcgcgattttttgtgcctaaaaaatcgcatccnntagtttatttaatagaattagaacttattttatttttttaagtataaaattgaaagaattatggaatacgccaaaaaagaagatgcccaacttcacaaattgttgcaaaaattaattgccgaatttaaaaaaataaaccagaactaaatcttttgtgtaagtgtatttattcgtatgtacatatgtaaataatagaaatgaacattaattttgtcagctaattggtgactccaattttctattaatggtaattagatattaaattatttaagaccctcttggggatgagcagcaatacgacactgttcactgttccgtcatagaaagtgcaaattacttggagcatcgctttggcattcatttggtcgaactttggcacaatccaacggaatttggcgaaataaattcaaaaattgtgccattgattaatttggcacgaaatcatctcataggagacggacaaaagcagcagcagcaaaagaagaagaagaggacggaagacagtggaaaagaacggaaaaaagaaggcggaagaaaggacgagcaaaaacgaacagtgccaacggaggaggggacaaatagcacggggactaatggcattttggacaattggtcgaatttggcggggcgtaaaggtctaagaaacaaaaattaattgaatcattaacagcgttttcattcttcttaattccccggcattttcagacaaacaaagaaaaacgactcttcctttgattacttttttggcccgggattttatacgattttggtgctgtgccttttgacttatcttcttagtttcattccgcggttaataaaccgaaacggtgtgtaaaaaataacttcatttcttttattaacattcgaatgtcgaaaattggcacaggtcaatcgctggcaaatccatcacaacagttgctgaggaactccgcagaacagcatcatcattcatttttaactttaaaaataatctttcgttttgtcctattttataaagtgtccttttttgtttaatttgtttgttttgtcagcacttgttgctgtacctaaattatgctaatgagtgtttcttctcacttaaggcataacacttttcaacactttgcccactcgcactatttccgaaaatgaaagctgtccaatttgtttgagcgaatttgaggctaattctgaaataaaacagctgccttcgtgtaacgtaatttgattttggatttttaaatataacttaattacttttaagaaaatcaatttatttcttagtcttttcacactgaaatttataattttcagcacaatttccacacaacgtgcatggagctatggtatggtatacagtaaacccaaagcaaatgctcttttgtttttttaacaaaaaaaaagatttaaaaatagtaaattactttattaataataaacaaatgctatgtgcatatttaaggctgctgcaaaaagacaaatgcccattatgccgtgccaaaatatttaaaactgaaaatgggacaggtaataaatgaaaaattatcaaacagtggttgatttggacatcttttcagtcaaattgaattactaaaaaaaaatcacggaacgtttaatcataaagcaaagaaggaccaaacgatgaatgaaagaaaaattgaaaaataattacaaaccttttttgtttacaccttgaaaattttttaattttttctaaagcataaatggtatggacaagctcaattttaaagaacatgaccaatcac

SEQ ID NO: 27706 - DNA, 843 bp, Heterodera glycines
aacaacccggattggtttaatgtgagcaggaattttaaaatgcaaaattaaaatttaataatttactattagaatgctttttaatagcatcactctttgaggaataaataaaattaatattgatgaaattaattttccattaatgcattataaaattattttattctttcagccatcacttgcctaaaacaacaaagaaaaaaatggacagaaatgggatttttgggaattaacgaaatgcgaccaccgattagtacaaaaaattaattaattaatcactttctcttaatattctttatcatttttggtataaatgtgcaacttttaattacaatttaaaattgtgcgttttctgttcagcaattctttgagtgctttggagaactttagctgtcaaggatttacttggaaatcacagtattttttgttccaaaccattttattttctttaaaaggtttattttttagataaatcaatttttttgctacttatatcggcaaaccttcgaccggttcattaccctacaattcctcaaaaattttacatttaaaattctcttattccaccttcaagtcgaaaagactggcctgggcataagccaaaaaaacattgcgcagtgaagaaatagaaacttgcaaagatgggccgaccaggcgagggatgttgtactttttggctaattaaaactgattaataaatctaattaaaaaataatccaccggcgtaaagcactgccattgcattgtctcccgttaattcggccaactcgcccaataaatgaagctcaacatcactttgaatgctgctgcttccacatcagagtgacctccacggggcaatta

SEQ ID NO: 27707 - DNA, 947 bp, Heterodera glycines
attaattttcgcttttgtttttcctaaaatatagcctcccccccccttaattagatcccttgaaataaagcctccttcgagaggagttgaaaaattgagccccaggggggctttatttttagtaaaatggaaattttatttttattttttgctttttatacccctattaaaatggaaaaaggaaattttattttttatttatagtaaattgtttttaattttacaaattttcgatttccctgaaaaaatctttctcgaaccagcaaattttgtataaaaaatttgggcctggaattgtttttttcttgcttcttattaaccctataaaaaaatttcaattccctggaaaaagcgttctcgaaccatgaaatttagttcaaaaatcagagggttattaattttctaccttatttctaattaaatcagagcatggtttttaaattgacgtcgctcagttggcactggcaataaattttttttccattaatttcagggaattgtccaattgttgggcatggaaaaacagttggtgatggaacggaacagatttttcaccaattttggcaattgggtggtccgtatggagacaacgagccaacatttgcgagccgatgaagcaccggcacaaatacagtacaactatttccaggtacagtaaccgtaataaaaattatttttaattaatggacctcattaaatcattgtcatttttatcaaaaaaaaattcaaatgtttattttatttttattttttgctggactagatagaagccgcgttaaacgcatgaaaatcctttttaaaatggcaccctctactttgtgacggctcccggtaaattggacaccagaaaattggacaccaatggaaaattagacactattgtaaataaaataaataagttaaaattaaaaaaaaatttatggaaataaataatgttattattattt

SEQ ID NO: 27708 - DNA, 851 bp, Heterodera glycines
  misc_feature (646)..(646): n is a, c, g, or t
  misc_feature (651)..(651): n is a, c, g, or t
  misc_feature (672)..(673): n is a, c, g, or t
  misc_feature (810)..(810): n is a, c, g, or t
agagttgtacgggaccaggacttggtactgaaaaaacgcactactgaatactcaagtcccgattttgacttgttttgatcaccgggaccgggaaaagtcccgattttttcccggttttcccagccaaaaagtcccagtttttcaacccgaaaaggtcccggtcccgggtttgcccaaaattcccggtcctgtacaacttcacttttaattaataaattatatagcacaaaatgattgaatttggtttttttttttgttcgcagctattaaaaaaacaacaacaatttaattgaatttattttttcaaattaagaaatttgtcgaaaattatccctagatgacggaatttacgcaatttaagcaacgacaaatttatcaccaaattcatttgccatttctattttattaaacaaaatatttttaaatttccaagaaaaaaaaaattcaaaacaccaaaaactttaccctaagcattttcaattaaattcacaaattttttaaaattaggtgctcagtaagcctggcgttatggagaaattcttccccgatgaaccgcaacgcgttgccgcactgcgcgaagtgttcaccggtctgtggggccttgagaatgacgacgcggtcaccaacgcggttattgaggtattanatganattttttaaatttttaataannatttttaacaattttttaaggatgccatccaagggcccagggattatgtgctgaaagcgcaaatgggcgctggcaaaggcaatttctttgacgacgaaatggtggaaaagctgaagacaatgtcgctggaggagcgnggcgcgtacattttgatgaagaaaatttggcctgtcgctgt

SEQ ID NO: 27709 - DNA, 1208 bp, Heterodera glycines
gggactgggtcgttttggcgcccacgttttggcgccgacgatttggcgcccacgttttggcgccagggtcgttttggcgcccacgttttggcgcgaagccaaaaattaaaaagggaaagacgtaaatttcaaaaatgttgcaaaaaaaggaaaaagatttttttttcaaatataagtaaaatttaacaaaatgaaaaaataacaacaattcacgggttcatatgataattgcgcgaaatgccacgaagaaattccaaaatgatatgatgattttgatttatgtggtaattgtgatcattgtcatagtttggattcaccggattataattctgcaccaaattaaagattcgctcgtcagccacttggtatttcttagctttctgcggtggctcaagtccagcaataaatgacgcatacttcccatcggtgcccttctgctcacggcggagaacgtcaatgaagtgccagatcgatggatgacggcaattgaaggcgccttgaagactgtggtgttctgcctctgcgtagttgttcgtccttgcttctccattcagagttcgagtgtagacgttccattgttctggtgggaagagtggttgagaccaagtcccatttggtcgcggttgtaattgttgagcaacctaaaaattgcacaaaaattgaagtacacttctgataatgatgagaccaaccagtcaatgagcggtctgagtgccgcgacgttcccaaactccgtgtctaatgcgatgacagctgtcctctgatgtcactcagcggtagaaatgcgaccgaagtcaacattctgactgtttctgcaaataccgcatccgcgcaatagcgataaaaatacgcagattaaataattcaatagaaaatgttaatgtacctgccagagactttgctccttaatttttttttgcaaattccgtacgaagtggaagaagcaaaaattgattgcacatccagggaacgcattaacagttctgtttcgcgcagctgtctcaaagtcaatggcaaacgaagttggcgagaatgtcggccacgcttgccgcagaagttcatacatcctttggtaggatgcccgtggcttggacgtcaggaggcaatggcacacatcgatgaccctcggaccacggccttatcataattttcctctggtaaaatcaacaagagaaaaaacaataactgagcaaaaaggggtaaatttg

SEQ ID NO: 27710 - DNA, 815 bp, Heterodera glycines
  misc_feature (798)..(799): n is a, c, g, or t
taattttttgtctttatttccacttttgttgtttgccatggccttttgttggctgctgcgatgagcgaattgtctgaattttgacaatttaaaagaggccaaagaataaaaatgaaaggccaaaaaatgattggttggtcaaaaagaaagcgtaaaatgggtcaaggatatttttcaaaagatgatcgatttggggacaaaagagtaagtgattggtcacagtggccaaaagagtggacaattggtcaaagagtgatcgattgggtcaaaaaattaaatgattggtcaaaacaatggacaattggccaaagagtgatcgattgggtcaaaaaattaaatgattggtcaaaacaatggacaattggccaaagagtgatcgattgggtcaaaagaatggacaattggcctaatggtcaatcgaatgaccaactgaccccgttacgctgctgttcgtccgtcccatatttctgttgcgtttcgtgcttttcttccacactttttctccgttccgccccattttttccctttgatttgtccgctttttccgcttcctctttgtccggatgttcgtttttcagttggccttctgctgatgctaaaatgccaattgtgtggtgtcgccgtggctttggcaccggtttttgtctctcaactgcgacaaaagttttttcttccatcgcacgacaaaacattaaatttatgagcacaaaaagctataaaacaaatcaattattttattattattttgactaattacctaattaaattatgtctttggtttttctgcgcttatgaccnntgcaggcccatgcaag

SEQ ID NO: 27711 - DNA, 1209 bp, Heterodera glycines
caaaattttttccattaccgcaagagctgcggaaattgtgaattaattctcagaaaaatggctatctctttttaggacaattttctatctcgtaaccccgatgctaatccgttccgcagagcctcttcaaaatttttccattaccgcaagagttgcggaaatgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattcagaattaattctcagaaaaatggctatctctttttaggtcagtgtattatctcgtaactccgattcataagcaatttcggagaccctctccacattttctagggggggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagaaagataaaatttttaaaaatttttaattcctttttaaaca

SEQ ID NO: 27712 - DNA, 1208 bp, Heterodera glycines
gagtcacccccaactcatccataacgctgcgagtcatcgtcgtggcatggcattttctgcttatgtggtcttagccgtggacatttttgattatgcggtctcggtcgtggcattttttggttgtacggtcttagtcgtggcattaaatgccacggcgacgactcgtatcgtgctatggatgagttgggtttaccccgaacaattacagttcatagaaataagagaattttgctgattgtattgccgaattgggatctttcaaatcctattcccaagtacagttataatggaaatttctaaaattcaagaacgcaaaaaaataggtatatgaaaaatgtagtttacttaatcggttttttttgttgccataatgggtttattttttgcttccactgaccattttactcgtttcaccgcatgtgcttttttttaaaacgtatttgccattcacgtacgaattccatcccctgttgtatagccttttttacacatatgaaagggaatatcacacaaaaagaaagaaacataaatgatgacaaacaattaaatggaataatagaacaaatgaacggcaatttgtcagcggagaaagtgctcaaaagggtctttcattggttgccctttgttctgtgctatgccaccatttctcgctgccccttctgtccaatttgtttctgtcctcttcacggtcatcactaattggtcaagggcatcaaatgggtctttcggtgctgtcgatggccgtgtctcaaccattcctaaaatatgaatttgtgctcttccgttagttcgtttctctttgtctgctaatttaattttgccgcttctcccctttacctcttttctgtacgggattagcactgctattcggctgaggaattgttgggaaagcggcaaatgaggccgattgtgaaatgtggggcagttgctgattttgttgttggtcaactgatacggaatgagatgaagttgtgggcaagaattcggagagtaaaagttccatgcgattcgaagcttcgagcgaactctgcggacgttgttgaaccgactggcgggaagagagagaagacagcgaaaaggggtcgaacggagcgtttttcgacgccgtcaatgttttttccatttcgaccatttggccgtttttctctgccacaatgcgccgtttttcatcgagtgaaagtgctcccctaaaaagttcgaattaaaaa

SEQ ID NO: 27713 - DNA, 1913 bp, Heterodera glycines
caaagaatcgatgtgtttaagccaaccctacccgctctactcacactgatgtcaacatgataaccactaaagctaaagatgatgatcacacaacattatctaaaaaagcttactaatagtatatttacataaatatctttacatataatcgttttttacttgatatttttagaaaaataattattattgaatgataccataatattcgactatgtctaattaataatgatcatttgtgcaattctttaactgggatgtcttgatcaccatatgtctatctgttgtgcctgatccttaatcccggcacccacacatgatacgggacctgccgatacccggactcccaaaagctgatagtcctcatacggatcacgaccgcctttgttttttggtagattgatcaaacaaaagttttcggccatgtaaatcgcgacgctggagaacattggaataatttatgaatttacaaatttattttgattgtaaattaccaaaaacttttgtagaggcccattattttgtctctgttaattcaatatttcacaaaaattcaaaattttcatttatttaataatttcattggttgaggcacttaacaatttaagtcagagctcgaaatttttcatttgttttaaatttttttcattcaaaatgttgaaagtgaaaagggcgacgctgccaaagaaatgatcagtgaaatttttgaaataattaaatcagaatttttaaataaaaagaaacttaaattaatcttgacaaaatctcacgggttttccgactttttcaatattttaaattctaatcataaattacaattaaaatgtccatcgatgatttaaattaccattgttcagcggtgacaattttaacttgaaaatttattaaatcattttttaattatatgtgttttatttaatcttatacaatatttaattttttgtcataatttaaataaaagtaacaaattttattgatcatttacaatgataacatacaaatctcaataatatttatttttttctgttccattatttaatataaattaaaaaaatattgatttaatttgctgaaaattttcaaactataactgcattgtcaacacttagaacaaattaattaataattgggattggaatcgcattgaatgcctacaaatttcaagaaaaatcggcacgaatttttcttagtttttttaaaaaaggaaaagcaagccttgaaaaatgcataaaaggttaaaaagaaggaataaaaaaatgtaaaaacatcgtccatttcatgacaatggaatgacaacaatttcgtcagctccaatgctacatcctaaacaaattgaaaattttaaataaacaatttaccattcaagaccggacaggatcaggcacttttgtcaggattttccagggatactgacccagacatagggttcaggatcacggtaaaactgggatttgaatacgggtttctgcattattcccaaatcctgatcctgacttgggttttaaaacccaggatctgtaatctatcccgggcccgattccgatcacgagtttggtaaaggtcccgccactgttaaccctatcccctgccagattcccaaatgctgaaagaccatatgttcatatcacggaataatttgtcttatccccgccccagatcccaaatcctgatactgatccagtcttgattttcatgattttggcactgttaatcctattccgggcccaattcccaaatcttgctttgacttcgagttttggaaaatttggtctcaattttcatataataactaacaaattttcaaaaattagctttttttcgaaaaaccaactttcttttctctcatctaatcgttgctgaagttcatgtttgttgcacacaatatcacaataacacagcaaagtttcgcttggctt

SEQ ID NO: 27714 - DNA, 935 bp, Heterodera glycines
gcacggatcgagccggggataagaccattggaaagagcagctcgagctttacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatat

SEQ ID NO: 27715 - DNA, 1885 bp, Heterodera glycines
atattgggacacgaaaagaggtccatgggacacctattctactttacaatcaaaaaaatacgtcgccgctgaaaatttaaaaaccttatttttagatttaaaatgaatttaaaaaatgtttcccaccgctctgcgtctaaatccgtcccgatctctgatccgatcgcccgtcgttctccgtgtcaccgtcccctgcggcacttcgtcgtcgtccgtttgttgccgtcgtttcgtccgaggcgcaattgcagcgtctccattttcggcacattcaatgccaccaccggtaccaatggaacgcgtgcacattcaaatggggggaatgacgagaagggaagaggaggagggaacggacggaaggctaaacgaaaaaattgaaattgaaaagccaaacaaaacatagaaaatataggaaacaccaaaatttttatttatggttttatggcaggccgtacaattttttttaatcctaaatcttttgttgtcgttttcaagttaatttaaaattttggaatgggtcagccagcaattatcaacaagacgaatttcagaaattggtaaaaaatcaaacaattgaccttttactaaaatatgaaaatgataaacgaaaagccaaagaaaaaataaatggaaaagcaaattttaaaatgcacttttaacagtgacaagtcgtttccttttttgttagaaaaattcgaccgttcaaaggcacaaagaatgcaattaaaaaaatcggaaacctttgctcccaacaatcaaaggcagaaattggtggcaaacggtggagggaaaggcgcttcgcttttcgcaaatggcggcggtaaaaaccgattgttggcgctctgttcacctctcttctccatcaaagcgatgctcctcaaaaattaatgcgcgcacttttcttttttgcttcgtcgtcgccgccgtttgtctgtcggtcgatcggcaaaggaattttgagtgtcccgccgtgtgagcaaaagtaaaagttcggttggagttttttgttgcttgggaaaacaaataaatcgcttaaataaacaaaattcttttcgaatttaaaatgtatgtgtgggcgcgaacacaaaaaaaatgcacagacaaagtacgaaaatcacaacagaaaaaatggaggattaaagttcagaagcgatagaggggaaaaacaaaaaaaaaaccgacgaatttgagaatttcacatttcgaattcgaatctattaaaaaattgacgttttgttttttaaattttgtggcataatgttgaccattttcaaatgaattttaatcaattaaaaaatttaaaatttaaatatcaaaatcaaaataaatataggtatttcatttgtttggcttcttaaaaattacttaaaaggtaataaaatttcttaagcatttaattcagagttcccaagtgtgcttatttctaagatttgtgcttattttgaggggtcggatcttagaaagtaaaaatgtgcttatttctaagatttgtgcttatttcagcgttacgtgcttattttgtgcttatttttggatttgaaaataaaaaatgaaaaatttgaatgactattttgatttttcatttttttctgaagcgaatatttgaattaatttgatttaaaaaaaaattacattttatttcattttttgagtgaaattcacaaaatgccaccaaaacgtaaacatgtctacttggagagctacgaaaaagaattccggcacataaaaaaaagtcgaaaaggcgaagaatttgccctttgtgtcgtctgcaacgatgatattaatctcctttccattgggaaaaccgcaatttctctgcatcaaaaaacgggaaaacatcagaaagcggcgaaagccgcaaaccgatcaattccattgcatgaat

SEQ ID NO: 27716 - DNA, 1327 bp, Heterodera glycines
  misc_feature (25)..(25): n is a, c, g, or t
  misc_feature (51)..(51): n is a, c, g, or t
  misc_feature (68)..(69): n is a, c, g, or t
gcgccggctgggaaattttgaaaanttgagtgagatttgttagcagcttcnaacaaaaaatgttaatnntaggattaataggctaaatttgtacggatttttttaaatgataaaaatatgtgtcaattaaaaacagaggaatcaattttctcgataggaaaccaatgagtatataaagagaaaatcaaaatattttaatttttatagaaggattgaaccaggagaaaggagaaaggaaagtcaagaagactatccactagaccatttgcacaattgttgttatttttaaaaattatattaattttatttttcgctttaactcaaattttcatcactaatttttcactcagccccccattcctaccagtgcttgtttttcacggttcccagttgccttaccgggaccgggaaataaattttcaaaatccgggatcgagaaccgggacaccgcaggaccgggaattcccggcccagtcccggtcccgctcaactctaatttaactgttaaaaagatcccaaaatccacataaatgcactctcttacaacagacctcctcccttgttcgccaatttttttttggaaaaagagcgccgtaataagtgttttaaaacaaaaaggtcgttgcattgcttggcctaatcccaagctaaatatttgactacaaacgttccacaaatttaagtcccggtcccggaagggccccggcccaaaaatttggacaaaaacgggtgtgccggacccgtgatcccgtttaggtctacggccccggtctcggctatttaaaaattcctactctaataattattatgatttttttatttctgcaatataaaattaagcattcactcgtaaggcagaagaatgtccatgggcaaaattctcagcacacctagcgattcgttttcccattttataaatgtgtcgaaggattgacaggaggacaaagaaggcaattgcctctgctgataaaaattgacctcatttttgcaatttggcattgcctctgataaaaagagtgaaaaaatgacctcttcatcattttaagtatagttcattttgttgtgttttacattttttcactaaaataaaaaatgtaagatgtaaaaaagaaaaacatttttttttgcattccaataaattcagaattttgtacttacctatgtacaggtattttaaagaaaaaatgctaataaatctacttgtattacattcatttcttaaaaattaacgtaaataatcagcattgtttttgtgggaattgcacttacacaatggttattcattcatgcatgtctttccgcattcacacagtaaaaaattaaacat

SEQ ID NO: 27717 - DNA, 1109 bp, Heterodera glycines
aaaatttttgaaaaaacgctaaaattttttcaaaaattttttttattgaaattttcttactaagaaatttcccaagaattttttaatgaaaaatttctaggtttgaaaatttttttaaaaaaaattttcggtggggaaacgacctgctccccgtgatcaacacccccgaaaacctcaagtttcatgtttttattccaaaataataaaggagaatatgggacccccattcttcacgattgccattgttcccattaaagccacagctctgatccattccaggcgaactcatcttggacggggcctgcaaagacccgccgattgccatcgtcgagccgaacacagcaaatgttcattccatcgaggcgttggaggacggcgccgctttcttcgaccttttggtcccgggttacaacgacagtcgctcgtgtaattattacactctgtcggatgacaaggtgtactgtaatgccgtatttctctgtccactcattggttcgttcctttgttctttcaggtcaatggtaaaattggcatcggagacttcgtttggttggagggttcagaagaagtgcctagagaatttaccatgcaacagcttcgtttcgatccattccttatgtcaaataccaacagattcgattgaaaatgtcggaaaaatagtggcctaactaatttattttattacttttacactattttattgtttggtatacggacgggtacgataacttttttatataaattgctgattttcctcccgttttacgccttacttttctgacggacgataaaattgcttagaattaagtgactatgatgtgagacagatttgggctaaatgcggctaaagtaaagggaggggtgcattttattgtgaatggaagtgaaggcgatttcttttctctcccctcgattcggcattttgctggcttttcgtccgcttttccccaatgtctcttcgatcgtttgcctttgccattgttttcttttgcattttttctctgttcggcgcttttcgtatgcttatacgcttttccgaccaaattgcgtttatcagcgaacaatttgaagcggaaatgaatgtgtggcgtgaattgacggacgaaacg

SEQ ID NO: 27718 - DNA, 1109 bp, Heterodera glycines
gggaagcgtggggggaagggtggggagccacgcatgttgtggtacacatcaattatggaagccgcgcatgcactagcaacgaagtcctttgcgcgaagcgctcatgtaatgcatattcttttcatctctcacaagtatactgtctacaccgagcaattactgtgcaaagcataatgtctacgccgagcaattactgtgcaaagcatactgtctacaccgagcaattactgcgccgccacacgctagtttatattaccatagagaaaaagggggactcgtcttaaaaactaatttgagtcgaacggctgtcgggaggggtctgaaagtggtggaagggtcttacaactttttgaggcgcatctgggaaaaatatgggttttccgctccggtggacggttcagcgccggcggcgctgaaacggcgtgaaattttttttgtccgtctttggtggcctgtaactttgcgggaagaagcgggagcggaaaatgcttgctggtaggattttaagttggactgtttggcacagaatgccgttggtttgggggttctatctgcaaatgccaatgctgcagaaaatggcaaaatttggcacccaatttcggcattttccgtttttcgcgaataactcgctgggggttaagcggagcgggttggcgccgcttgagcatttgtgcagtttttaaagctgcatccgatggcgttttcagattttgaaaattttcaaaatttttcgagctaggccccctcgaaaatttttagtttttgaattttatctttttttgccgatttttcccaggaaaacgaagaccactttcaagcaaccgtttttcgagctctatcgattggtggcatttttgaaaaaatttcaaaattttccggaaatagaaaaattttttggcctgaccgggacatttcagtcccgggcctataactcgtcagcggttgattttaacgaaaaatcgtccaagagcttttttgtagagaatttcgagctctatctaatgtgctttatccggtatttttatctttaatataaaaaaagatataaaataaaaatgaatttttaaatgcaaaaccaaaggggggacccccatggatttgcatttcat

SEQ ID NO: 27719 - DNA, 529 bp, Heterodera glycines
ctatttgccatttgttatttataaaaatcataaatacagaaaagtgctatgagcacaaggacacagtggtgccaatgattggcagagaagtgccaaagttgggcggcggtggtacggcggacgacgtgcggtgccaatcagctgcaattgacagcggtgatcagcaacaacaacatctcggcgaccgcattgcgttggacggcacttcgattgggtcggccgaataatgcaaatttcgcaattatttttttaacttttttcagttttcccgtcaaaatgttggcccctttgctcgtcgccaaaggctccaatggaaatgggacgccttttgagatcaaagtactcttttgaccaattggcacgattatgaggccttattttactcgatcaattatttttatgtaaatatttgggttttcctaccccaccggcaacattttcctttaaaaattgtgttgttttccggtggacaacctccgttttgtcggtcttccctggcacatcaccggatgtgtccactcgctgtgcg

SEQ ID NO: 27720 - DNA, 1305 bp, Heterodera glycines
ttgcccacttggaatgcatttcacaatgtcgaaaaaagctcggcattgcaggtgccgcaaaagacgacgacgacggcatcattacggtgcccatttcgcgcgttattttcgcgcagacggcaaacggttggtgaggcatcgattagtccagcattttaaggacagcatcgagtggtgaccttgaatttccaaaaaaaagaaaaattttgttggtcttacttataattacaactgccgattaaggtgtgagacaatgacggattctgttccgtgattttggcagtttcaaagtcccattacggtatttaaaaaaaaaaattaatttttcggtatcctcggttttctcaatcctttaagccctagcagatgatttgagaaagctcttttttttgcaaaagcctggctaaaatatgcaataattcaaataatttaaaatattttcaacagcttgaacgtagcgaatttgacgaggaaaatgaaatttcgccattcaaccgccagcaacagttagcgcctgaagcgctcgcttcggttgcgcgtccgtgccacaacacctccttgcgcgtgcggcatgcgttggctgatgcgcgcgcattggaatgtgccggaatgtcgcacaaaagggcggaagtttgggtcagcgttcacgcgttcaaacggatgatgagaaaagcggaaaagaatttgaaagtgaagaaagaggagaagaacgcaaaacaattcgccaaatgaatcaattaaaatggcaacaaaaagcatgtgattgattctccttttgtccaattaaaaatgccaatacccaatttaaatcatttgcacaattatattcagcattgaaaaataattgaaaaaataaaataaattatgataaaaaccgagatttatcaatgatggaaaataatatttaaccatcataggataagtcaaattattatttttttgttaggtaattttaggttaaataagtatgtacttttttaaggcttaaatttattcccaaaaaattttttattaaaaatcttttgaatcaaatttggattttaactcttttctgcttttatctttttaaattaaaattaatattttttcgaaaatagtttaatttattattttttgtacatttgaaaaacgcaccaattataaagctgaattaaaaatttagctgtttttgttgtttgtgttttatgagaagaatgttttttggattccttttttgggtggagtccccaagcgaagcaattccattgattttcagtgttgcctccggcggagtttggcagagtaatgggctgcaattgcgcacca

SEQ ID NO: 27721 - DNA, 1338 bp, Heterodera glycines
  misc_feature (1333)..(1333): n is a, c, g, or t
gaacggtgctaggtggcgcaattaaaccaattttactatccatgggatgacgaaatttggggttttcgggttcaaaattagtcaaaaagcacgttgtaaacgttattggcacttatgaaatctcaaaagaacatttttgggttctaagtttcagtttttcgtcaaaaaacacgctgaaagtaagccaaattcattttccgttcttttatgagtctagaatttacctgcttgaaagctcaatcccgagaaatttatccatttttttaaagacaaacaatacattttggaatggatacaaaaaaatttttcatttttacgcgagtgtctatataaaggacgcttttctcacccaacattaatttttaattcgcctcatgcatactttttttgagctcctttcgtcaaatcaattaagcaaaaaaatagtttttcactaaaaatcgcggacctatcttgtattagtctgcaaatttcaaagactttcgttgagtttcaaaaaagttatggtcaaaaatttccaaaaccagttttttgaaattttctatcagtggacatttcgacagcaaaggacttttcgacagaaacagaaaaaataatggacttttagacagtaaacataaaaacaactaattcttattaaaatgaattatattgcttgtcagttttactaaatttattattaacatactaaaatgtattgtataactctaagaagaatgaaaaattttctcaaaaattaatcaccaaaatttatctttttaaaaataatttatctcaatactgatctggcttaattttgttgctttttcgataaaattttacgattttacacctctaatttaggaacttaattactctttactgtcgaaaagtccggcgcccaaaaaaacatgtttttcgtacgtttcaggccacggggagctcaggaaaaaaatagcctttagtacataagaaccgttttatttttcgaattttttaatgatttttttttgaattttgagaaattgaaaagttttgaatccgttttacaataattaaccagtgtcaatcagctaattttaaaaattttgtacttaggttcaaataatcgcaaatcttctcggtccatgagtcatcgaagctcttctgctcggtacagtttcttttttgaacagtgaaaaaaatgaaaaaattccgaaaagactttttacctatttttttatttcattttttaaattagttttggcttggtagctaacccaggatcctcttttggcaccgttttttttgagctgctcaatgaactcaattagtttttggcaagtggaattcccgatttgggttattcagctgntgatg

SEQ ID NO: 27722 - DNA, 1086 bp, Heterodera glycines
  misc_feature (25)..(25): n is a, c, g, or t
ttttaatgattgcgtcgcaattatntggaactaataccaacaaatgcgatatgttcacttctcaaatgcataattgtattaagggataatgaaaggaaaaatccattttgccgattcatatgatgagtgaattgagttgtgcgttcattttgagtcaactttcaacaaaattagtcaaatcaaaaatctacgccgcagttggcagaaaacgcaacgccaataaattttcaaaaaaatttacgaatggctaacgtgtgggcgacatgaagtttgggcaccgggaagtttgggcaccaggaagtttgggcaccagaaatttgggcaccgggaagtttgggcaccagagggagggatttcaaaaaaataaaacaatataaatatataaaatgttatataaatcattaaaatttagtaaatttaacaacccttgtgctcaaaaatttctatgttcttgaaaattaaaaaatttttatatggaaacctggcaatcttataatttagtcaattcttatgtactggtttctgtttggacttagacctgaataccgtcttattgttagttgggcccgaaataacaagagacccgtctaatactatttaaatttataaattttaaatcttgaacatactgagccgatttgttggatttggatgataaataaaaaagtttaaccaaaaacatgctggagcccaaacgtgagggcccaactgacggagtccggtgggtcagttttttactgggaattgaagatataataattattaaaaaatatgcagactggacaaagaactcctttttccaagtcccggtctctgccatttcaaaattaaggtctctgatttaattttgttaggaatattcaaaaaaacccttttggaataacaaatgcattttctgatttcgagtttctttcagcaaatgttgctgacgcttatgtaattagtcccgcaagtaaaaatgatcacccaaaatagtcataaaatatcataaattgaacaaatctaagggccaatcattttatgcataaatacgaaagcttgaaagaaacattttttaaaatttggtttccattgggctaccgtacc

SEQ ID NO: 27723 - DNA, 931 bp, Heterodera glycines
  misc_feature (914)..(914): n is a, c, g, or t
cccacgcccttcagagcacgacacatatttcaacaaaaattgtgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcacagatccttttggatagtcagcaatcgttgcttaacttgccagatcggacgggtgcgcatgactttctgaataaaatatgatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggngggactgccccgaaaac

SEQ ID NO: 27724 - DNA, 1058 bp, Heterodera glycines
gtatacaatccggaaaacccaaaactttccaaaaaagttttggtattcttcgacagcggatccgaacgctcttacgtcgaaaaggcactggcctcatttctcaagctggaagccaaaaatccagcagagataaccctgaccgggtttgcaggtgtcgacttaggcacctacaccatgcacatgacaaaattgtgcatgaaaacggcgatgggagagaagaccatcgagccggaaataacgactcgtgtgctgcgtgagatggctcacgtcgaattcaccgatctgtacgactctgattttgaagcaacgcaactgcaacccacccaaacagagtcactacagccactggtcctaattggcactgactactttgccgattttgacatcaaaacagagaagcgactcccatcaggcttttgggttgccaactcaaaagtgggcagattaatcttcggcaaaggaaacctttcaaagccaaagatggcgaaaaaagtcacttcaaccgccatctctcaagaggcagtggaagtacagcttcaaaacgacgacgacggactgaattcaatggtcaaacaattctttgatctcgaagctgctggtatggctgatgctgcccatccaaccgaaaatgagcaatggttggaccatttcaataaggagctccacttcaacatggaagagaaacgctacgaagtcgcgcttccatggaacaacagggctgaagagctacagcccaattatggattggcacgaggaagactggacaacaatttgaaaaagctggacaaagaaaagttccaactttacgatcagatcatctaagagcaactcagcaaaggcattgtggaaatggtgccggatcctaaggcatggactggcaaactgcactatttaccgcaccaagcggtaataaaggatgatcatcaaacgacaaagttaaggatcgtctacgatgggtctgcccacaccaaggacacttcctcactcaaccaatgcctcgacaaaggaccacagttgctaaacgatctgatcggcatcgtcatgcggtgccgcatgtc

SEQ ID NO: 27725 - DNA, 1115 bp, Heterodera glycines
  misc_feature (65)..(65): n is a, c, g, or t
atttcgtcaaagatctgaggcttaaaagcaaaaatgagcattcgcttattcatcagtgtataccnccaccggggaacatctgtttgtccatgccgagcggaacgagtgtccgccgtgaacgtgccgttgccgagacgccgccgggcacaattggacagccgccgacagcaaaaaggaacagcagacagagacggaggagcactttggggggaagaaagtgccgaaatggaggacagaaagaggagaagaagcagttgagggaacggagatgaacagcatcaacagctttctgggcatcattatcatcatggcatttttgtggagcatcagtggagcattgtgtgtagcagcactccggcggaaagcattgcttttgcaagctaatttttgccatcgccgaggcattcatccgctgtcgagcggaacactgttgttctgttcctagtattgcagcatcgacggcaaaacaattgctgttggaattgtcggtgatgctcctctgcctcgtcgccgaacccgaaagtgccgtcctcgccatttgagtgccgtcgattgagtgggaggggaattgtggtggatgacggcgatgaaatcaaatggacctgtaaacgaaggaaggattgaatgagttttggcatttatatgtgccaaaaagcagtgggaattaatgggtctgctcatgatttgcggtcagttgagtttgaaacccaagtctatgaattaaaacagactaatgaggaggagaaaaatagcaaaattataatggcacgagacggtcggtcgggcgatgactggacaaaaaatttgcgaaaaaaccaagaccaaaataagcaattcccatgcgcaaaatggggaagccaattttggcacgatgagacaaaagggaaataaaacaaaaacttattgggaaagaaagtgtggccaatagaggagaaggagaaatggatctttagttctattacctaccatatttgtaaaaatagacatgttcaaatgcaattataaatttgaaaaaaaattagtttctcgggagaaacaggtgaaacaacacaagcaaaacaaaaggggacggaaatacatatgttatgacaaaggcacaggaaagtgaagaaaaa

SEQ ID NO: 27726 - DNA, 1068 bp, Heterodera glycines
tattttggagctccggcggtgccgataggcgccgccggggaaaatttttaaaatttgagtgcaatttgtgaacaaatttagtactaaaaatgacaatattttgtgattttaatttgattagattcacttaacacaacccactgagccacgcacactattaaggtaatgaagcaaaaatataccaaaagtatatttatttctaacttacaaaaagccgatcattaggggtgtaaaaaagtctcggtctcgaaagtctcaaagaccgagactgaaatcccgagacttgagaccaaaaaaaaaccgagacttttctcgagtcgagactctcgaacatcactacttagaattaacatttttctgttgcttattttgagaaaaaaaacaggtaaacatttactttctattttaatcgttaaaaaatgaatggctcgcttaatacaaactttgcggataatctcttacattgtaatccgaaacatattgctgtgtctgtcataaaaccaaacattcatttaaaagcaagcaaataaatgtattacaaaagcatttctgagagaaaatgatggcatcaaatcaaattccaattgtgtgagatcggcttttctcaaatataattaattcacttccgcgcagtccgacgatatttcgatgctttgacccgctttttcttcttccgctggtggccataaggcctgtaattaaacacaaattaggtgtgaactgtgaattatcttttacacttacccatacgaacttttgccaccatacaaactgaattggacattgttcaaattgtcgtcccaatttttttcattttcccattgatccgtcgccgccttttcactaattggacatcgcttcaacagtttttcagtgaattcacttctccaacaagtaataatgtcagcttctcattagtccgttcgttcatcaattcaaatggctcaatgggcgtcgaatcataaagttcaagtcggatattatagctgactgaagcggtggcacagagaaatgcctaaaaaaggaagcgaaaatcaaaggcaatcaatcagtcaatcgtttatgtga

SEQ ID NO: 27727 - DNA, 1661 bp, Heterodera glycines
  misc_feature (1639)..(1639): n is a, c, g, or t
agtacacgtgaacgtgtgattcagtccattacgttccttgtacatggtagtgagaagtttgtgattacacaacactaaagccttgttcgctcagcatcactaagcagtctgttactaacgtcataagcagaacagttaaacaaattcgtgaattgatcaagcaaactcatctgagcaggagttagttacacgaaaagtgaatgcgtgctttttgaaagaatgaatggtcgaatcactcactacacaccctcaaaatttgtattcaaattttgcgctaaaaaattcgcttcaaaaaatcgtacatagcagcctatttaagtgcagattgtatgcttaagtatacactttaatccttcattaaaactaattttttgaaaaatggacaatttcattaaaaaaagtgaaggagtttgtatgaataatcagtttcagcatgaggacaaaattccaaaacaacaccaacaacaacaacaacaagatcaacaacatcaaactgatgtgatcgaacatgatcactgctacgcacgccccacaaaccagttatggaaattgaaaagacaaaaatacatgttgacatttaaactatgtaaaatgtgtgcacaagagctatacaaccgtaaggacgacataacagagtgtaacgatggaggtgtggacttgaactttcacctgtgcaaacattgtacaatgctcaacatgcgactcagcgatatgaattctgtgcaatttatggcatatcatccacgtaataacaactacaacaacaccaacaacagcaataaaaacagaaacaataaaaacaacgataatgacgaaaatgacagtcaaaataacttttggtacgataattacggtcctacatactgtagaggtggtccaagaaacaactacatgcaaggaaaacgaaagtgcttggaaagaattgacatggacgacatgaattgatatttaaaatattaaatttttttatttgtaagttatgtacggcctctaaacggattaaaattgattaattacatctgtgtccaaatttttggtggccaaatataaagtttaatcctttgactaattaccgcgtatgtgtattctcgggcctaactatggacaaagcccttagtctttgtggtcctgtgcccctaatctgatgattgattgacacattcgttttgatcgtcgcattgtatgtcccccacaaccgcgccctatggcaacaaatgttctttgtgacatccctcactgagtgaaagggcggtgccggagtttggaccaaatgatctcattctgccattcttgtaccattttcctccgttcgcttcgtttttttcgctacataattttaaataaaataatccaaatgagcaacttcaacaacagcaacaataatacctatgccgaaactgcttatgccccaactacagacaacaatatccctgacgctcagcgctggtggatttgggctgacgaaatcgaccaacctcccgctgagcgccaaattattcttggagtaagtctgagctggctgggtattgatatttccatcggtgcatgtgtacccgtgccatttcagcaacatgagcgaccgggagtggccctactcgtaaacgacataccgatgcctatatacactgtggaaacaccngtggtggattcatcaattacaa

SEQ ID NO: 27728 - DNA, 1592 bp, Heterodera glycines
atatttttttgcacggatgggcttaatgtgccataatgagagaacaatacaattacgcgagagcagtaagcttacatgtaattaaagtggtttatctgacatttgaaattggaaggcattttttaaaatcaacaaaaaaaaattaattgaagattttcggcccggatttgggatgccatcatgatcagactgaaaattgcagcagcaaggcccgcccttcccgttccctagtcgcccaaaaaacaatggccaccacgaggacagagagcagtgaggaagtgcgctttatgcggtgggcagacgtagcaaaagtgggcgagtgagcacggcgaagggggcgtgtcttgtgatgagtgatggcggaagtgacagacattgagagagactgagcatcactaagggttacggtagggcgccaattcaaacgcctgtgaaggggctttagtcaagagagagagacgaaaggaccattcgttcgttgggcgatgctcagcacaagtcgaattgtaatatgagagagaagtgatattttccgagaatagaaaaaccaagatcgagattttacacttaaaaatcgaaattctcttattaaattttaagaatcatttttcgggattctccatataaatttttgcctctaattttgagtcaattaatattctttaaaaatttggggatggtttgtccacagcggttggccaaaatcggaaataaaaagtgaggacaaaaggtgaaaagtgaatttttgttcagccaattttattaattttcaaaattaaaaatctcgcttctgagatatgatataaaacgattttattgttttctgggtcaaagctttttctctaacatgatgaaaatcctttggtaatagaacagagattttgtcttaaaattcaatttttaggctttttctttatttggaaaatacttaaatagaaaataaataaattttaataagtaacgaacgcaaatgggaacgaacccatgattagggtgcggatttatatattttatatatttattctgcagctttattttgatgagaaatgcacaaaaaacctcctttttagccgaaaatattttcattttaatgtcattatcaataaattttaaaaatatttaaactttcgcaacaaaatatttacgaaaattctttaactttttatctgctaaatattttggcattttgaattttgcttgtttttgtgcaaaatccgttcacgaattaggcaaaagtccaccaaaaatccccggcggcgcctgatcggcccatttttggattaaatctttaaatagtttcattccaaaatgctgaaattgaaagtcggcttaccgggattccaatacggttttgtctggatctcaatcccggtcctttttacaaaaaaaagctaggaccgagatcttggaaactcctggcgggatcccgaccccatccagtctctagcaatatgcaaattaggctttatattacgctttaataatgtgctggtttttgactcttttttttatacctttttcacatttttcgtgcctattttaggtgcctatttaagaaattttcgtgcctaaaagttcgggctctagtaata

SEQ ID NO: 27729 - DNA, 1446 bp, Heterodera glycines
  misc_feature (624)..(625): n is a, c, g, or t
  misc_feature (646)..(646): n is a, c, g, or t
  misc_feature (649)..(649): n is a, c, g, or t
  misc_feature (685)..(686): n is a, c, g, or t
  misc_feature (693)..(694): n is a, c, g, or t
  misc_feature (698)..(698): n is a, c, g, or t
  misc_feature (739)..(740): n is a, c, g, or t
aaaaaaaaaaaaaaaaaatttttcttttttttttttttttttttctttttttaaaaaaaaaaaaaaaaaaaaaaaaaaaaatatggggggggggtggggggggggggggggcccccccccccccccccacccccccctcctctcttttttttttgttaaataataaagaataaaaaatatattttattaaaaatttattttttttttttttttttttttttttttctcccctccccgggggcggggggggggggggtggaaaaaaaaaaaaaaagaaagaaaaaaaaaaaaaaaaaaaaatttttttttttttttttttttttttttttttctccccccccccccccccccccccccctctcttttttttttttttttttttttttttttttttttttttttatctaaaaataaaaaaaaaaaaaaaaaaaaaaaaaaaaaaagggggggggggggggggggggggggggggcccccccccccccccccccccccataatgttttggcgggggccaaccgaaacaccgacgacgctccctccccagaagagccatcgccgacccccgctcctcgctcgctcgcttcgcgagtgctctcgtttttgctcgcctcgcaatcgtcgnncgaccggcggcggctgcgacngcngagcaaacagaagaagaacactcactcactgccgcnncacagannaagnccatcatccctctttctctgcatatgtctctctttactctnnttagatggatctctctctctctcgttcactatctcttttctctctctttctctatctcttctctctccctttctctctctttccctatgctctttttaagtctctctattctctatcacattcctctctgttctctattagtctctcactttccttctatgtctctctatgcctttccctctaggcaaaataactaaaaagataatttaaattttgagaaaaagctgatccacagttagaataaaagattaattattgaatttttgcatgagtttgtcataatgtttaatcatcttttaaacttcttagtaaaatttaaaattaaaaggagaataattagatttccgaattctgttaagaatttttttttggcatttatgggataaaaaaacatttaaaaatgttttagaattatttgttctaagacctagcccttgaaaaggcttaatttttgatccttcaattttttctataaaccgaaaccctaccaccactaccagcgagcgagtgtaatgagtcggtaaagtgtgaaaatcaaaggaaatgcggcggcggttggatgcgcctgtgctgcatccgatgctccgtctctgattggctgtttccctcgtcggggagaagccgatttcaccaccctcatttcttttcttctccacaccacccaaagtccacttccttcacccaacacaattcaatttgacttcaa

SEQ ID NO: 27730 - DNA, 1249 bp, Heterodera glycines
cggtcaatattttccaaaccatcggagtggtggacggaggaggacaaattggacaatttcacgcaaattgaggcacttatttataaatccaattataattatttagggctttctttttttaattacatttttcctggattctccatagcccctaatgaattttttcgtacatattttgcaatttttgaggatttttcaaggaatttttattgtgtcccaaaaaagttcataacttagttattattttttttttgaaaattacttttaaaacatcgattttaccaaaaaaaaatacaaaaattaatttttaaatactaaaaggtgattctaagcctatttagctcattttttggcattttgtgcctatttcacccgttacaaagaattaaaaaaaaatttaaattttatttatatattggtggttttatactatatttcatctttttagacataatttatttacatatttagcgatttttcttacgtaaaaaaggaagccctaataattattaaatataattcgaattttaataaatgtaaataatttaaacttgctcagattgcgggcgatgtctacccaagcagtattgaagagccccaagtgaaggaaagggttggaatttgctgaaaaaatttaaaaatgaatttataaattagggactttttggaattttttaaaatatattttaattcatttcgaattttttaatttctaaaatttcaaaactcttaaatgattttttcttcttcgacttcaaagggttggaatttgctgaaaaattaaaaatgaatcgacaaattagggactttttggaatttttaaaatatattttaattcatttcgaattttctaaaattcttaaaaatcaaacataattgattttatttcttcgacttcaatttgtttttactttaagcctgaagctgtcaaatcaaaacgccaaagttggtccaaaaaatttgaaaatgcactgaacgccggggacaccgttgtaatcagaggcaaaatggggaggccagaaatgggcgacaaacaactgagtctgtccttctatcttatgcacaattcgcccgaatttaatcgttacggtaggcattttctaccgtttcccaattccttattactgtatgccttttttcatttatttttctctctcattgtcagtgtccaaagttgcctggtttttgttccaaaaaggatggcaatttgacgatgggccattataattttgcggtatgaaatgtttta

SEQ ID NO: 27731 - DNA, 926 bp, Heterodera glycines
catcgcccgggggggggggggggaatttgcaaattgcccggaaacggggcattgtgagcggcctcatttagtgaatattaaatcactaaacgaaaacaaaaaaaataatgactcgaagaaaaaaaagccattcgtcggcataaaaacaattaaaaattagggacattccattctcggcaattagccgctttacacatttccaaatttggaccaatgcgatgacccactcaatcaaaaaacaacaaaacaacaaccagctgcgggcaattcatttcccgatttattggccgatgcgaaagcttcgtttcgtctattttaagccgatcaaaaacataattagcaaaaataattattataaaaagcaaatgcaattttaatttatatattcatttaaaaaattatattcaatgaaatttataacttagaatgttttaacctattttcttgttcattcccacatgcgccaaccttttgtgaatttattgccccccccccccccgctgccgacagatcaacgggaccaattcgcaacaaatgctcgtaaatcagtgccacgaacaatcctaacgaatgggcgattaaaagagtctggcgattcggctaaaattgtgttcatttaaggataaaagggaacacatgcgaaacataactaaattttgacagcgaattttggcgttttttcgctaaatttgaccttttttaaatggtcatttcaattccaatatttttttaacgtttcgttccattaataagaggtgaaaatccactcgacagcaccacagatattcatttgttccattgaaattgggcagcgaagaggacaatgagcaagaaaatgccaaaactgtgaatgtgggcgaaaggatggcatatcagatagcaattggacggggattgatgctgaatttggggcggggggggggggg

SEQ ID NO: 27732 - DNA, 1060 bp, Heterodera glycines
cagcatttctcaatttgcagaatttgtcatatttatatatttagttttttgaaagtttatcccgcataaaacagacagtctttgattttcgccttttttagattatttgtgcagaattctattgacaagcaattaatgtgataaaggaaatgcgatcgttcaacagtaaatctcatcagtatgactcatcaaagaatttccaagagcttttgtcgcctcgtctcttccagcgtcgacaacaggtttaaaaatgcataaatatttaagaattgccatggaatttcaattttcattaaattcgatctctctactttcattagcataatttttaaaatgaaatgtttaattttggagattttagtttttcaatttgttttgttttttagaatggcggtacgattgttcagcgagtgctccaacagcagcaattccagcaaatgttccaacaatatcagctccaacaacagcagcagcgcgaatcgccgcctccgtccaccgtttttggcaacagttgtgatggcactttgtgccaaagcgatcgtctgaccagcgactcatcggttggttggttggcattccgttttgatgtgtttcctttccattttgctacccaaaatttatattttgggctttaatatctgccataaacatttgtattaaaaattatgagtgaaattggaacaaaataaaaatacatttttttacgtctttgagcccaatttacttgaacatttatcgtctcacgaataattctttctgaaatttacatttatttcaactaatgttttaatcgtggacctggatccaatttggacctaggtttatggacaaaatcagaattatgaaaaactcgggttgccgaaaaatggcctctgggccttggtatgaatccaactatgattttaccttttgggggtccggcgatgccgattgggcgccaccgatttttttttttaatttaacgcattttgctaagaaaaaataattcaaaattttaaaaaattgccaatttttcttggaaaaatttttcatttcggggagggggaatttacccaatctc

SEQ ID NO: 27733 - DNA, 1514 bp, Heterodera glycines
  misc_feature (148)..(148): n is a, c, g, or t
gtatgctatatacagttttttcactatttttttcctattttctagttttttattttgcacctaaaaaattatgaaaaaaggtagctattttggtgatggtggcacggagaaactcctaaaaaatatcaaaatgctgtctcaccgcacnccatttgtaagaatcgtatttgtagaaaatcagccaagagtgttctctgtctgtcaataggtataatttcaaaaaatttcgttaattttcgaaaaagttttgagaacattgttattcgaacatttttggccataacctttttgaaagataccgaaaattttttgaaattttgcaagcgaatagagaacacttatttgttagtgctactggatgatatcaaggattaaatttagttgttttagagcaaagttataagcaaacatttattattttgctggttttttaaataacgacatagcaccatttgtacgataaatgtagaataagagcaattgaaaaatttaaatgttgcaacgacaaccacctgaaatcgttgacccatacaataatgtccataaagaattatataatctttgtaacacaattgcttcggttgcccgtcgatggtcggagtgtgcaattatttgggcaacgcttggctagcagttgcatttggcacatcatcaccaatcacagcgtggaacaggagatcaccggaattgattgacataaatctttgttaataaataaggattttttcgggccaaaatggcatgaaaacgccaaaaaaggcatttatggcacgaaaatcctaaaaagaataataaaacccaacctagaagcttcaaaccaagtagaaaatgtgttatttgtgcttaataatatgaaacaagtgcgcaaaaaagacatttggctcaaaatgagcattggacgcgtatacagaaacaacaatttggagaagaaaggaaaattcacaaggactttggattaatttggtcaaaagcatccacttttggggctttaaattataattatataaattttcaatatgtctaagtaactatccttttgaaaactttttgttttttgtaactctttataagtatttattttgattggataacttataaacatgaacattttttttcttaagaatcaaaatttttgaatgttatttgttttaatttttaattttaaaataacttagtaaattattagttgcttttcatcaaaattcaacaaattgtccatcagtttctttaattcccagaatatatcccaagtttttttattttaatgttttgagcagattaatgaagcatatgactagtctagattgatattatttaatatttctaatattaaataaacccacaaaaaatgccgatgagtgaaaatgaattcgattcgcgcaattttcttgtcattctcggtttattaacttttaccgctacataatatattattttccaaagatcaaatgcaaattgcgtatattttttttattaacttaattaaatctttgtcactaattttgatttaaata

SEQ ID NO: 27734 - DNA, 1911 bp, Heterodera glycines
tgaaaaatttggctaattcctaacaaaattcattaaaaatccttaaaattttctcccggcggcgcatatcggcaccgccggctcccaaaaatctttttttttctaaaaattggattagtataaaagtggttggcttctcctccgccacttcattattataattattcattggccatttatttgtattcgtctctctctcttcgacttttcgccctaacaatgtccttaaaagtgatttcggagtccgaaatgggtcaaaatggatgtcaaaatcgattttcccaatcttaaaaactcaaaaaacaaagtttttcttagaaaaaacaaattttgaaagataattataacaagtacccatttttacaaggcatcaaaaattgctaaaaattagtataaaagtggttgctcctcctccgccactttcattattattattttccattcgccatttatttgtattcgtctctctgtcttcgaccttttctccatgacaatgtccttaaaagtgattctgtacgttttttgcatttcttctcgacatttaccattttccttctcattttttagtctgatcgctgtaccaatgtttatgatctgttgtgccattcttttgaagtattgggaccgtttcaaaaaaccaccaaaacaacaacgaggccatcgcaaaattgagaaagtgccggaaactgtcataacaatttgcctcgacgaaattccagacaaccaaaatgaagcggaggaaaagatggcaaaagcgatgtgaaactaaaattaaaaattgccaattttcaatttagaatttcctttttttcagtttcatctccgccgactgttggctcggagtgttcgatttgcttccgacttctcaacttggcctcggaattgcgatgatcagccaccgatttgactattacgtggacgaacatttcaaaactcgcaaatggacattgaaatttattcgaattcgatacaaaatcgaagaaaatggcacaaagcaaatggaaattgtcaattacgattggaaaccaatgccaattccgcaaaatcaattgccacgcaaagtgatcggattcgaaaggatcatcatcacgtaaaattgacgcttaattgattcttgtcaacacttcccattcattttcagtttcatcgaccgaaatgtcatcgcttttctccgccattttcgttcacttttcgcctcattctgtccaattagtttggccatcagcacgaccaatgaacgcatttcggagttcatttttcacatttggccaatgctcggaaaaaactgtcgcgtgatggaattgcccgctccaattttccgccgtttgcgacatttcgtgccgtcaattctcaaagattgtatatcgcttcgcgttatcaacacctattcctatggtttcttcaccgaattccctgccgatgacagtgctacggcaacggatggacaagcggtggctaaatggcttttcactccacgtccggacaatgtgccaaaggtgttcaaatgctacttggacaaggatgatgcgaatttgacgtccaaagttgaagcattcaaaacggtgctttcttttattatttcatatttcgttaatcaatttttcccgtattttaggcttttgccaatgcttcatctcccgccaatttcattgtctccatttggtttagttattttgctgactccgttttggcctttgattttaccaacgaattgactcgggaacaattgacactgaaaagaactgactttcactactgttttctgttgatccgttgtccaattgcgcgagacgaaagcaaatgggcgaaatgggaaaaggaagcgattgactggcaaagttatggtcaatggaatcgaattagcatttatcctatttttgtggatgacatcggcgatgggtcagcgaatat

SEQ ID NO: 27735 - DNA, 1078 bp, Heterodera glycines
aaaagcctgagatgatgcaaaagcaagcaaatggaaaacgtcggaagggaattgtggaagggtaaaaaaaggaggggggaggtaaataagtaatcccgtctatgaaaattcaatttattttgaaatttcctgttggataaaggaagttgtgggtgaaaagtgagggagaaaaaagggaaatagaaaggggaagagaggaaagagaggggagaaggggagagggggggggaagaaaatgggagagaggatggggaggtaaggaaagagaaaaagagagaggaaaaaacataggatggaagagagtgagggagcaagagagagagacagagagagagacaagaaaaaaagagagagaaaaagagagaaagacatagagaagggggggggaggggcggcagaagaactgctaatcaaatactatcaaggtcaaagtgataaaaaggtattcccaaacgaacaaaaacaaaccgagtcaaaaggagtcactgaagaaatgttaggcaccggcggcgactgccaacagcagccaaagttgggaagaacggcggaggcggcagcttggtgaagtccaacagaaacgttaccgttggacaattcgttggcaccgacgaggccacccaaagcaccggtggacatcaaagatacggcgaaagacgacgaattggcggaggagggagacgaaacggcgacgcacagaccccccgggttggcacagagcgatgccgagttggccaaacccacgcccgtctccggttccgatttgctgtcggccccatcgttagccaatgccaacgcagtctccgccccgaatggtgccgtccgcttcccctccctccgcgcgtgtcctccgttttgctgctgcggcgggtgtctcttcctcgccgactgcaattttgccacttcctctcctccttaaccattttaaaggccattttaacaaaatgccaagatggtgtcgccaccgtccggctcctccgcgctttttcccgtcggcaccgccgtttgtgccgccgccatccgtgccgatttcatcgcagccactgtctgcggtttgttcggcttcgattgttgtcgtgct

SEQ ID NO: 27736 - DNA, 817 bp, Heterodera glycines
cagtgtccgtttgggggtactcaaacatttatgtgggagcaaaaatccaacgcagaattaaagtacagactatagggaagctattcccgaaggattcggtctccccataaatctgggcgcatcggttcggggggactgccccgaaaacaaaaaaatcgattttttcaagtgagtgtccgtttggggtactcaaacaattatggggagcaaaaatccaacgcagaattaaagtacaggctatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcacaattaaagtacagactatagggaagctattcccggaggattcggtctccccataaatctgggcgcatcggttcagggggactgccccgaaaacccaaaaaaa

SEQ ID NO: 27737 - DNA, 919 bp, Heterodera glycines
aagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaattaacaaccatttttaaaggagggggggagaacacccaggcgctttaatgaacaccccctgacacccaaaaaatttccaaaaaaaaaaaagagattttttttggaataaggcggaaaaataaaaatt

SEQ ID NO: 27738 - DNA, 1627 bp, Heterodera glycines
  misc_feature (125)..(125): n is a, c, g, or t
gcaaagggctgcgaaacatgaaagtggtcatgccctcgcttgcgccctcgatgagcatgcacgagggtcatcagtgtatgtaatttggtgtccgacatttgcgctgtccaataaaaatagacatntagataagcattgagcgacccactgaaaaaggtccaagaggcgaaacccaaatcgaaacacgtccattttacaccaaaaagcagctgaaggcgtttctcaaatattacttaggtaaattttatttacaactattagaattcttaataaaaagtctgaacaagcacccaaaattgatcagtctaaatttttcaaaaataaaaaataacaatgaattagacgaaattgtagaagcttgtgacgaacagaaacaagcatcaacattactgttaaagtattggcgccaattcaaataaataatgttggagtgttacatattacagaatttgaatttggcgcacttcgattattgattaatttggtgacgtgtcaatcccaccccctaatcgcgaccttagcaagctcattggaaaaatcggatcgccaaattccattacgattcggaatgcggcaaggtggttcaatcctcctgttgcaatcaaaacgtggaaaaagctggctctccaaaacttgacaaacccgacattgaaacacggaactgcaatgaagtcccgttcaacatcgaaggaaaatttctctgcaccgtttgccaacccaatcaagcacccaaagagcttgtggcttatggcagctcagaaattaattacgaccttttcggacggccattgattgaagctttggaagtcatctcacgtaaaatcatgtaccccgacatccacccaaaatctcaaccagccccagcagaaatcaacgccatggccattccccagccgacgcacaaaatttcggatttggtatcgctaacaaaggcactccaggctgatttttcggatgtttttggccccggattaggccgttgcacaaagccaaggcccatttgattcttaaacccgatgctcacccaacatctgcaaggcacgacccgtcccacacggcgccctttaatgccgtcaacgaagagttagaccggcttttgcagattggagcgatcaaacgaattgagttcagccattgggcagcaccgattttggccgttatgaaaaagaatggaaaaacacgagttagcatcggtttttccaccggcctcaacaatttgcttgagttgaatcacctcttgccccggcctgaagacatttacacggccatcagctgctatgtctatttctccaatctcgacctctgagacgcgtacaaatcgtcactggcatcccaggcacgtttgcctacctagacgacggcataatcgcctcataaaagcttgaagagcacatttctttgctctacaagctcttcaaacaaattcaggaattttgcctataaatccaattggaaaggtgcaaattcatccaaccgggttgctttttctcggcccatttcatctccgtgaaaggaactcgccccgaccccggacgatcagaagcaattcgccaaatgccgccaccgcatgatttgagcaaccttcgtacagtctcggcgcattgaattattatggaagatttattaa

SEQ ID NO: 27739 - DNA, 1258 bp, Heterodera glycines
gcgaagcggccgaaggtcctccacaaaattatgaatgcggcctcgcgatgcctgtagactgaaaatcccttatcacatccagaaattcatttcaaaatcgagcatgcactagcaacgaagtcctttgcgcgaagcgctcatgtcagcgcccgcccatatataccaaaagtatactgtctacaccgagcaattactgtgcaaagcatactgtctacaccgtgcaattactgcgccacaacacgctagtttatatatatatacaataaacttgcagttcgtagaaaaaattataagtgcccgtggtttgcccggagggggctgaaattttgcaggcaggggtaacttttgattgcgcatctgggaaaaataaggaaattccggtccggaagccaactgagcgccagcggcgctgaaacggccaactttgaaaaacgagctcggttttcgggctgtaacttttctcagggaaccgggagcggaaaaagtccgctgagagggcacaccccagacatgttggctacaactttatcactgatcactttttgatcagatcaaatgccgagcctgtagaaattggcgactgaacggcgctcaaaatgtcggttttggcttttcgtgaataactcgctgggggttaagcggagcgggttggcgccgcttgagcatttgtgtagtttttaaagctgcatccgatggcgttttcagattttgaaaattttcaaaattttttgagctaggccccctcgaaaatttttcgtttttgaattttattattttttgccgatttttcccaggaaaacggagaccactttcaagcaacagtttttcgagctctatcgattggtggcatttttgaaaaaatttcaaaattttccggaaatagaaaaattttccggaattgagctccccatttccgtttaaggcttataactcgtcaggggttgattttagcgaaaatttgtcttagagcatttttgtagagaattttaagctctatctaaagtgctttatctcatgtttttatcatgaatttaaaaaaagttataaaattaattgtgattttgaaactcaaaaccataggggggaccccatgtttttgcatttcatgaaaaaattttttactcataaaattgccaaaaaatacttttctggggtaatttgaggtgctgaacacgaagatgcactttatattgcgttttggattttttggagcctgtgaggaaaaatttgaaaaatcaataatttttggccctgaaaa

SEQ ID NO: 27740 - DNA, 1008 bp, Heterodera glycines
ctcttcatcctcctcttcatccccctcctcttcatcctcctcctcttcatcctcgtccgtcgttaaaaatctccccccccggcccgccgagggcgctcttcctcgaaatccagtttatgcaaattgcagctgcgctgcttttcgggtcaccagcccagcaccagtgtccagcgcagcaggcgagtgggccaaggccagcagctgctgtgctactgttttggccagccaatacataatgccaatgtcaaacaacaaaattggacaaaaggacaaaaattgggggaaatgagagagagagaaggggaaaatggagaggaaaaaaagtgagagagaatgagtgaaagaaaaatgataaagatagagggagaagagatagagagagaaagacaaaaggaaatattgcgataaaagtggagctaaaagaaagaaggaaaggtaagtggaaaaaagaaaaaaagaaaagagtaattaaaattaaatgggtgcaaaataagtaggtcaacaatgggagagagagaaagaaagtgagaaaggcgagaaaaggagtaattaagaaaaaagtaaaataaaacggaatgggagaaaaagataaaaggtgaaaagagagggagagagagagagagagaaggtaaaaaagagaattaaagagtgaacgagagaggaaacaaggaggagggaaagagagcaaagtagaagatagacaaagagagcggggagaaaaaagagatgagaaaaaaacagaacgggtggagagaggaaaaagagaaaggggagaggagagagggagagagaaagggggaaaaagagaagaatagaagtgatagaaagagagagagagagaaggagaattaaacagtgaaagagagcgggaaaagagaagagggaaagagaggaaaaaagagagggagagagaaaaaggaggaggaaaaaagagagagagaaagggaaaaaagaacacattaatggtcagttttttgcccgttgggaacgatcgtcggccgcgatttc

SEQ ID NO: 27741 - DNA, 1393 bp, Heterodera glycines
aaagaggctgaggagatcatgctcagaaggatgccgaggctaaagccaagaaagacgcattagagaaggctaaaaaggatgccgaggctaaagccaagaaagacgcagaagagaaggctaaaaaggatgccgaggctaaagccaataaagacgcagaagcaaagaaaaaggaggaagaaatgaagcaaaaggctaagcccgaagaaaagcctgaggcacctgccgaaggcgtggccgtagtgccggaagcgaagaaggcggaagagacaaaggaaaagctgaaacaggaagagaaaccaatggaagtgccaccatctccagcagaaaagaagagaaaagaggctgaggagaagaaggctcagaagtatgccgaggctaaagccaagaaagacgcagaagagaaggctaaaaaggatgccgaggctaaagccaagaaagacgctgaagagaaggctaaaaaggatgccgaggctaaagacaagaaagacgcagaagagaaggctaaaaaggaggacgaggctaaagccaagcaaagaagcagaagagaaggctaaaaaggatgccgaagctaaagccaagaaagacgcagaagagaaggctaaaaaggatgccgaggctaaagccaagaaagacgcagaagagaaggctaatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagaaaaaggatgaagaaatgaagaagcaaaaggctaagcccgaagaaaagcctgaggcacctgccgaagccgtagccgtagtgccggaagcgatgaaggcggaagagactaaggaaaagctgaagcaggaagagaaaccagtggaagtgccaccatctccagcagaaaagaagagaaaagaggctgaggagaagaaggctcagaaggatgccgaggctaaagccaagaaagacgcagaagagaaggctcagaaggatgccgaggctaaagccaagaaagacgcagaagagaaggctaaaaaggatgccgaggctaaagccaagaaagacgcagaagagaaggctaaaaaggatgccgaggctaaagctaagaaagacgcagaagcaaagaaaaaggaggaagaaatgaagaagcaaaaggctaagcccgaagaaaagcctgaggcacctgccgaaagcgtagccgtagtgccggaagcgaagaaggcggaagagacaaaggaaaagctgaagcaggaagagaaaccagtggaagtgctaccatctccagcagaaaagaagagaaaagaggctgaggagaagaagactcagaaggatgccgaggctaaagcca

SEQ ID NO: 27742 - DNA, 1050 bp, Heterodera glycines
  misc_feature (35)..(36): n is a, c, g, or t
  misc_feature (128)..(128): n is a, c, g, or t
gggtcccggggggccggggtttccgggctgacgcnnggggcaaggtgtgcatgggtgctaaacattgacacactcatggactaatgctgctgcggttgttcagattttgctcttaccgggtgcactgnctcacagggagtctggacggagtgtccgggctgtccgggcgatccgggagctccagggtttccggggcgtccgggctgtccgggcgggccagccgggccaggtcctccgcctgagcaacagtcttggcagcttccgtagccgccgctgccaccgtacacttgacgtgccgtacggtttccgctgacgatcaacggcagacccttcagctgactcacttctgaccagatgtccttggcattgctctgaaggggttggcattttgtcacctttcaaattgtgccattgtttttacttggcatgagctgagctcagagtccatcttcagcccaacgttggacacgtagctcttcagcatcggcagcgtgaagcaaaccgaaagcagagagatgatggagaaggacaccgtggagtaagccacgaagcggtaagccttgatgcggccgtcgaagtccattttgaataagtttgagccttgagggggggggggagaatgagtgttgggataggacagaaaaggcagaggaaaagcctttctcgaaatgagggaagtctcgagaaggacgaagtgaggagatggtttggtaggctgtgactgtttggagtgatggctgtgaatggtgagaagtgatcggagagggcccaatttataggggattctttttttgccgggacgcaacaaatggcctcgggggaggggaaaggcggggccaaccgcgcgacgggcggagtatcgccgatcggtgcgcccccactttttgcacatttcgatgttttttcgcgcacttcgacactttcgactgtccccgtggggccaaagcgatccatcggacggacgaatttggtcggccgatacgacgacaaaaccggtgagcgatggacggacggaatgactgacccacccatggacggccaaacggaggg

SEQ ID NO: 27743 - DNA, 1270 bp, Heterodera glycines
ttcataggaaaaatgggtttttacaaatttagcagcccttactcctaataaaactcctaaaaggtcaaggcggggaatagtgagtccgtcaggctggtcctttcccattttcctgggtttactcgagatcgggaatagaccaaggaggaggaaaaatttccgtccgtctctgcccttgcaaaagcatttggggaagcatcagaaaaaacatgtagctgtagtgtactgtttttcgtacggaaagtgtgtcggggaattgtgatggtttgtccatgccaatcgtttcgcaattcttgccatggtatttgttctttgtccggtatgggctcgtcccagcccctggacttttcccacatactctggaaaaatagtttagctcctaccaggcagggggagcataatccgaggggatcaaagaatgaagcaatggtttttagaataatcctacgggtcaatttttccggtgacggaacaatagggaatgagaaaaataaggtgtccgaactgagaatccatttctgcccaagtacaaggggttcggtttcagaaaggtggtcttcagatggcacaacacttagaattctcgagtccgctgcgacaaaatcacggagacgcatttttgcggatgagaaaattttttgtgcctcaatggccttttctctcgcctcctcagggcattcagctaataaaagtaaattgtccacatacagcagggaatgctgttggatttccttggccaaagtgcctggcgtggtttccaaatggtgttggagagtggccgctaacaaaaatgggcacgaaacaatcccgaatgtaattcgacgaaagcgatagatgaccaaattatttccggaaagaggggaattcgggtcccgagtcctcagaaatttggaaaattccctgtctgactctttcaaactaatcattagaaaggctttttctatgtctgcccacacagggtaaatagtagccctaaattggattaatttgccggctaaatcctgtacaaattaggacctgcgaaaagtgtgtcatttaaagaacgcgagtcgcgttcatgggaagaggcatcgaaaactatacgtaatcgtttgccaaccacagtgtgatggggtaaaaagtgttgaggggcatttgtccgggtactttcttcgatgatgccacgattcaaatagtcttggagaatttcattgcacccgttgaaatattgggggtgcctctcgaaattttcgtactaatgtggaaaaggcgagaaaaggcaatgcggaaa

SEQ ID NO: 27744 - DNA, 1577 bp, Heterodera glycines
ataatatgatgaattgcgagcaataagtagagcgaaaattattagtgctcgaaaaattttcaaaatcagaatattttgtgaaattgcttcaaaaaagttatttaagttttgaaatttgagtgcaatttgcttacagattttgtcctaaaaatgtgtaatttagcaatttatgaaatttttagaaaataaaggatttagggtccggcgctgccaataggcgccgcccggaagtttttttctttaattttggctagtttcaacagatttttgtccaaaaaatgaccaaaattgcgtcaaatttaaatttccagactaaatattgacattgccatataattttataattatgagtaattttaagaaatatgaacaaaattgtgccaatatcccaaaatcggaacgattcttataaataaaaacatttttaattttctcagatttggaccttctaaatcagaacatttcttaaaaataagaacagatcaaagcattgggttataatattgtaattgtttagatcttaaaaataaaacctttatattttagcagttttttgtccatgtttttcgtccacataaactgggccattccagttttaaaatcattgtgcatgaggcgctattgaagcaaaggctgagagtgtgagcacttctaaatcatttagattctcaatcttatcaaagccttgaaccaaattccatatagtcaaggcattgtggctgtatgttttttaagttctcgaattcttagcccttgagttgggtccaagtcatactaccacagcttattggctgcaaaagggctgctagctaagctccggacttaaactttctttttttgtttgtgctttaataatgtagtacaagctcattgctctgaattttgtgattatagaatatgcgaaagtatttatttgtgtcctttccccaatccatttgcaaatcggcatttttgctgttaatataaaaattacttttcaaatgaatgaaaactatgccttgttcgaactcgaatattattgaactgggttgagtgcttaatatgagatagacatttattatttattttattttttctagcattttttcttattaaaatttaaaaaaaacaattcgtaaggcttcagtagtaaaagcataggatgacggaggatttcctggatttggtaaattatcattttaaaatcttttgattgacagatttcaatggcattatcataataaaaattatttggtcaataaatttttagaaagcgtgaaaatggcacaaaaaggcataaaagttgtcttattgttagcataaccgtttttgtgttttaaaatggtaataattcttcgaattctctataattctttttgcttattctgggaatgttttcaagtggtatatttgtttttgttatttctgagatttcattcttggatttattcttaattttattatgaatctggtacttgccttgtaaatatattattaattcagcaatttggtttatcaattaatgtgatcaaccagtccaattagggatttgggaagcttccaaaacatttaacatgtagtaaataacaatatgtaca

SEQ ID NO: 27745 - DNA, 2124 bp, Heterodera glycines
gatgttttaccatgcttacaatgggtatttgcagtacctttacccccacgacgaactcaaaccgtgggccttgttcaattgttggcaattggtgatttaagaaacggttaaggttaacctgcaaaggccaggacacgtggggcggctacagtttgacattggtgggcatggacttttgaaaatcggcggagaaatttacaaagtgttcattgtcaggtggatgcactcgacacccttttgattcttggcaatgaaactgagtttagggtctgtgcccgcaaataatttgcctaattagcctaattcagcgagcttcagacctcgttatagaacagttggatgtgaacagaaacattaatgtttcggtgttcgaaacaaacattcggatcatcggtgaccatttctgttccttgggccttaatgtttgctttttcttgctaggtgggctgctttctgcgcatatgctttcatcccgttccagaggttcgtgccaatatgacctttcgaaatggggagttttgcctgttcagaaatggctcttcccgatggttggccttgctcgggtccgttgttggatttggccgagaaatttgcacagcgattgcttccggcatttagcacaaacactggaatgccttatggcactgtgaatttaaagtactgttggcgttcctttgttttttcttttaaattaagatacggcgtcaattatttcgaaacaccgatcacatggtaagcttgttttgtctattctttcaaggttttgcaatgttttattgcttttttagtacggctggcattggcacttttcttttggaatttggcactctgtcgcgcctcactggcaacccaatttatgagagggttgcgctacgggcattggatgccctttggaacagtcgctcctcgttgggtttggtcggcaatcacatcgatgtgcagacgggtgagaaacaaacaaacaaaacaaaagcagagcaatattaatatttttccaaactaatttcccatgaatttagctacaaatagtaaaattaaatttgaggtgtttttaccgcaactgattccggaattggggctggcgtcgactcttactttgagtacttggccaaaggcgcactgctattccaacggccaaaattaatgcgccaattcaatggtgatcatttcgttttctgaccatttattcacattttttgacctcgaaaaggcactttaatcgcaattcccgcgtagaattcgaggcagccattaataaacatgttcgtcgtgacgattgggttttgtgggtggacaaggacaaggcgactgtttcgatgcaaatctttcagtcccttgaggcattttggcccggattgctggtttttatttatttaaagtttcagaaaacattattttaagactcttgtcggtcgtgttgaggatgccgttcgtataatggcatcgtatggccaaattttgcggcatttgggcgtcccacccgaattttacaatttgccgaacagagagcctgtaaaatcctttgtttttatttccattggttgtatttattctccgcttcccccgaaggtcattggtcgcgctgcttatccgttgcgtcccgaaatccccgaaagtttgttgtatcttcacagggcaacaaatgaccctgcttatttgacaatggctgcttcaattgtcgacgtacctccaacttttcatatttttaaatgttccattgtttttacagaccatcgaccaaattgcaaaaacgaactgtgggtgcgttgttgtcattagaacaacgctaaatcattctgttgttcagttttggcactgttcgtgatgttggcacgggcagtgtggaagacaggtgggcgcccgagggatcatttcactcccccccccccgaaaaagagtttttagtgtgtaaatttacaaacagttcaacttcctctttctcaggatggagtccttctttttggccgagactgcgaaatatctctacctaatctttgacgaacataattttatgcatagtgttggctctgcgaaggcaaaattggtggagaccacggggggaccatgcgtaatcgaaggtgggtattgtatgaatggaaagcataggactgggacaaaagaggg

SEQ ID NO: 27746 - DNA, 1505 bp, Heterodera glycines
cacactcaaaaagttggaagaggtgttaaaagcaatccaaattgttaaagatagcgctttgtcactcctttccacgccagcttcgacaaatgccatccgaactcgccctcaacagtggagagaatcaaaaaccaaggccaaatcagcaaatgccgtgcaacaaaaccacccggcacagcaaaaaccggccacaggaggaaaagcaattcgtggacaaccgacccagccgtgcggctcatgtgttggtactgatcactggagatcagattttcgcttccgagaagcgacatgccacacgtgccaaaaacaaggccacattgctaatgtttgccgaaagggagcattcacgacaaagaaccaacgccgttcatttcacacggtccaagtcaaagcaacatgcctacaaattggcacgactcaaggacggtggtggaaaattttggtcgaaattaacggcacaaaaatcgaaatgaatgtcgacacaggagctcagacgacagtccttaccattgaaaaatggaccaaattaggacaacctaaattgttgccaaccgacattgagaatcgtaactgcaacgacgtcacatttaacacaattggcaaatttacatgtcttgacagcattaagggacaaccaaccaaaaagctaacagcttatgtgactgaagagctcaattacgatttgtttggtttgccatggattgaggcaacggaaatgattcccaaagaaatcatgtttccggagacgcacacatcggttggaatccgcgcatcatctgccgcacctttccaagaaatcgccgatgttaagtcactcacgacggctctcaaagaaaattttccggatgtttttggtaaagagctaagacagtgcaccaagattaaggcacaattgattcttaaatccgacggtcgatcggttttctgtaaagcccgaccccttcctcatggctcactggaagcagtcaacacggaactggaccgcctcttacagatcggtgccattaatccgatagaatttagccattgggcagcacccattttagccgtcaaaaagaaaaatggcaaaatcagagtgtgcattgatttctcaactggcttaaacaatgcacttgaactcaaccgccacccactccctcggcctgatgacatttatgcagccataagcggcgctgcattttcacaaatttggacttaaaagacgcatacctacaaatggaattggatgacgaatccaaacagctctgcgttttgaacacgcatcgtggcctttttcagtgccaacgtcttccatttggcgtcaaatcagcacaggcgatttttcaacatttgatggatctaatatgtgctggaatccccggagcatttgcttatttggatgatggactaatcgcgtccaaaaccctcgaagagcacctttcagccatccatcaatggttcacgcgattcaaagcatacggattgtgcattcaacaaggaaaatgcaaattcttgcagaaagaatt

SEQ ID NO: 27747 - DNA, 1906 bp, Heterodera glycines
  misc_feature (843)..(843): n is a, c, g, or t
  misc_feature (917)..(917): n is a, c, g, or t
gggggggggcgggtggacagcaatgtaaaagcggaatccaattcttcaatcggcggatacccctcgcgcagcccggtccgatccgaatccaatcgacgagacgggcggcgggcatgaagcggtggtcgggcgggagaagacggcggtccgctccgccgccgtcgccgctccgattggctttaccggcgcccaatggatgatgatggctttataaaaataattcctgaaattaaaggcaaacaatgtgaagccgggctgggccggtgatgcatggaggtggaagtgactgaatcactgagaatgaatgattgactaaagacgaaaattgggcgttgtttgggtactaactaaataactaactatctgctaactgatggttggttggagctggacacagcagcaaccagcagcagaatgctactgctttaatttggtccatcaatatgttatgagagagaaagagagagagagagaaagcccaaaaatttcccctttttttattttacaaattttttatttaattttttctattgcaaattaactcaattaattttaatatttaaatttaattagttatgtctgtgttttttaaagaattctatttagtcatggccaaaaaattgcttgacattttctcgattccgacggtaatcagaaaattttgtaccctgtttaatgatttttgagctaaaaattaatattggtcagtaaaaaggcaatgaatgaactgattttattttggtctccgaaacaatcggaagaggaagtcgagactagtgaagcactcactttttgactggtcatccccacaaagtcgagaggcgattaattttttttttaatnttctcgcgcaaattttttaattggaactgcacactcatcaaaagcagcacaatgagagaacacacacttcacanatttgttgatgaatgattttattgtttaacaattttttgtggccaatatttctacaggccaaatactgtataagttctcaataattcaattagctgaattcagtttaataggagaatacgcattttggaccgggttaaaatttcttaaatttttcatttttaattcgaaatttcagtcccaaaatacttctcatttaagtcaggctgattttatgaatcttgaattttagaagggcgttgcgcaccaaaatttgcattttgtctctttctttgccatttgcttcatcgtttttggcgaaatgcctcaatttaatttttaccaatgaatgggatacaaaaggcccaaaaatttgccgacatctttaaaacttttgttttttaaatattggcacatgatgacaaaatgtcgacttaaccaaatttagcaaattgttattgtcatgtcttggactaagctaatataactctattatttccaattatagaattgtataagttcaaaaaggtgtgtttatggcactttttggcacaatatggcacacatccttgcccagttttgcaacacaattgtgccattggccaccaccaccaacaaacacacaatgtccacacagataacaatctttggcgcacaatgaatgtccatcccccccccgcccgtcctttccccgtttttccgccaacaatgaatcatataaatattaaatattttctcacatcatttttacttttttttatttctttatttttatttatgtattgtaacaataaaggggagatttgctctgaatgatgaacttttctttttttgtgtctttgagaatcggtccgattgggtgcagatagattcatttgtatagagaatgaattttatttatgtccattaaacattttgctttacatagaaaatcgatttaaaaaaattaaatccgttaagtacaaaattcaaaattttattttctatcaaagaaattttttttttgcttgaa

SEQ ID NO: 27748 - DNA, 1573 bp, Heterodera glycines
aataaaagcacaattaaatcctgaaaatgcctttgtccctgaaaaggattggacttttacaaccacaacatcgactgctccaaggacttttaccacaaaatcattacaacgcgccgctttgatgagcgaatttcgaccattgagaaagtacggtaccatctaattggccagttgtacgataatttgcgtattgtaaaggttcgttcggccggcatcaaagtttgctgcggagggattatcggaatgggagagaataacgaagaacgggtgaaaatgtgaggcggaaaatgggctaataaccgtttgcttccatttggccaaggctcgtcacattggccaatttcgcacctccgcccgaatcggtgccaattaacaaattaatgcccttccccggcactccgttggccaatgccccggcgcccgaccccttcgatttcgtgcgcacaattgccacggcgcgtgttctgatgccaatggcttacatccgactgtcggctggcagagagcaaatggcggacgaattgcaggcgactaattttttagccataaaagcccgtttaatttaaatattacaaccaaaaattgactttcaggcactttgttttttagccggtgcgaattcacttttctttggggaaaagttactaacggcgtcaaatccaatgccagaaaaagacaaagaattatttcaacgattgggtctcaaaagagagcaaattgaggagaaaaaagctgaacggaatgacgaaaaagtgaccttgaacttgtgaagaaattatttaataggactgaaatttttaaataaaaaacaaggaaaatttcgtgagaggtcaaaaaatacaacaaatcaaaaaatggagaacagagaatgatattataaatttacaagattcggacagagacctctataatataacaaattgaatattcccgtatttaaattgcgatattttgcatcggtccgtggcctttcaaaatgtgcacgccgaagtcaaccaatggccgttccaacggccgacgacactccgccaaagtcctcaagcgatgcgttcaaaagattggcatccaagcggcgcaaatatcgctccaaatgttcaacaaaacgctgtttgaccacattgaattccatgacggatgacggacgaacgaacacccaaaagtcggcgaaaagagaaaacacgcggcctgaaaatgggggggggggattgttaagtgaagtgaaccaggaaggggggggattgtttttattgatgggtcataattaattaacaaactataaatttcagtacatttggattcgaaatgacaatcttttttgatatggtaattcgaatattgttagcataatatcgagtaacgaaattttcaataacttagaaattttttcttacattaatttttttttacttaataaaaaaattgttttacggattaaattcctttagagatgatttgatcttaataaatgtaagaaaagttattgaaaattattaggcaaaagtgcaaacaattcataaaatgctctgtttatgtaaaagaattttctgcccagagatgtttgattacgaaaatt

SEQ ID NO: 27749 - DNA, 1895 bp, Heterodera glycines
tgaataggagggtaacaaaaaagttgaaaattcgaaaaaaattccgccaaatattcaaaatttatgttaatgtttttggcaaaatattattaatatttttaccattttgtaattttcgactccatttttttgctgaataaaattagtgaaatttggctccatcaatacatcgccaatttgaaatatattttttccacaagattgtattttttaataatttggtaacgtattgtaatataaaatgttcaagttattgtttccatacaactacagtttggggtcggtcatatatatcatcattaacaaaatcaatgcagtactatatgatataaattctgtatataatgaaatatccaagtaaattttatttagccttggctgttaattgcattgaaacataacaccaaacttactacaattaccaaattcttagcctagttaagccccaagagcggtgattaacgcccttttccgtgtgcctaaccaattttgattgttttagcatttgaaattacctcttattacagtgtacaaaatttttacgtactaattaaagcaacagaatttcttgaaatttttttaattgcatatttacgtcatcattgtgagttcaattgcagcaccaaatacagcatcagcccaaatgccaaatgcccgcatcaaactgatctggtaattctcagtgaccatgttaaatgctatggctgaatacaaaaaattgatgaataaattggagagaaataagcataaaaaagttggcgaaagttgctttgctgttttcacattatcagaaaccttaaaaaatgaatttataatttaaacaaaaacataattattacaagagactgtatgtgtttaatgtatcaaaaaccgctaaaacattcagttatttacaaaaaaatatataaattaaaaacccgaaaattgggtaaatttgtacgaaaatatgcgttaaaattttataataaaaaacaaataaaagtgataaaaaaacaaggattacaaataaaaaaataaaattttaaaaataataattttttgttaacatttgcaattaataaagaaataaaaaatttaaatcaattaattaattataatggtatttggaaattaattgaagatttaaaaaaaaatttaacattacaagatagcgatgtccgatatgataattttttgcgttgcttgtgcaatcttaaaagcgtcgaaattgtttgagtgatcaaatttaatcgtgtaacggtccacgattcgccattggttattatgttcaaaaaagcgataatgaactgtaattcgaaattatttttaattacaaaataaaaaaataccgtagtgctagaccatgcgagagtgaaaccaaattttgaaaatttttcatatgaatttgtgcgtactgtggcaagaaaacggtcaattatcaacacatgtccaagcaaatggcggaataatgagttacaaataatgatggactgtaaaaaataaattttacagtacagttaccaagtgcaaatattatatctcatggaaaaatcaaaaattttcgagtttttaaaataaatttacaaaaatttgaaaatatgtatccaaaaaatgtgaaaatgcctggaaacaatcaacaatttttaatcctaaatttgattgtttgtgaataattgatcgtattttgtcaaaggtttagaagagataaattttacctgtaaatttacatcggatggtgcaaatgggtcgtcgattgtgaatttttggaccaacataactgatcgaaacaatacataaagcatctcagcaccagtttgagtgatcagaatgcttttcaggttaatgtgtaaaattttggtgggacaaatcaccgcaaaatttaaaaaagcaatggacaacaaaatgccataggtgaa

SEQ ID NO: 27750 - DNA, 672 bp, Heterodera glycines
taaataaaatatgtataaaaaacactgaaatatgtatgaaatatgtacaaaaactcccaaatatttactaaaatatgtaaataaaattttttaaatggtgattttttggaaaaaattctttctaaagggtgaaataggcacaaatcgtggtgagacgaaccgaaaatagtctcagtgtgggcgaaccgaaaataatctcagtgtgggtgaaccgcaaatagtctcagtgtgggcgaaccgaaaatggtctcagtgtgggcgaaccgaaaatagtctcagtgtgggcgaaccgcaaatagtctcagtgtgggcgaaccgaaaataatctcagtgtgggtgaaccgcaaatagtctcagtgtgggcgaaccgaaaatggtctcagtgtgggcgaaccgaaaatagtctcagtgtgggcgaaccgcaaatgtctcagtgtgggcgaaccgaaaatggtctcagtgtgggcgaaccgaaaatagtctcagtgtgggcaaaccgcaaataatctcagtgtgggtgaaccgcaaatagtctcagtgtgggcgaaccgaaaataatctcagtgtgggtgaaccgcaaatagtctcagtgtgggcgaaccgaaaatggtctcagtgtgggcgaaccgaaaatagtctcagtgtgggcgaaccgcaaatagtctcagtgtg

SEQ ID NO: 27751 - DNA, 796 bp, Heterodera glycines
  misc_feature (777)..(777): n is a, c, g, or t
ccaagcaaatttattgatgttttcaatgatttttgactaatttaagcttgttttaatcaattttagagcaaacgtgcgagttttgagtcgactttttgttcgaattcggctccgggatcccgaattggacgaaataggtgccatattcgtgatcagcgacatcgaaaacccctagttatttgttttcaggatcctttaaaacaaaaaatatatattttgaaaaaatttgacccaaaaggcggacccaaactgtactagtacccaaacccgaaccattcgacataaaaatttgaccatatcccaccggttaaaaaaactgagcttggtttgaaggctttttgtgttaaataaataatatacatatctctgtggccccaattttcaacccacacgaaagggtggctctataaattaggcaccacaattctgcaccattgctagcaattgtataacatggtactttgaaagtggcttataattatgcagaaagaaacacaaattaaaataaacattaattttacatattttgcgtcctttttcttagattgttaaatttttttaaattttcgattatttaaaataaataattgcaatttaatataaaattcatagaattcgaattgaacttttatataattttttacggcagtgaatggcaccaaattgagaatggctccaattttcgtcatctctcgtgatttatttgccataggcacacacgaatttatatttcaaaatttgggccttcttaaagggaaccacagtaggtatataaantatattgggtattaaatat

SEQ ID NO: 27752 - DNA, 1411 bp, Heterodera glycines
atgtccggggcgcaaatgttgggtaaccgaatccgggcatattttcccttctaagccccaaatgacaggtgctgtaagtccgaagttcgggtttcattcccatttcaaccacgacacaggttttaggtggaggaataagctgcaatcgaattttccaagcaactcattcactcacttcgcattccaccaaatatttgttcatcgattgagatttgtactcatcattgcattttgtcaaattcgagttgaaaagttcttgtagaatttctgaaaaggcttttacggttattaaattgtaaaaattcaagaatgcggtgagagtacgtagtctttgaaccaacaattcaccggtaaaactggagggaattcgaaattaaaagcgaattaatcaaaacgacttatttaagggggtttcgagttagttcgaagaaataaggcattattcattggttcggtgtttcggtaagtgttgccccaaatcataaaattgcacaccttccaccgcttccgtctccgctttgagttgctccattttaccctccaccattttttcgcattgctgccgcaccaccgtcgtctctaactcatgcaaattcagccgcgctgcactcaattcggcctcccgaccgcgctccaacgcgcgtaaacggagagaacggacggtgtccaatttctgtgaaaggcgggggtgttaattttttacgtattatttatttttgtggggtaatggtagagataatataaaatgcccgatttaaacgattttttatttcactcatgagttgtcaaaggtgctgataatgagcgaaaaatacgctatcagttttgtcatatgacaacatcaaagttatggtttcatcagtctatgattttttgtcgtattattttcattgttattttgctctcgcttgacaacctttttcttttcgttgtattggtcgtcaatcgccgatttgagtctcaaaaagcacgggcaaattcgtttccggaccgcctcacgccgtttctcaatctgaaaataaaagtaaaataataagatgaagaaaaaggtgttatgggtttggtaaccaggtcttacggtaatttaaatttagcaattctcatttactgcgcattactgaaacatatagatggacagacggcattgaagtcagcggattgcacaacccttacggaatgtactataacaatgactacggtgcagcaccatcgctaccgtacgcagcgtactggtcacagagtccagcactacagcacccaatgcgcggagccgcggcacacttacagtactccgcgtcacagaatccttattccaccgcctattggggtggctctctgagcccgatgaaagccaaactacgaagaagcggatgcttttagaataaacttaagaaaatttaggaaaattttt

SEQ ID NO: 27753 - DNA, 1596 bp, Heterodera glycines
ccccttaatagaaggttcctcagcaaaaaataatactttcttaaaaatgaattcgcttcgcccaccccttagtattgtgataaatctcgaataaaaaattctcaactattttcccaaaaaatgcagaaggtttttaaatttgaaaactccattcatctcaatttatattgcccgtttcattcagtgcttattttactatgctggccataaaaatatggagttttgcaggttcgaaaaagctcggcgcgctcttcatattcagacgtatcaactaagggcctatcgccactctcaggcgagtatggccaatcaaagcagagtgtgacgcataatcacgaagcactgctccagaattcttgtaatgtttcacggcagatttttgtgataatttttttcactgatttctttatctctacgcatatgcattatttgtttgagctcaaggccttatcgaaaaaaattgtcaataaaaacaaagtttgtttaatgaatatttacatcaaaaaattaatgacaatttcgaaaaagaaagtcaagtaatttttagaagcttttatttcatgttttgttgctcacttgttgaagccgcacatgagccgttggaaatattttcgccttttcttggcaagttttttcccgaactgtttcacgacagttaattgagtcaattattttcgccagtttcttttatctccaagcgttatttattgcatttcacttaccttggaacaagattacagtaaaataaaatattgttttgtgaatatttacgacaaaaatttatcgacaatttctaaaggggaaggaaaataaatgtttgcctaatatattaatttatattttcaaatgattgaaccggatctgttgcttgtgtttttaatattttttgattttgccatatattttggctttttggaatttttccaatgtccgaaaatttgtttgcttttacatgataagtaatgatttggttatttttgtatttttcttcttttcatcatgaaagtcatttagccattcatcccctctaatgaaaatagttttctgtagctgatttaacaatatttttctttgcactatacatgtagtatagcactggttgcgccttcaattctgccccttaatagaaggttcctcagcaaaaaataatactttctcaacaaatgaattcgcttcgcccaccccttagtattgtgataaatctcgaataaaaaattctcaactattttcccagaaaatgcggaaggtttttaaatttgaaaactccattcatctcaatttatattgcccgtttcattcagtgcttattttactatgctggccagtaaaaatatgagttttgcaggttcgaaagagctcggcgcgctcttcatattcagacgtatcaactaagggcctatcgccactctcaggcgagatatggccaatcaaagcagagtgtgacgcataatcacgaagcactgctccagaattcttgtaatgtttcacggcagatttttgtgataatttttttcactgatttcttttatctctacgcatatgcattatttgtttaaacggcaaggtgtcaataaaaacaaagtttgtttaatgaat

SEQ ID NO: 27754 - DNA, 967 bp, Heterodera glycines
agcgagcgtatgtcgcgattatcccaaatcgacgaggcgactccaccacctccggatcgaccgaatcggcacggagatggacactgctgctcacattcacaatgcgaccgccttcctcactgcgctccaactttggcaggagcaattcggtcaacagaaaatggccttaatgcattatattttattaatagtagcaaataaagacctaaaaagttggactgccaagtcagctcatggccatcgacagttttggtgaagcgtggataaaacattatgcccgcgttatttatcagaatgtccaatttgggttcatctgagtattaatttgggtggattgaaaggatataaactaaaaagaggcatacctctgttgaattctttaacaaattgatgaattgaagaaaagtcggccaaatcgcaatgacggacaatcatccgagtcatatcgcaaccgtactaatgaaaagaaatgctatgtaaataagggtgatcggaaatttacccgggaaaacagctctcgggcagtcgcttgtccctgcgagacgcttcgacacgccatgtacacctgaataacggaaagtcaaaataagcggactcatcccttctggatttgctgagtaaaggtaaaatgtaggagaaggtcttcccgcggggtgtgcccaaagcacggattttcaataaaaataatttaaaatttataaaataatatacgatcaatttacaaaagtatggtaaatttaacgagtaaatggattttttttcttatttttttaatgtccaaccgaccttcacataacgcaggttcaactcgcgcaccaattgcttcccaattccgctgttcgcacccgtcacaatggccaccgccccacgagcactgactttctcgcgaaactgtgcacctttaatccattgacggattgcgaagagaataatgaagacgataaggccaatgcacgtcagataaagc

SEQ ID NO: 27755 - DNA, 908 bp, Heterodera glycines
atccgattggagagcccgattgatttggcattggatgaatagcagcggcgtttgagacggagtgtgaccgacaagcaaagggcctgtggaaacagtgaaaattagaccgacattgaaaaggcaaaagccaacctttaaaactttccaaaatttcgacgtatctccgtccttcagcatctttaatgaaacgcttcaggtcttcaatacagacagtgctaactgagcgggttgggtccacgtaaattattcttccaccacggccaaaccgaacgggagtgtggggaaaacggaaaaacatcaattctaaacggaaaggagaaaacgccaatttgaactaaaagaggcaattactaagtcgtttcataaagatgaggctggaaacatatttccaagtgtttttcggggatccacttcaaccaattccgaaccccggaccgaaattcgtaaagtcaaaaactcaaatacttcgatttcattttagtctaatagttttgaatgattagtttgaatgatttttattgaagcaataatgtcctttcacttcgtttctaaaaatttttcgaagggacgggaataaactttattattaccttttatttttactaataatttttggaaggaaggaaaataattcatttttattgaacgacttacaagggaaccacccgaactgtaactcggaaaacgtatataaatttgtttggtatcattggatagagcagggtcgacttctattgtgaatttttagttcgggtggttcccttgttagtagtcagggccaaaaagaggcgatcctttccgacctttagccagcgagtcggtgctgttcacgtcctcgctttctatgcttggtcgatcgcttaaccttaaacagcaaaatcagacaagtcactcgcgctttgtcccac

SEQ ID NO: 27756 - DNA, 1762 bp, Heterodera glycines
attcttacgaagtcatttcgaaaaggctttttcagttccttatggaattgtcggaggaaatggacaatttggggacgaatttggaggacaaatcggacaaattggaccaggaaaatgaaaatataaaatgggaaaattggaaagaaattgtgggaaaattgcactttcgaaaatttggcattgcaattgttaagggacgaatagaaaattgggaaaaattgggccaaaaacagaaaacattggcactttcgaatattgtcgaaaaaagagagaaaattttggaagaatttgaaagaaatttggaacaaattgaaaaggcggaaaaacagcgaaaattgggtaaaataaattaaaataaataaataaaatttaaatttaaaaaaattcttagacaaaaatattttctgtcaatatcaaagcgacacaaatttatcggaatttattgaaaagaaagacaaaataaattttagtgagaaaaattcgcaattatttccatcagaaaaatggcaagaaataaattcagtcaaagaatttgagagaacaaatttagaggaaaaggaaaaagtagaaatttaaaaattaaagaataataaaatataattaaaaataataattaaaatcattttaaggaaaaaatgggaggaaaagcgtcggattatgggcacaaaaatgggaaagaaacgctaatcgaactgagacgaatattcaatgaatgggtaataattgctaaaacatcactaattaatagagagacctaaattttgaaaagacgggatcagatcataatcaggggtaggaattgggaacaggctgatccccgggattaaaatcctgattttgtcggtcgggattccgatatttaaagtgatcggaatcaggattcagaaatccttacaaaatcctgatcctgtccgccggtctctacaaattataaatattagcattaaatttgtcattttcgtttttagtccgacgcggcgcaatttcaatttccgagtcgcttctttatcaaacatttggacaacaaattcgagacaatttgtattttgccggatggatttgaccacggattaattttcggcacttccgcggattgcgacggaaacggcgccggagggaaatgcgcggacaattcgctgcactgcgcactttgtcaagttggcattttcaattaattgtttttaaaaaccaaaattgttttaatttaaatttaaactcccttttatcaatgaaatatgaacgagctggggaagcttttcaggaaaaaaaaaaattttggtaagaattttaagaaattggaagtccattttcccatttttgtcgatttttaactggtttttccgttttttccttcccattttattttggcacttttcgccataaaatattttagcccttttgatcaattgccaatttgttttttttaaattttctttttcttcagaatttggagttaacttttctccaaaaattccccaaaaataatttttcgtccgtcccatcgatgcgaattgggctccaaaatgtgcaaattgacgtcaaattcgtccaaattgcccaatttgcgcacattccgcgcaaaaatttcagcgcaaaacaattggaaatatttttgataaaattgggacaaatcattcacaaattggaggaaaattaccattttgacgagcgggcgcatcgatacgaaatgtgcaagagaaaagagttgaggaagaaaacctatgaagaaaaggaagccaatggatacggtaagggagcgact

SEQ ID NO: 27757 - DNA, 975 bp, Heterodera glycines
ttttggacaaaacagcttgccgtactaaactgactctcgtactaaaccgaccctcgtactaaaacggccgtactaaaacggccgtactaaaccggccgtactaaaccggccgtactaaactgacccggtccggtcccgtggcactctactactaatcatcaatccttcccttttcatgactataaaaatgtttgttttttcgctttgtctcgcatttgaaaaaataaaagtttctaacggaataattctgcaattcttccttccctttgtgacatctttcggaactcggccaaaattgtgctaattgccacaaaaatgaaccgacggtaataaatttttaaaagtcaaacaaattagtcatttatttaactaacaataaactgttttcccacaattttagttggatttgcaacgacgtttggatggacattttcccatcatttgaccgtgctcaactcggcctcaaattggcacttctttcgccacgtttcgatgcgttggtggacaaacatttcaatggcaaaagcgaattgacaatttggagaacaatcgcaattcatcgcaaggacaaaggaacagaaccgaaactgtttgtaaagatgggttacaaatttgtggaatttccgttgcccgaccgtccgctgcccaacaaaatccgttttaatcaccttcggatttagtaattaaaaaccagagagctatgacaataaaagcatttatttcattttcagttacatcgatcactcagtcatcgcttttcttcgttcaaatcaccaaattttcaacaaaagaggcacctatttatatttgtggattccatcaccacacaacacggatggccaactaatttgggatgtttttgttcgtgaaatttggcccattttttcggcaaacattcaacatttgggctttttcccgtggtgatcatttggacaatttgcttcgtcgcacttcgcccacaattcttaccgatct

SEQ ID NO: 27758 - DNA, 1015 bp, Heterodera glycines
atgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaagaaaaagctggcggtgcccgagctgacactcattgagtcttaagccacgtgctaggccaagcacgggccctaccacgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccaacacagccgttaggtcgccccacgagcgtgcaccccacattggcgcagcgaaccaaccaagcgaggcagcccgccaccgacacattgccacgcagcagccatacacaggctttaacatgtgcagcactgagcggtataccacagctccaacgtatggaagcaccccaaaagcatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacggggcggtgtgtacaaaggggcagggacgtattcagagcgagtgatgactcgcccctaacaggaattcctcgtcacggacaatatttgcatgtccgatccccatcacgcaatttttcaccggttacaaaccccttttcggggaagacagcacgctgattttgc

SEQ ID NO: 27759 - DNA, 1436 bp, Heterodera glycines
  misc_feature (1414)..(1414): n is a, c, g, or t
cctaaaaatatgttttccttttaactttggaatttgaatttttgttcgaatttgggttcgggattcggaattttgaaaaagaaatgtcatattcgtgattagcgccacaaaataccctaaaaaaattatttaaaatgtattttgagtgtttttatagtgcggtcaattgagtcccagctgagtttggcactccaattccggcactttttcagcctgaaaaagggcaagcgcgcaccaaattccatttttccggcccatttataacctttttacatcgattctgaccgtttttaagcaattttgagtttggtgactaagaccaatattttcccctcccccaatttcaggtccccttttacaatattttcttgataaatttggaaatttaccttttttgtattgtgaccaaatttatgtttttataaatagggctgggatttttagttttttaactattttttctgcggctttatttcgacgagaaatgcacgaaaaacccatttcgcgatttttcaaatttgtaaaggaaaattcactaattttcttcaaatatactaaataaaacccatatttttaagggaaatatcgaaccaaaatgctcaaaattcaatctaaatctgcatttattcgtgactggatcaaaaaaattgacggcgaagaaatttattcattaatggaaaaataatcttttgtcaagtttgcgaacagcaggtaaagacaacgacgacttgcaagaaacaacagcagaaacatgataattttccacagattccatgctcgcaatattgccatctaaaacaacactatgaaacggcaaaacatcgcgctaatttggaccgattttcaaaaaagaaaagcaagcagcatcagtcttttttgacaacgaataaaataaacaggaccaattttctgccgacctttgcaaagcatttgtatcggccaacattcctttttttaaactaaacaatgcagttttgagttcatttttggaaaagtattgttaacgcaccgtgccagaccagtcaactctacgaaaaaattatttggcacaacttttttctgaggttatatcaatctttcaaaagctttaaatttttgatttttagacaatgacaaaaattaaagaagacattggcgacgcatttgtttgggtttcagtggacgagactacggataaaatgggcgaatgatggccaatttgttgataggcaaattggatggcaaaaaatggcaccccccgcatttaatttctgtgaaagcgcttgaaaaggtgggcagtggagcaatggcgtgttttgtcaatgaaggatttggtcgcttggcttttgctcctagacaactttttaattttagacagtgtttctgctgatattaagaaagaacgagtgctctttttggtgacgaagaggggccngcgtacatgaaaaaggctggaa

SEQ ID NO: 27760 - DNA, 1187 bp, Heterodera glycines
  misc_feature (280)..(280): n is a, c, g, or t
  misc_feature (284)..(284): n is a, c, g, or t
  misc_feature (288)..(288): n is a, c, g, or t
cgcccagcaaattcattcatcctcccctccccattcagtgtgcccccatttattgctgctgatcgtaaaaagtgatcagcatcagcagcaggaatcgtgcctgttgctgatcattttcagcttttgctttcgacgcatagcttatttgttagcgctaaatgaccaacaactgcagcagcaggtggggcaaaatagccatggcatgtgatgtgatcagaccagcgattttatgaagcccggctgatcaagccccaagaactaagcttgtcctgatcagtgnaacncaanagtcgagagatgatacatatttcttcaaattcaatttgcatttccttagcttttatctcgcaaaatcattttgtctcaatttccgagccttaaaaatgccccacaaatgtgctgcctattcgtgccatctttgcctgctgatcaaccatttcaaatctgctcatctgaaataaaattatactgctggacaatttgtccacccgttttaaatgttttttgttgtcccgtttcgccgattacgaccattatgacagcgaattcaagaaattcgcttgacactaatttattagttcattaattaaggggttggtcccggttaaaccattaaacttggccatgaaaccctgtcccataattttcggaccgttggccttgatgctgtcgaaattataacagggccatgaaaccgtgacctaacaacaagcaaaaaatctcgaattgtttgcaatatcccgacagggtttcccataatgaatattttctcgaccaactgttggttccgatcagcaggagaaaaagaacataaaaacacggtgatcagcaattattttccataattccccgtgaaacattttgcattactcatgtgaatacccaaatgatcatttagggctttaaattatattgaaatccatatttcctggacttttggagccgagcactgaaacgcacgaaaaacatgtttttagcttggtttgaagcttctagaataactttccatatccatagttttccataattcgagttttatgcacagatctccttattttgacattaaagatacccatatgcatcttgacatttcttgaaaaaagctctattaaaacggggccccatcaactaatttgcctttttaaaccgtcaaggtcggaaaattctccatttttttttaattttct

SEQ ID NO: 27761 - DNA, 1838 bp, Heterodera glycines
  misc_feature (1812)..(1812): n is a, c, g, or t
ttctcattctaattaaataagcttgatatcattttaactctcctgatagtccctaatagcctgcaaaatttcaaaaaattctattgaaacacaaaaaagttatggccaaaaaacctcaaaaaactgactttttctggccattttggcgccgcacgctatatcttttgtcaaacagaatctatttttactaatattttgcaggctaataaagaacacttaggcctatttaatggtatcaaaattattttatttggttggataagaagttataacactttaaagttcgcggcgccaaaatggcccacgccaaagtgaccccgacccgtttttttcatttgtgagatacggtagtcatataaagctctgaaattttacgcgtgaattggtaggataagaaaacataattacatatttatgataagtgtacatatgtagtttttcaaaattttatcgatccttttggcaaagtgccgtccccccccccttcctattttggcatatccctccctcaccccttcagtgctcatcaccatttcgcttgcggttgcgctggtcgctctcgtcggcctttgcgcgttgttcattttccgcgctcgtcatcacaaacagatgcggagacgagcccaagtgtgttgagctcggctttctataaaattcaaaaaattgtagactttttgaaaattcatccaacaataaattcgcatcgaaaattgtaaattagtgaattaagtgtttttgtttaatttaagcaaatgcgccgacgacgaggcttttccgctggcggtgggctgctaacagtgagcaacgtgaaagggtgactttttgaaatttaaacccactaattgtccgtatacaaaataatacgtgtcgaaaaatttcggtattcgggtcgagacggtccaaaaaaagttttggtctggtttctgggcgaaaaaaggcgcgatttagggtgaagtcgatttgataggagaaatattgtctggacgaaaaaatgtctggatcgggagttgggcggcactctgttttccacgtgttgcgactttagcgccgcggatatttgcgcctcccagcaaaaatggacatttgcgctgcccagtcaaaaaaatgttttacaaattttcaacgaattttactaaagtttgtaacaacaaaaaaaaaaaacaattaaaagaaattcaaaaaaattaatcacaatgaaagactctaactttttgttttttgcaatgcgtacatcagcatcattaggcaaatatgatgccaaggaacacaaaaaatgaagacttactaagccacattaatatgtatgatgggttttgtagggcgacgcaagtgccgaggcgcaaacgtcggtacaccgttttccactctttggccacaataccgaaaatgcgtcagtgacaaattaaaatttaaaatattttaaaaaatcctgcctcgttaattatcactaattgccccccttgctttggcccaaaagtctcgggcagaaattcccttgaatgtaataaccaagttttgttcatcagtggtgcaccagttgatgggagctgtctgttttctggcatcccgtcctattgcgctggcggcagcaacaatggcgccggcggcaacgtgtacttgccgaacaccacacagttgggcggtggcagcagcggtggcattggcattccgacacattgtccatttgaaaggagcaacaaattctatgagtcacaggtcactagatatgtgatcactgatcacttcctatttgatcattttgtttttttaattagaatttttcgtcatttgtctgaggaaagaatcccgaantattttgccattttttgggattgtct

SEQ ID NO: 27762 - DNA, 925 bp, Heterodera glycines
atgtgaaacgaaatagtgcacaaaagggagggatgctagacgaaaagaggaattgtaggatggacgcaccgcatctgatattacatttctctgttccacaagtggtcagcggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaagaagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcccatttttctgtttcacaactggccaacggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagttcacaaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacg

SEQ ID NO: 27763 - DNA, 1317 bp, Heterodera glycines
ggacggttcggtgccagccgtttcagtgccagcccaagttttggactacaactttttttattgttgaccaaatctaacaatcttggtatcattcgaaagcccttcataagccctattagccttacaaaaaaccaaaaaaattttagcttgtaaaaaagttattaagaaaaaacttccaaaattttggtttttttgttatttcatgttataactagggatgccaaaaatatggatataaaatcgcaaaatatggccataaaatatggaccaaaaatcgcgaaatatggacataaaatagcaaaaatctcaaatatggaaataaatggcaaaacatgtcgggggtcgggtcgggggggagctcaaatgtcgggggtcggggaccccgatcggtcagatagctatggcagtaaagctaatcgctaagcaataggttagaaaaagcttctaaacatataaagcttcgaatgatactaagattattagatttggtcaacaatgaaaaaagttgtagtccaaaaattgggctggcaccgaaccgtcacctaccgaaaaataggtgctaaaaattggaaaaatctagtgtttttatgcactaaaatccccaaaatgtcaattttagggacgaatttttgggaaaaattttcatttcttagaaaaaatatttctaaaattttggtcaattttagtgtatattttttagtttttttttgaatggttcttagggtgtatttttcgtttttattcggagaaaatgtgtttttcgtgcttctctcatcaagtactatccgcaaaaaaaaggtaaaaaccaagaaatccgggctctagtgcagtttatgagtccaatcgacctttatgagtccaatcaattgacaatcccccgggtttttatatgtacaataaacttctgcgacgccatttgttgacaacgctcggttttggagattaatattttaataatcagagagaaaaagtccggattttgatgccattctcattcgatatcccaccatcatcaatcaccgtcaacccaatttaagaataaatttgtcttagaaaatgcccaaatgataccattactaaaatttcccaccgtttcccttccgcacgacgcgcggcagtactacagcgattttttctgcttctgatcacttttctccttttcatcactttttggctgctgctggtggtgttgtttctccatttctttacgatttagcaaattttgtgggaatttaggaaaggctttatttaatatttgtgaaattaaaaaaaaaaattttaaaaacaaaaaaatgatttcattaaaaatggattttt

SEQ ID NO: 27764 - DNA, 764 bp, Heterodera glycines
ctcctgcatttcatcactgggattcaaatctccggcatttcaatcactgggactctattctcttgcatttgaatcactgggactcaaccctccagcatttcaatcactgggactcaatccaccagcattccagtcactgggactctgttctcctgcattccaatcaccgggactcaaatctccggcattccaatcactgggacctaacctcacctggtccttcggcatcgcaatcaccgggactcaattctcttacatttcaatcactgggactcaacacaccagcattttaatcaccgggactcaacacacctgcattccaatcaccgggactcagctctccgacattccagtcactggaactcaattctccggcattccaatcaccgggactcaactcaccatcattccaatcgctgggacctaacctcacctgattcttcggtatcgcaaccaccgagactcaattctcctgcatttcaatcactgggactcaacccaccagcattccaatcaccgggactcaattctccagcatttcaatcactgggactcaaccctccagcatttcaatcactgggactcaatccaccagcattccagtcactgggactctgttctcctgcattccaatcaccgggactcaaatctccggcattccaatcactgggacctaacctcacctggtccttcggcatcgcaatcaccgggactcaattctgtgacattccaatcactgggactcaacttaccagcattccaat

SEQ ID NO: 27765 - DNA, 1303 bp, Heterodera glycines
  misc_feature (27)..(27): n is a, c, g, or t
ctgtagaaactccacaaatcgttcacnttaaaataaaatttttgtaattaaatttaaaaacaattaattaattaatgcattttaattaattaattaatgtcggccaaattaaacaaaataaattcattaccgaacggatgttctctgtccattttatagtcattgttgaaagaggagacggaaaagattggacgagtgttggccaaattggagccgaattccatggctctgcccaacacatggacatggagaaacgaaaaaaacagaaaaatggcgagaaaagaatacatttaattgaatatattccaatgattgcttaatggaattgatcaaaaatgttttgacaaattttgcaaatgattcgacttattttttaagctttttctgtttgataatttcccaatgagggcgtaattggcaaaattgttggcatcaatataaaacatggaatgcattttaattaatgaagcaaatttatgaataaatggtccatcaaatgaaaaaacatttgatgagaagcgatgcccgggggaatgaaacaaaaaaagaataattacattttgagaagtacacaatcagacttgttatttattataaaaaggccaaaataaaataataaatatatcaaatgaaatgtaaaataattttaattcaaatttacaataaagtcttaaaatattagaaagtccttttctttttcgtttcgagtttcgtttcaatgtgccaattttttggggggtttctttcgttttctgggtttttctgtcgagaaatgccgacaagaaacattaattgtaagtcaaaatgtcagtctttggcaacaaagacgagcagttaaactttaagacaatatgtatttggcagcgaaatgcagcggaaaacggaggacaatggtggacaaatgagggcactttttgttggaatcaactaaaattaaaatggcaatttaaatcagaggtcgcatttttacttatttgtaagtattttacttattttgagggtccaaaacttacaaattttaaatgtacttatttgtaagtaatgtacttattttggcattctagagaaattcaatttttttatctttgttttgaagcgaatattaatttttttttgcagtcttgtttttttctctttctattactttttaattcgctttattgagattcataaaggttctatttagcctagcttataggttcatggctcctccaaaacataaatataaatttcatgctgattacgagcgtgaatttcaaggcataaaaagaagtaaaaagggcgatgaatatgcgaattgtgt

SEQ ID NO: 27766 - DNA, 1415 bp, Heterodera glycines
cgctgaatttccagaaaataaatgggacagagagtggggaagagatgagaaaaaagtggagtccgagtgagagagagagagagagagagaaaagccaggagagagaggagagagaaagagagagggggagaaaagagtgttgcaattggaatcaacaaaatgttcacctcgcatccgacgccacgaaatattccacctcaaagtttgccgagtcgcatggccgaacacttcgcgtcgaatcgctgcattcgattttacgtgccgtagaatttattgtgtctaaaaaagataaatgagtgtaatttgaaaaacccaatggcaaccattaaaaggagcgctgaaagaggcgaacatgtcggaagcgttgagtttgtttggcgtttccatcgcagtggtgcaactttcgtcgaacaccagcgaaacggggccacggcgtgctaaaaataatgaaaaataaaaaaatggcaaatttttgcaaaaaaagcaaaagcaacccaaaaaagcaacaaaagcgaaagggcttaaaaaaagcgaaaattggtaaatcgcctttaatatcggcactcggagaatcttttgaacggaaccaactgtcgataactaaaccaccgtaatggaaaatgaaattaattgaaaatgaaaactaaaaaatttcatttttactaaatgtttggaaatccaaaacaaaagaatcagaaaacaaaatttaatcaaagcggtatcaaaacgtacgtctgctgtagaagaccgggaaatggtcagtggtcagcttggactgacttttaatgccaaccaaaagaggactgccgcgacgagtggccaccaattggccaggaaaacggcgacttttgaacgccaacgcaaaagcaccctcctgaaaatttaaaaataattggagcacggagggaaaaacaaattgggagtccaaagaatacaaaaggaaaagtcgagcaattgcgacaattaaactgctgaccaattgttgcacgacaatttcgacgagttgccggaggccgtagtgtgggtgccgttggtggatgtgttgcgtgagtttggcgatcacttcggtgtccgtctccgactcgaatttgtagcccttggtcagcaaatagtccttgatctccttgtagttggtgatgattccgttgtgtaccacgacaaaatctgacaaaggcttttaaaattacgaccaaaatatagtatatagcaccggattaacgtaccgttgtcaaagttcgaccgttgcgggtgcgcattttcgtcctttggctttccatgcgttgcccagcgggtgtgtccgatgccgcaatggactaaaacaagcgaaaattcagttgaatgagccaaattagatgtaattgctcaccgttgtaggtgaagtccatgtccacgccttcggaatctgaaaaagcgat

SEQ ID NO: 27767 - DNA, 1055 bp, Heterodera glycines
tgttttcttttctttctgtttgatcattgccgcaattttttagctttaccgttgttggaattcgaaccgaagagagcgtgcacggaagtcggtgtccattgtccaaaaggctctgaatgcaccttactctgctgtaagatatatttgttaaaacgacgtcttttaaacacccctctttgcaactagcactaaaacctctaatttttccccaaaattctcataaaaaaagctgtaacgaatacacattttcaaaaagctttcccggcggcgcctaatggcactgccggactcccttctagtttttttttgttggaaaaagtgcgccccaaaaaatttcttgcagataataaggatttctattggtgaaaataattattatatttttcagttttgttggttgactcacaaagggccgcacgacgacgtaagagaattttcttaaaattgatggtttttatagtactcggtcaatgcatcaagattttgatatttagatatgtgaaatggcgtccgactacatagcggagcgcatgcaaaaacgcgaattcggtttttgtgtcggtcttgccaagaagtcaaactcgtccaacgaaagcggtggcctggtgtttttcgtggcgaaaaaacagtctaacgcaccaacgaagttgatgtaactgccggcggaggcaatttggaccaggcttgttcgacatcggtttttcttggacgaacggcggctgtcagattcctcagacgcagatttgccgacaaagaagcggaattggccacttacctccatctcgacgtggagttcgtggtcggttattgctgggagagggtggtttgagaaaattttatatccctcggaatccgtattacattttatttaaaatttaaaagattgccaatttattttgaaatctgaaattccggataaacatttttgcatttctcgctataactaagactcaagagataaataaaaccataaaatctggtccacactttcaatcgctaatttgtggaatttgacagtgaaatatatatgctaatttaattcttgcgtttttaga

SEQ ID NO: 27768 - DNA, 1342 bp, Heterodera glycines
caattatgggtgaataaaatgtatattcacgatttttatccaaaaaaaatttacaaaacaaaagggtcccccctatggtttttgataaaattcaaaatctatcactttataactagcgccaagtttgcttaataggcccaaataattgtcatattcgtgatcagcgacctttaaaacacccgggtacttggtttcaggactttttaaacaaaaaaaaatttgaccaaaaaaaagttgaaaaaattttcaaaatagtgctctttgtaaatagcgccaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaattcatataatttacaaccctactgatgagtcgaaaaaagaaaaattctatttttgaaattcaaatttggcacaaatggagaaacagcgatagcaaacagaatttttatgcattcaattcagtacaaatataaggtaagtgatacaaacaatgcgtgtgttcttctgacttggttatgagacaacaaatgaatatatccatcacaaatacatcaataaatacactcggccaatcattcattgtgtgatccgtcgtccgttctttccatccttaataactgcggctgcggcgtccttggcgatcacggggcctcccgcgcgtgtagtcgtagccgcacatcggacaaaacaagttgacgcgcacccatttgtagaggcagcgtcggtgcagcggatggtggcagcccatcgtggtacgcgtgattcggctcagtcggccccggcaaattgaacagcgctcggctcgtcgcgatttggcggtctgtggggaaaacaattggggaaaattatggtttaaaatttttttttaatctaaacttacgtttcctgcccttgctctggctgccttgcgcagctgcgcttgacgcttttccgccttggccgcgcgcgcccgtgccgcgtacattgcgttggccattcgctgaaaaacggggggggggcaattagcacaatgaaaatgcacataacaaaacaattaattacctaaataaactgacgatttaagtggcggtggaggaggacgaataataagtggatggaatgaatgaaacgaatgaacgtggataagcaaaatgtgtgggccttaaatagcaattttttagtcgaaagagtcaaattttttcgataattcatatataaaaggcacaaaaaatcatttggttgcattattt

SEQ ID NO: 27769 - DNA, 1384 bp, Heterodera glycines
  misc_feature (29)..(30): n is a, c, g, or t
  misc_feature (59)..(60): n is a, c, g, or t
  misc_feature (62)..(62): n is a, c, g, or t
  misc_feature (108)..(108): n is a, c, g, or t
actccttagcgtccatggcatactcacgnncagcacaaagcaattgaccacgtccctcnntngttcgagcaaacaatgtgtcgtcggacgactcgagatcgatggttntgataagttgggtatacccggcatatttgtatggcgaaagcactaaagaaaattataaatgattgattttgcaccaaattgctggcgaaccttgtaagttcctcttgtatacaatgctttgtgcacgaatgatgatcactatgcgattcatgtctggcgttgacgaggaattggctctgaccagcgtcgatgtaaggaattcgtaggcgtagttgatctgctcaaactgttcccgaccgtccgggtttttgtccgggtgatatttttgtgctaatttgaagtaggctcggcgcactgccgatgcgtctttccacccggcagtgggatccgtcgtggacagccccaagcgttcacaagcctgttcaacagacattttggccggtttgcgcgtgatctcatcatgccaagcggagagacaggcccgcaaaaactcgacgggctcgcgaataggccaattcggaaagcggtgattatcagtcaaatggcgaaggtaatagaaatggcagaacagctcttcttttagttgtggataatcaatgggaggaattggacaatatctgacaaaaaaattaatattgtatttgaaacaataaaagtttttggttttcaatacctgtaaagtgccttaacatttgaggaaagtctggacgaaaagtcggacacatgaagagcaatcttttcgatcatattgcgtcgcatttcactattccaaatacattcgggattctcaaactctccgaggaaaacttcggcatatttctccgctccatattcctaaacaaattttgaaaaagcaattcgaattaaaaaatgacttcgaggtagaaaatatttgcttctggcaacattgggcatagcacagaacgggaggcgagctccgacttggaaagagttgaacggaatgcttgtttcaaatgggtgtctttgaggaagcgagcaaccggcaaaatgttggacccattgtacatcaagataaagaaaaatatgcccgacaaatacagtctcgaaatgtaagggttgtcctgcatgacatcgttgaccaaagttgccactcgttgcacaatggacgggtcgtaagtaagcaacaactgcaccagttggtacagcaacacgggttcagaaagcacttttttgattcgaggcattggacgaatgacagcgcctgtctcatctctaaagcatttttaagaaaaaaaaaaatatgaacaattgacacttaaatgtatttaattaaaaaattcggggtagtctgggaattgaccccaggactctcgca

SEQ ID NO: 27770 - DNA, 1131 bp, Heterodera glycines
taaggggagggggagagaagagaaaaggggagagggactttataaggggagggggagagaagagaaaaggggagagggagaagagaaaaggggagagggagtgagataaggggagggggagagaagagaaaaggggagagggagtgatataaggggagggagataaatccaagcaaatggattgccctcatttgcaaatgttcagcaattttggccccttcgaattctgttggaccaacgacttttccatcagctgttcgccgtctgtggccttctccgccgtgtccaacgcactcttttcaaagttttggctgccgtcccaatttggcaacgctttcgtcaacgattggccccctgggcaattccctttgcgacgaattgtcccaaggggcgtttgtgcggggcattgggcgcccaacttattggacagctgcaacagctgctccaccttctgtttacttatgtgaatgggctattaaaaaccaacgaattcacttcccaattgcagttcttttcgctgaattccttttgttcccgtgcattggttgaaaacatcgaaaagtcgcgcaattgcgacgaaaacattcatttcattgttttagtggaaatggtgcacgaatggaacaacgctttaactaaattgcttttggtgatattgcttacccaattcaataagcataaaacgaaatgccgaatttttaggttatcgacgaggttttccgagatccaatcgacgaactcacgcggattaatgctgctttctgcgagttaattctttctccctctgtgagcccttcaattgtcgacaatgggccaaatgaccaaatcagtgaaaatggacacaaagagaatggacggattggggaagacggaattgacgacgaattccgtcttttggatgatttatctgaccgaatgagaagagtccgtctttacatgaaacactgccaacacaattggaccagtgaacttgcgaaaacagcagcggacaaacccatttattcccttaatttctcatcgcaacttttcacacgatttccattcgtatccacacagatcttgtcggaacattcatcaaatagataaactgaggatttattgaatatcttgaccttatacggtggtttttcc

SEQ ID NO: 27771 - DNA, 952 bp, Heterodera glycines
tggggagcaaaaatccaacccagaattaaagtacaggctatagggaggttatccggaaggattcggtctcccaataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccattaatctgggcgcatcggttcggggggactgccccgaaaacaaaaaaatcgatt

SEQ ID NO: 27772 - DNA, 1238 bp, Heterodera glycines
cgctttgctgctgttcccttcgccaattatttggcgtcttccctcttccgtcaatcgcagccaaacgccgtcttcgttgcgcaacagttcgccaaattggagcgaacttccgcggtggacgaggccaaattggggggcacagagagaggggagaacgcggactttgagggcgaagaagggactgacgacggggaacagagcgattctaaatgaaagaacgggcggagcaagatgaaattggatgattcattagatacttttcatttccatttttggcattggcatttcgcatggaatcgcattggccaatgcttttgtgccgactttcaattgtgacggaatgttcgctgctggctttttggtcctcatggacttctaacgaaaatatttgtccactcaaaggcattccgtccacggcacattccaccaaatgccggcccaccctttgcggcgtccaaacggccgaaaacatttcgctaattttgaaaatattttcaatttcaaatggctaacgaatgaccttttccctcttcgaagcttcagctgatttcgcaaaggtcgggtgaaaacgaaagaaaaacgcaattcctccaaagaccaaagggcgaatttgggcagtgccgaaatgcattggtaaagggaacggccgcagggaacggcacggaaggacattttctgcatttcaaattaaacccactaaaagcccccccccccctccccgactcaccatttgttccgcttttagtccgccccaatcggtgcctccccctcctcccgcctcctcctccgcttgtccccccattgttccgctgctcagagttaccgtcacttccaattcgcacacgggcatcacttgccttctgtgctggtcccgtgccacaaaagtgatctgaactgtccccctctgatcagaatttttttcctcccttcgaattgtcccaattttcaacctcaacgggccttccgatgcgaatgtcctcttgatgcgcaattttaagctgtgagttgatcacactgacaacggattggtggcacagaaaagcggacaattcggcatggcgcccttcggcgaattctttcaaaaatgccaactctgaaggattttttccataattgaatgtcaaaaactatcagatggaccttcgctctccgcctgttgctggtccgtcccaaattcaatttgttccgttatttgtgccatcgacggcgtcatgccgtcgttcactccccccaaaatg

SEQ ID NO: 27773 - DNA, 1536 bp, Heterodera glycines
ttttcttctatttatgtgataatgagggatacgtggccttattagagggataaaattaatttataattagtttattttaaagaattttaaaaaatgtttaaattggctcaaaaattaccacaattgattatcgagaaaaattattttatggaggtgtttttggttaattctttgttattttcgtaaaaattatttgtctctcgaaattttttttgtcgagttttgactacctttgtaaaaagggaattttaatatacttaacattaagataaaaaatttatttggatatcatatgaaagagcacacttcaatctataagaattttatttttgtttatttttatctcacaattttccgtgtcaaaaggctcatggtaaatatggctaccatgggtaggatggtggtagcatttctaaccaccaactcccgtcaaatgaccatgaactacgttcttattgacagggtaaaaaagagggtcatggtcatggttaaatgaccaccaacttcgtggttgtttgaccaaagttcgtggtagctcttgttgaccgaggtttaccaccaacttcatggttatttaaccattaccaccttcttattgaccgggccctgagcactgagctgaaagaggtggccaggaattgccgttgaaataagtgttaatcaacggcacccacttgcttgtgcttcttcaacccattggccgtgcttcgaatcgccgagtgccgttccgacgaatcgcctgccgcaaaatgtgcacggtattcactttcgatgtccttttggttgaagttcagcgtccagcgattgagcgacttaatttttacaaagagaaatgaaacatttaagttatgaataagcggcactttttgatggagccaaaaacccttcgcgaaagtgccgttcgccccgtggatcacttgtgccaaccgctggtcaaagtcccgatgatccgtgtcttaaaaggaaatgccattcattccttccgcaagtggtttttggcatttgaacccaccgaaacgggtcaaagaggcggcgttgtggtggtgggaaatggccgtgtcgagtcggtcggccattgacaccgtcgaatggcccgcgtcggagccaatctcctaaacatggccaaaatgttcctcacattgctctttctctctcttttttgttcacctgcagtcccaaactgcgcgtgatcccttggccgggttatttgtgctgctttcgttggccaattgtgccgatattttgcccccaattctctccggcgtcgtccaactggtcgtcgtcggctgttgcttttcgtccaccgaattttgcgtcaccgtcgccgccctttccaaaggtttgaacaaagcgacggacgaatcgacgacggcgaaagattcgttcagcagcaaattggagggcggaagaacgccttaaggaaaaacgaaaacaaagtgaaaggaagcgaaacgacccagcgaaaataccatcgccgtgggtaagcatttggagagaagccgatttacgagtttcatcgacaagacgatgcttaaa

SEQ ID NO: 27774 - DNA, 1733 bp, Heterodera glycines
  misc_feature (555)..(555): n is a, c, g, or t
tatactggcctgcgtccatcgatgatgacaaatggtcatgctaatcatgaaagggccttttcggaatggcccattaaccatgttggaaatgaaccgctctgagatggatagacggaataaccaacaggaagggtgtggcgacttttgggctgagggagataaagcaaccctcccaaaaaatttaaagaaaaattaccaattgcacaaaagatttagccactgactggtcatgtatttaattaaatagcaattcagtcattttaaggcataaaaatactcgagaaggctcttcaatgtaacacgtttgatttgtctctccaatgttcactccattctcaattggtgggtgatgcgttacttaaattcctttcgattacggcttttgcattatattcgtccgttatttgtttgcagggtaatgcgtattatgcccgtggtgactacaggaaggcgaggttcccttcaaccgttcggtctttttactccccgacccattaaagagaccatcacatggctgacctttgcgcttctaggttaactcttggttttattgtngtaggaaataatcaacattcgacagattgcaaaaggacgaattgcaacaagcgaagacattgtccaatttgtccgcaacttacattctgtaatggagattattgtttttaattatttgtgtgaactattagtaaataagggctagcggatgtgagaccttttgcatttttcgtcaatctgttaaaatccatttaaattttctccaaccaagcctatttgcacctccggccatttccctattcctggtatattcttttttcaaaatgaggcttttgataatttttcatcttcgagtcctgaatttaaacgtaaaaaggtggatgctatttgtctcttaagattatccgattttgacaatgcaattgactgtgcaaataacgtgattaattttgccaaaaaaattggcgacaaggtagttgcatagtgttgcagcaaaacattcttctgctttgtttagtcgctcgaaagccgtgggctttacagcctcggggtaaatttgattctgaataatgtttaactcattattgttgttttttagcttgcctatttgcattgtgcgactcagcgagtctctggagcctacgaagatgaccaatcgacaaagcatttggagcaatctgtggagtgttttgagtgaatattttacataataaattaatgtactttcctgttatgtgactacagccaaaatttaaaaaaatcatcaaaagggcgtgcaaaattcagtaaggcgcgcgtataattacttagggaaagtgtgtagcgagggggggggggctttccgaaatcgaaaaatgaaaaaaaattgtaacgaaaattggaaaaaatttctaaaaatatataattttcttaagaaatttcatcaaaagtcagtcaatttttggaaaaatctgttagaaaatcgaccaaaaatcaataaaattttcaggtggctaaccctgctcttcaaaaaaaatttgtgaaattgtggtgaaaaagaagggttagttgcacgccgttttggtgattcaataaattgttcacttgtagtcacataacaggaaagtacctaaattaggtaatactggagaattggtgtcccggcgaaagattaattgaaaatttttcttttctaaaagtcgttaaaacatatttgtgggggttttctggtcgctgatcacgaatctgacattaatttt

SEQ ID NO: 27775 - DNA, 1894 bp, Heterodera glycines
atcctggcatcgcgtggccagcactttttgttgttgtatccaacaatgttctcattgtttgggtcgggatgctccgtcaagtaccgctgaatcaggtccctggtctcttcggcgttgaagcggaagaaaatccacactttgtcgacataacgacagtacagacgaattgggtgagctgcctcagtcgcaatgtcttcgaaagcgaggaattcattaggacacttaacaaaggaaattacaaagtaacacaaaaactataatgttccacttgtggtgggcctgtaatttcgctagcgcgccgtagaccgagaacgagcaaatcgagaacaagaccgtagtactgaacgatcaatgaggcaaattggagtcctcgaattatgcctaaaagagaaattgacgaagaaataatgaactctcaactggtgcctggtatttgaaacaaaaaacctaccgaaagagttagtgtggttcatgtccttgtaatttatcgtgacgttgtttttagctgtcatataatcggcgatattatggtcgacaatgagtcgtagcaatctgttgagcaatgtcaagtccattttctcgtacattttctccactttggcctcaagcaacacattgcattcgccttcgctggtgtcccaaacggactgcaaattgtttatgccctggcaccatttgtagacgagcaatggcggtggttcagtgtcggcaggtttcacccaagatggaaacagtctccgcttgtcagcttcataccacaaatattggtcgagataagcatccgtgaccttctccaatggctcgatgtcgtagacagggattaaatggctgtacaggtccatgaactcgatgccaacttctttgaaggaccgcatggtgagcatatgccgctttatccgagacaatgcctcatgtgggttgtcatatgcttgctcgatcagtgccaattcctctcgctgactttgattaagacggttcttcactgaataggcttctttgaggcgctcaagcgccaaaatcagcagtttagtgtcgtgtttgtatgatagaggcgggaaaggaatcggtgaaaaacgacgcgactccaaccaatggacggtggtcgtgtaaatggcaaccgcttcctcggcactcacatacggtccatccttcaggtaattgtgttgtctctcctgttctgcctgaaatgggtgagtttcgttagaaaacagaaaggcattcaataaaacaaccttcagatagagacgcgtgagacggcccaaattctttttgcacaccgttttgtccacagtcgcaccgcgtcgaacacgctcacggttgtagtgagccgagttagtccaccaatccgcttttgctttcacataacgcaggatcatgttttcgaccggagttgggagaccgggcactttccaaggaatgttcgccttccaacaccgccacgcctcgctgagatgttgcaagatgactcgcgctttattctgttttatgccctcgggcatcatatccaaaatgtcgtgcatcacagcggccctttgaaattaattttagagaatttgtacgaaatgtgtacctgagctcaaggtcaaagtgcgactcaacacgctgtttagtcacagtctttgcaactccttttgaatgacgaccttcgaattgtcgagaaagcaaatttccaagccaacgttcaagaagaggggtaatgccgcgaaggaagaacaaccacacacgccaaccaggtgcccaaaaaccgcagccaggaccctttcctaaaaaattggtaaatgtaaaaacctaaaaagggttcaacagtgttctcttccgtaagtgtaaaactgaaaaatacataccaactggtccggtattgaaccggtaataaatgagatgtttgaggtccttg

SEQ ID NO: 27776 - DNA, 756 bp, Heterodera glycines
attcacactgaaaagtgatttaaaatcaatgcaaaaaagaaaatttaatacccaaaaggcatttttgaaaaacatggacgctcaccttgaagaaattctgctgaaaatcgttttgggggagccatttgcgctcgaaagtgttcggatcctgaaaatgggagtttttcaacagatcagcagggcaactttgtgttacctcctcgaattcaggcaccggctgacctgaaatacagaaaatagttttgttggataaagaaaagcccaaatattcattgccaactcacccttgtgttcctccatccaagcgacaatctttttgaaagtctccgccggaatctccgccttggtcatgtcgaacataaagtcctcactcagtccgttggcttccacgttgaggtcctaaaaattgaaaaaagaggaaaaacgttggcacttttaaaaccgaagcatttggtggggccggcattttcgttaaacgatcaccctcccactcttttttgcaatgtttgcgccaatggaattggcataataagaaaggaaatggtgtgaaacctgcaacattttggcaaagaatccgcactgcgacaagatggagagacggaccacaactttctcgccatcacagcacacgcaaggaacctggggaaaaaagtggtatttgaaagcaaaaatgtcatgaaagcccatgcgttacccggggggggggggggtgaacatttcttatataaaagtgaaacctggaaaattgaactttta

SEQ ID NO: 27777 - DNA, 1146 bp, Heterodera glycines
gcggcaacatcatctttgaagtcacggagacgagcatttctatgacaaagtgatgagtgcgtgttctttgtaccaggacatggaaattctgccacaaggagaccaaacggaaatcggcgagaaagtgagtgtattgcctttgttgttaaaccttcgtttgtgcgaatttttccctcccatattttcaattttttttagtcaattttcttctaattaaagcatttttcgctagggcataaatttgtcgggcggtcagaaggcgcggattagccttgcgcgagctgtttaccaaaattgcgacatttatctgttggatgaccctttatcggccgtggacagtcacgtgggggcccaactctttaaccaagtgattgggccaagcggaatgctgcgcaacaaaacgcgagtgctggttacaaatgagccttcctgcttgaaatattccgattttattgtgatccttgccggtaaacgaacccaattgcaccattttattataccatttgaaacagatggccgagtcatttctgaaggcacttacgcggaattgaccaaaagtggcattttggcgcgtctgatggaggatgttgagtctgacagagtaaagtcggtctctgtccccacggaaaaaggtggtcgattttattggaattaatttcaatgaatattatgattatgaaaaatccataaacttaaaaaaacataataaagaaggagaagaagacaacataagcgacgacaccgacgaaacgtttatggatgaaaatgcggcggatgttgagaatctgctcggcacttctgcaatgtctaccgtttccggcatttggcacgccgaaagtacagtacatcatccacaatgttccgccgacaacgactcgtccgtgcggacagtgtcatttcttcctacaattatccctctgttcaacgacatttgaccggaattgaaaaagtggagacaggacgagtgagttttagaaatatcaaataattcgtcccttcgcccgttgaattcatttttcgaaatctgttcaaaggtgaagcccgtgatttacttgcgttacttccaagccatgggcttctctctctccatccttttcctcctccgcctcactctgagcactgccgcgtcgatgagtcgtaaccttt

SEQ ID NO: 27778 - DNA, 951 bp, Heterodera glycines
gaaagtttaatttggattagcttgacaaaggttatgggcagttttttgtttaaaatttccattttgatggttttttatataacgacatagcaccatatgtattgcataaaatttttatcacgtaaaaacataatacctaaaaaattcctgctaaggttttttggtgcagatgaaaaaagtcttttgcagcactatgatcagatcacttcttcatgttgatctggatactccaaaatacacgaaaaaatttctagggacttgggaaaatttttctggaaaaaaacattatgtccatcagagagcacaaaatgctctaaatgctaaaatgtgcaaatgatcacaattctctaagcttatacccgctgaggtatgggcactcatttgatcaacaccaaattgaagtacccataacagggatggcattccaggcgctaaaaattttctgaaatcggaattccaaccccaaaatgtcggaaatcggaattccgtgccatccctgacccatacctcagtggcagggatgtgcctaggtttcgcttttcgcatttcgcctttcgcatactcgaattttttggcgtttcgcatttcgcttttcgcatttcgctttttggcgcgaaacgcgacttttacacccctaagaattggattaaattgccataaaatttttcaaaattttacctataaattggctaattttcagtgaaaacctgtttataaatgatcaaaatttccaattttttccccggcggcgcctatcggcaccgccgcgcccccaaaactcctattttttcttagaaaatggcccaaatcgcaaaatttggtaatttgattaaaaactgttctcagcggcgccccaaaactcttatttctcattagaaaaataataaaatcacaaaatttgatcattttttagtgaaaatttgtcaacaaattttaatcaaattttcaaaa

SEQ ID NO: 27779 - DNA, 1113 bp, Heterodera glycines
  misc_feature (1092)..(1092): n is a, c, g, or t
cttcccattccctaaaaaggatcccaactcgcgtctgaagagactgatcaacactgctcgactcactctgttcatgaaagggacgcccgaggggccgaaatgcggtgggatgaaaagggggaaggaacccctggggaaaaggcaaatttgaaggaaattctaaggggttcgtattaccagcaaattcaaatcgttcagtccagagagattcgttttttagctttaacacaacggaatttagtttgaattcccttttcaggcttcagccgtcagattgttgatttgtgagtggtcggtccgcatcggagcaaatctcatcgttccttttttaagattgcgcagtcacaacgtggatttttggacctttgacatactcgcggatgagcaggtgcgacaaggactgaaatcctacagcgattggcccacttatccgcaagtctatttggacggagaactgttgggcggactcgatgtgatcagagaggagctcaatgaacaaaatttcgtagataaattgccgaaaaagcattaaaatggaattcttttggctctctttatttattcaacatttattgatgttgaaatagcaaaaaatactaaataaaatatgtgttttgtcattatcgtccgtacgaaaaaaacaagtgacaaatacaatgagttggttatattgaataggaaagggtgtgtaatgagaacggaagaacaaaaagatgggcatgaggtccgtgtgtaaagtgaacaacgagaccttcggctgccgtccattaatcggtcatgttgtcaaattcttgctcggatgttccgttggtggctgaactgttgacgatgggattgcccttgagaatcgcctcgacctgagaattattgccataatggacgagagggggaaattaaattggcaaaccacctcctttctgaaactgctcaagttttgcgtgaagttgtctttgttcttcagggaaacgttgtcctctctcactccgtccatcagtcgtgagaaggccttaggtgaaaaaatgggaatgaattgcaaattgtgaacagttgagcaatggcgaacaaacttgctcaagcggttgctgaagttgngtgggttgctgacaaatgaac

SEQ ID NO: 27780 - DNA, 1157 bp, Heterodera glycines
acgaaatacctaaaatcgatacggtttaagtcttagataatttactaatcaaataattactgttggtttttgacagcaaattgtctgattgaatggcaaaaaagcagtacgaccttttgttcaaacttctgttgatcggcgacagcggagtgggcaaaacttgcattttgtacagattcagcgacgatgcctttaacacgtcttttatttcgaccattggtatgtcaaatagtatcacaatttcataccgaaattccacatgacacttcaatttaccttaccttatcttctgggcagaaataaaacgggccgaatttatgaattttactaacgccaaatgaatttatcagattttcaatctttttgtttgatttttccaggaattgacttcaaaatcaagacgattgagctgagagggaagaaaataaagctgcagatttggttggttttacttttatttgattgtaaaaaagaaaaagaatgttgtttcctttccgttgtgctttttttcgattatttgttaatgaaaatgcggacactccaaataatggccctaattcaagtcaaacggttagcgcttttttactattttaagggacactgcgggtcaagagcgttttcacacgattaccacctcatattaccggggcgccatgggcattatgatggtttacgacataaccaacgcgaagagcttcgacaacatcgccaaatggctgagatacatcgacgaggttttgccaaacaaaaacccaaatccattctccaagctttgctattttttcaaatggaccaactttaagcatgcctctgaagatgtcgtaaaaatgttacttggcaacaaatgcgacatgtccgaccgaagagttgtgccgaaggaacgtggggaaaaaattgcgattgaccatggcattcgtttcctggagacatcggccaaggcaaacataaacatcgaaaaggcgttttacgacttggccgaagccattttggacaaggtttctttttttcttaatctgcgattttcctttgtcattttgatacttttagattgtgcccccccccccttttttctaattgaatttccaaagttacaaattcgtatccgggattcagaatttttaaagtgaaatcactgccatttaaatatggtactcatg

SEQ ID NO: 27781 - DNA, 974 bp, Heterodera glycines
gcactgaaccgtatacaaaaactctcacattctaaaataactcagttaaaacagcttttaatttttattgttctgaaaccaataattttatctgtaaaaaatagtcccatatgaaccaacacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaatctcccctctggtgtccttcattttaggaaggcactgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaaactcccctctggtgtccttcattttagaaaggcactgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaaactcccctctggtgtccttcattttagaaaggcactgaaccgtatacaaaaactctcacattctaaaataactcagttaaaacagcttttaattttaattgttctgaaaccaataattttgtctgtaaaaatagtcccatatgaaccaacacataaaaagtgcctttgcgcaacaaactcccctctggtgtccttcattttagaaagcactgaagcgtatacaaaactctcacattctaaaatactcagttaaaacagcttttaattttatttgtctgaaaccataatttatctgta

SEQ ID NO: 27782 - DNA, 896 bp, Heterodera glycines
tttgttcgaatttgggttcggggttcggaattttgccttcctaggtcatattcgtgttcagcgccacaatttacctaccttaattatttataatgtcttttgagtgctttatatagcacggtcacttgagtcccagttgagtttggcactccattttcggcacttttcatcctgaaaaagggcaagcgcgcccctaattctatttttccaacccatttcaaacctttttacatcgattctgaccgtttttaagcatttttgagtttggggcctatgatcaatattttccccttgaccagactgtttggctcgaaattcataccattttttcatacgattctcatgagcagtggtatcattgaatttgctgtggccaggggattgcacgtcaaatgcagagaaacgggtattgaaaaaaacaattggagattggatttcgttattttcctgtcattgttcgtccgtttcagcagtgccatatttgcgcagttccattcgccgttttcccgttgatgaacaacgcgtgccatggaatgtgcctcttgtggactattctccgtgcgattacaccgctgattcggtgcacggaaagccatgggctgacccatcggagccgtcaaaatgtaaattcaattcgatggacgacggggtgaacagagtttcgtttcacgggtacaatagttaaaaatgataaaaccaaatggtaaacattttcagcagttacaatttggacaccgatgggaggcctctgaaccctttcggacggacggggctcagaggcaggggactgtttggccgctggggtccaaaccacgcggcggatgccattgtgtcacgacggctggcgaatggccaattgcaatttgtggctattgaacggcgtgacactggtcagt

SEQ ID NO: 27783 - DNA, 1358 bp, Heterodera glycines
  misc_feature (15)..(15): n is a, c, g, or t
  misc_feature (50)..(50): n is a, c, g, or t
tagaactttttattngaggaataatttatccaatgaaagtatattttttnagtattaataatttatataatttacgcattatttgataaattaatttaaatagaaaaaaactttaaaaaattaattaattttttttatgaattaattaaattaatgttaagttaataaaaaattaatgctcaattttaccgaatgatattaattttatttttaaatattttaaaatattttttttttgtcaatttaatttgaatttctttaattttctcgccatctcatccttgaagctctgaagcgagtgatgggcaagattgtcatataatattatttttaaactatttaatgatgacatagtacaaaagtgaaaagtaaaatttgtttttattgtacgattgatttggatatttttgtttaatcaatatttaagaaattttcttttaagttcagttattaatattaaactatatttttagataaattgtatgaatatttttctttagtttttccattatcaaatttaatcaaatattcattcattaaaaactgattagtaggattaattgtgcttgatcgttatatattattatttttaatgatttttatcagttactctcccattgtctctatagtttatttcagagctgcgatctcaaaattttgaaaatcctcatttcagccataaaaaatcctcatttgccactaaaatacctcaaaaaaatcctcatttggaatgaaaaatactcattttttaaaacatcataaaattgcgatatggaaaatatggatatagaactccttcctagagactcaaaccaagcaaaaaacatgtttttcatgcgtttcaggcctccaacagtccaggaaaaaaatatggatttccatataattaccaaccctattataagcattttatggaagtctgagctcgaaaaatcgaagttgcacttcacttgggccaatgctttcactgtgcatctcttaaattttttgcttttaaattgctctttttgtgacgtggttttccaaaaaactttttgggaacattgggggagggggtccggcagtgccgataggcgctgccggaaaaaatttggaatttttgagtgcgatttgttaaaaattttgtcaaaaaaaaaatgattttgactgaggatttttcgaaaaaatgtttaagattcgaagaaaaagttcgaacatattgccaaatatacctaatttttcaaaaaatcatgcatttttatcacttttttgtcaaaagaccacaaaaatacgcaacatttttcaaaaaaatcctttttgaccctctaaaagatcacaaaatgagtaaaaatactcagatatcgcagctctgcattaaa

SEQ ID NO: 27784 - DNA, 1345 bp, Heterodera glycines
  misc_feature (922)..(922): n is a, c, g, or t
  misc_feature (927)..(927): n is a, c, g, or t
  misc_feature (1010)..(1010): n is a, c, g, or t
tttttttttttttttttattttttttttttttttttttttttttttttacctttttttttttattgttttttgtttttttttattttttttttttttttttttttttttttttatttttttttttttatgctgttttttttttactaattaatggattggatgtgtttgtgatttgttgttgtgttttgttatattgatttgtgttttttttttttttttttttttgtttttttttttttatttttttttttttttttttttgggggggggggggggggggggggggggggcggggggggaggaaaaaaaaaaaaccccccccccccttccataaaagaaaaaaaaaaaaaaaaaaaaaggagagaattttttttttttggggggggggggggtattaaaattatttttttatatatttcctcgggggggggggggagagggggcgggggggggggaaaaataaaaaaactcctcccctttttaaaaaaaagggaaaaaaaaaaaaaaggggggaaatttttttttcgcggggggggggggaatttaaaatttttttaaaaattccccttttgggggggggaaaaaggggggggggggaaattaaaaaaaaaatcccccccctttcccttaaaagggggaaaaaaattacaagggggggaattttttgccctggggggggggaattttcaattttcgaaaatttgccctttttgggggggccgaaaaccggggccggggaaattccaaaaaaaatcccccctttccccttaaaaggggcattaaattccaatgggaacggatttttttgggcatttagggctggaatttcagaatttttggaattttggccatcttaggggggacctgaaaccggtaacgggagaaatacaaaaataagtccccatttgcgcttaaaagggncgatnaatgtcaatttgaggcgatattttgggcatgtagtgctggaatttcagaattctcgaatattgacatcttagtgggaactganaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcttgtagtgctggaatttcagaattctcgaatattgacatcttagtgggaactgaaaacggtacgggagaattacaaaataataaaaatgaaaaaacaggaatttttctttaatagtaa

SEQ ID NO: 27785 - DNA, 131 bp, Heterodera glycines
ttttttttttttttttttttttttttttttttttttttttttttttctttttttttttttttttttttttttttttttttttttttttttttttttctatttttttttttttttttttttatttttttttt

SEQ ID NO: 27786 - DNA, 933 bp, Heterodera glycines
tatcagtagttactccaccagattttcggggttgtatttcatctccgccatttcagtcccagtggaaagggacgtttcagtaccaaatttaaacctttaaaaaacacctataataaatatatccaatcccagaagaggtaaataattgaaaaaacatctgaaggataaaacccaaggctaaatcgtattagagaaggaaagggaggcagaggatgggtgtcaactgtcatgccttataaggaaggcaagggacgcatgccacctgagcgcccgcgtgtgtgccatttaaacgctcgcgtatgccatttgagccccagagttatttttacagcgcacccatttgagccccagatttatttttacagccccgccatttcagtcccagtggaaagggacgtttcagtaccagatttaaaccttaaaaaacacctataataaatatatccaatcccagaagaggtaaataattgaaaaaacatctgaaggataaaacccaaggctaaatcgtattagagaaggaaagggaggcagaggatgggtgtcaactgtcatgccttataaggaaggcaagggacgcatgccacctgagcgcccgcgtgtgtgccatttaaacgctcgcgtatgccatttgagccccagagttatttttacagtccaaccatttgagccccagatttatttttacagtgcaaccatttgagccccagatttatttttacagcgcagccatttgagccccagagttatttttacagtgccgccatttgagccccagagttattttttaagtttagccatttcactcccagtgcccacgggatatttcagttctgagacccaaagcctattgagtacccaaagtctacggagggtcattacattccttttagtgcattcgaccacgcagggcgacggagggcattatcattcttt

SEQ ID NO: 27787 - DNA, 1319 bp, Heterodera glycines
gtgatcgaagaaaatgtgtttttgcgtttatctcaccatatgatatccgcaaaaaaaaaatagatgaaaccctaaaaattcgggccctaggcctaatgccctcctccatctgtaaatccttttgcgcggtatttccaattcatttgcaattttttgttcaatccttccacaatcttgttgcctataatcgcttctctgtttgtattcatttctcattgaaatgaactgatttataattgcaattttgtctgctcttttccaattttgaaaattcaaacttttaaatttgccaattttgttttccatttcttcttcagttgaatatgtcggcacaatgttttcctcggcacattcccttggaattttctcctcttcttcctcatcaaaaattggttcttttttggcatatttctccaaatccactttttcatcaccaaattccatctcttttttgactttttgtgttaaattggtccgtttttcatcttcgaaactttcattttcaatcttctcataatcaacttcttcaacctttacttccttttgaattgaattttgctttttatttgttattactttgttcattttccataattcatcaaaaaaatcatcgcccaattcggcgagtccaattagtcccataaaacacaccaaaagaatggaagcggtagtaaatgaatacattttctgtaattattgtattaattataacaatcatttacaatggtttcagtgataacaaaataataaatattagtgagagaaaattgaataaaattatttattctaaggcaatttaaatgttggtaattgagcaattaggccatttggtgccaaacatttgcaaaacaaaaatcggaaatgggcggtcattgggacagacggaggcaaaataataaaagagggagacgtggaaaacaaacaaaataaaacaaaacataaaggaataagaatgctatttaattatttcatttttgtttatcattcactgtcataggtaaaatatttataatatatttttttcacgctgtctacataaatattattattctagataattattttaaggatcatatattattgaaaatttagtttgcagaattttagatctaggacaatctgtcgagttatgaaagataaataatatatgaattataaattattatttcgtttgatcaacttaccctaatcccaaagtttgaatgaaacaaatccttaatgatatgacaaacaaaaaacagaaatcaagtcttaattactaatctcaaagggctctttgcaattctaaaagcgacaaggattttacgaattcctcatta

SEQ ID NO: 27788 - DNA, 500 bp, Heterodera glycines
atgcatttactttttgaacttgtggcccaaaattgactcggtgtgttgacaatatgaaacgaaaaagtgactgccccatgtggcccaatcagcagggcccaatcgtactggagccaaatccgaccggggcccaatcagcagggcccaatcgtaccggggcccaatcggaccgggcacaatcagcagggcccaatcgtaccggggcccaatcggaccggggtccaatcaacagggcccaatcgtaccggggcccaatcggaccggggcccaatcggacggggcccaatcgtaccggggcccaatcgtaacggggcccaatcggaccagggcccaacgaactggggcccaatgggaccgggggccaaacggatcggggcccaaaggaaccggggcccaatcggaccgggcacaatcgtaccggggcccaatcgtactggagccaaatccgaccggggcccaatcagcagggcccaatcgtaccggggcccaatcggaccggg

SEQ ID NO: 27789 - DNA, 1984 bp, Heterodera glycines
  misc_feature (1164)..(1164): n is a, c, g, or t
attaattcaaggcaaattttttttattaaataatttttctttattttgatgttttttaaaagattcatattaaacaaaacaattattaactttattattattttttcaattgtgaccaaataattaattaggtctgaaagtttcttaaaattcataaatgaaacttttgaaaaaaattttgctttatatcatttttggtggaggcttttactcgaactttagatttttttgtaatggatttaaaaaggtcttaatatttttttgaggaattttggctgaaaatttttcaggttattctggccctataaccaaaagaattggattgaaaatgcctaaaaataaaggatcctcagaagcaaaaataaaatcattttaatttatttgataattggtctaaattaaataaatattgaaaaatgccgaatattgagttcacacccgccaaaaatcagaaatttgatcaaaatcgctaaaaatttttaaaggaaccttcggaacccagcacctcccgaattctaagaaattttttttgttttatatcggtattttttgcagaaacatttaaattttttggtcgccgttactaaattttggttgaaaatggcacaagttttctaaataaacctcagatcaaacatcaaccggaattttattaaaatatttgaattttcaatgaaaaaatttagtaacaatgataaactcacaattagcgcaggtagtgcttcttgagaatgtcgacgattacgcaggcgaacattgtgaggccctcgggaaattgcaaagcgactgaaaatctttgaatttttgatttcatttcagtaaaagaaatgggacaagaccagggttcccggatatttgcaggtgacctcagggtgtatcaagtaaatttagcataaaatgtaaatttatcgaatccctggttattcccaaaaaacatttgaattttcattaaaaaattcagaaaaatcgtgatttgtttgccaattaaattttttgtcatattgggcgtaaaatgatttagaaaaattaaccacaaaaaagtaaccaaaatgcatttttttgcaaaaaaaatacccaatgggcttaaaaaccccaaatttattcaaaaaatgcaaaaaagattgacggattttttttttaaatttttttaaataaaaatcttanaatttttcaaagaaaaaataaaaattctttttaaaaactatggagtctttataaaaggtattaatttcatcaattaatttcatagcacattaaataaaaattcagggatagggacaaaacaacgaaaaatttcacataaaaacaaccttgaaattagcctttatgaataagaaattccaccaccctctcccttaaaaggcctaaatttttacgaaattgaaaatgctctaaatttttcatttttcatagaaaaaatagttttttttacttttgtgggttaaaatttcgaccaaaaaagcctttttaatccggtaaggagtaaaaatcaattatttagggcagtttgatccatcacatattttttcatacattaaaatagaaaatttttcagttttcagaaaaaatttccggtttttcaaatttttcttaaatttttgtcgttcccctcgccccctctctctcttttttactcactttaaattgtgcccaatcgaagccgccggggcccaacgagcgcatgtactcctccttcagatcatcggcgaaaaaatggcttcggactgagattttacctaaaagagaagcatttctttcaccccgaaaattagaaatttttgaaaagacatatctatttagaaaaattcacggcgatttttaaaaaatttatattttttgtccactgtttgtttcgtgattttcaattttttccgccaaatttcacttaagtgcataccttttagccaatttatgcagcaaatttggcgtacatgttgaacagttcggccgaggaaagggacgcttctgtgccatctgttccgct

SEQ ID NO: 27790 - DNA, 1434 bp, Heterodera glycines
  misc_feature (1080)..(1080): n is a, c, g, or t
agggacaccgccatcagagacatcagagagagggcgacggagttgggcgagcagagagcacaacgaacgggacggcgacggcgacgacccagtcgcggagccgatatttggaatttgcagagacggaattcagccggcccagcagttattttcccgttccatttgtagcagcagcgaacagccaacttcaggtggactgatggaagtggtcaattcgctcttccttatggggcacgggtggcgtcagaaatcatttcattgtccatttgccattgtccctccgctgagcgacaataattcgtcgatttttagccaattaatcccaaggcgaaactaatccttttgactgatttgtaatcgcaaaatattttggattattttggaaagaccaaacttacgggtaggtgagttggccatggagaccgaagaccccccccgccccacattggcgccatttctctttttttgggaatttccattaatttacttttggaccaaaggcaatccctgcgaaaacgctaagtcagctgatcaggcaacacattgcacggaatcggtaagcatttgatgtgctttttgctaacaaaaatcatttaaaattttcaaagaatgaaacaatttgagacgcaatattccgccgacaatttgagggtaaattaattggcacaaaaagtagcagccggataacaatattttaattattgagtcggctcaaagtcgcgagaaggaatttcgacaaacgccgttccgtcggtggccctcaaattcgaccattttgagttatgccgagaagaggcgacaatggaaaacggagctgaaaagacggctaaaggagcagaaagtgcggacgcgtatcattccgccgcttttgataaggcaattaaaatttcaaatagtttaattaaactcagtgagccaattaattagtcaattaattgccaaacattccagcggtggcggtttttcatcaattctcacagacagagaaccggagaatcgctattacgtggtgggttttggcctttaccgaatgatcgctttttcttctgatcagacttttcgtctaatcaccgtcccccnccccccccctcagacgtacagtccacagacgcgcacttaccaagtgtcgcgccgtccgccgccctatttgtacacaacggaccaggactcgcttccccagcaattgtacgtcttcgagagttaaaaatggcattaaaaaacgaaaatcaaaatctgatcaaaaaattcccgataattattaatcagatcaccgaaacgtccattatattcatacctgtgcaagggggggggggtcagccaagaggtcttacgatcgactttggccctcccatgggagggtcagagcccatttccattacgatcgaccatttcttgcctgctgaagacctttttgttgctcttcgggtcaaaaaa

SEQ ID NO: 27791 - DNA, 1817 bp, Heterodera glycines
ttgatcccaaatgcattaaaatttatgatttgctaattcctcctcaaaattgttataatcgataaagtgtggtgaaaaaattatatataaatatatttttgatccagtaaattgtaaaaataacttcaagaaatttcgcaaaatgtccaaattttgtatgccaaaatttgattttttttgggcctgatgtcctgatattgaaaatgttcagatcaaatcactgctttagttaaaaaattaataaatatttaaattgaaacttgtgactgttttccagccgtcaaacatcagctcgaacacctacttggcgctgctaaaatcgctgcagttgcgcgagatcatcagcctggacgaggagcaaaaatggacaaaagacacgaaatcaaaacctataagacattttccggctatgaattgggctcgagtattccttccccccaatgaaaaatttttaaacctaaaatgggaaacgttctgaaaaaatatgcctttttaaagaatatgaaaaatcggcgaaaatttgaaattttcgatgcggtgctgattagggggtatattttcgtggtctcaacgtgtaattgggttgaggatgacaaatttcaaaataaaccgatgaacaaaaattaaatgaaaatcattttaaatatttattattcttctctttttcaagccaaagttgccatgcgacagtatcaggtcgcaactggcaatggttctttgcaaataacacatgacgcaaatccatcatattttttacagattttctccaatttggatgaacaactttttgtttcggcgcatccattcaagacaaatatatcattattttgttctgaacgcaggcattattggagagaggaaatggctccttcaattcaattttgtgttctaaaatgtcaagatttaaaaaatatgaaaaattagttagggatgagatttgtcctaatttgtcacatttgtcctgagttggaggtagcgaccaaaaattgttctgggttcttaaataaattcataattttaaaattttatggcagaatgttaatgttttctcaagaaaatataagatttaggcaaaatttggtcatttaaaaatctggttttttgatcccaaatgcattaaaatttatgatttgctaatttctccccaaaattgttataatcgataaagtgtggtaaaaaaattatatataaatatatttttgatccagtaaattgtaaaaataacttcaagaaatttcgcaaaatgtccaaattttgtatgccaaaatttgatttttttttgggcctgatgtcctgatattgaaaatgttcagatcaaatcgctgctttagttaaaaaattaataaatatttaaattgaaacttgtgactgttttccagccgtcaaacatcagctcgaacacctacttggcgctgctaaaatcgctgcagttgcgcgagatcatcagcctggacgagtaaggacagcgaagagagacaaaacagagcaaaaatggacaaaagacacgaaatcaaaacctataagacattttccggctatgaattgggctcgagtattccttccccccaatgaaaaatttttaaacctaaaatgggaaacgttctgaaaaaatatgcctttttaaagaatatgaaaatcggcgaaaatttgaaattttcgatgcggtgctgattagggggtatattttcgtggtctcaacgtgtaattgggttgaggatgacaaatttcaaaataaaccgatgaacgaaaattaaatgaaaatcgttttaaatatttattattcttctctttttcaagcctaaagttgcccatgcgac

SEQ ID NO: 27792 - DNA, 1356 bp, Heterodera glycines
  misc_feature (1342)..(1342): n is a, c, g, or t
gagaacatttattcaatcggtcatatagggaaagactatgccgatttgcttaaaaatttttaccaatttattatatttcattaaacgggaaaatttccgaatacggtatctactcaaaatcgcacaaaaacacttacgggctttcttaggcgctgagaacgatggaacagcttaaaattcaacgcggaaaaccatttcacccggtttttgaaccggtttaaaactcggaacattgaggaagaagaaggaccctgaccttttaaaacggtcaaactcggataaatttggtatcattcgaaagctcttgatgagttaagtctaaaaatcaaggtatgaattcgaactgaaaccattaagcactggggcaactgagtcccagtgaaaacagacacttcagtaccaaaaaatgacaaggaaaataatttttaaaaaatgcaaaaaggagcatgcgaagacggagcaagtagtggggcgcccgagcgagcggagccttgctcaccatctcgtttcattgcagaaaattttgtgtcactaagaacttccgggcaattgcctagatcatttgtcccacaaaaaagagtttgtcccattcatttgtcaaaaaaaaattgttttcaaaagtcatgaaagtgtctcaaaaaaaattcgaaactaggcgattgccaacttccgtattgtcctttattcgtttgcatccagaacacacgtaacactgaccctcctctttttgcggccctgcctttgtccacttatagcacaatttgggtttagtggagatccgttaccatcacggatctacaacaaacgcgctgattataatttttatgcaaatcaatcggtaatacataaaaattgcgttagagcttaaaatttaaaaaatcacattcctttgattttttcatttcccatcaaaaacaagttggggtaataaaaacgagtggctcaaaaacgagttgggcaaaagcaagttgggtttttaccgaaagttttatcttcaccatttattccctgttagggatgtgtgtgatctatatgtgctgcttaaaaacccaaaaaaggtatgcacatactgtcttattttggatatttttctaaaaatgtttccacaattattgttttaatgcttttttgtgacaaaattgctagttttatgaaaattagagtccggtaaaaaaattttccgggacgggagtcccgaacgggattcccgtaaaaatcccgctcccgttataatcccgtctaacgggagtcccgggcgggagcgggagtaattcgaaaatttaattaaaaactcacaaaaatattttttaatgcacaaatttaaaggacaatcaatttattnaattaaaaatatat

SEQ ID NO: 27793 - DNA, 1082 bp, Heterodera glycines
tcttatcactggttttgttcattataaattttacaaattatcaatttttcatttcactcttttcccatattcccaggtcattgactcgtccgatgtcgtcatcgaagttttggatgcccgcgatccgatgggtacgcgatgccgccaagtggaacagttcctgcaaaaggagaagccccacaaacatttgatccttgtgttgaacaaagtcgacttggtgccaaattgggttacggtaaatgcatttttcaaccggcacaaatttataatttattccaaataattcggtcacgctttattttgtaatttatagcaaaaccttaattacattgcagaagaaatggctccaaattctgtccaaggaaattccgaccatcgctttccacgcgtccattcagcatagtttcggcaaaggcgcattgatcaatttgctacgacaattttaccggctccaccgcaaggaacggcaacagatcagtgttgggatgatcggttatccgaacgtcggaaaatcctccgtcattaacacacttagggccaaaaaagtgagtgaagcgcaaagggtggtcattgttgggcaagggcgtagccaggggcccccgaaactcaaaaaagtaaaaattttcagcaaattttatgcaattgcatatttttgaaaaatggacctcaaaatggcaacaacaaaaaatagccatttggcgacaaacggttacaaattcctgtaaaatacccccccccctaattcgggatttctaaaaaagaaaaatacgcccttaaaatcgaattgttgagttcagtccccccccccccccctcgaagcaagaatctggctacgctcttgttgttgggtactaaaaaaacgccaaaaaaatttaaaaataaacttaacttccttgcctaattgtagaaaaaaatttttgagaaaataagcagaaaagtcaaaatatgttctgaatttgaagaattttaggtgtgcaaatcagccccattggcgggtgagacaaaagtgtggcaatatgtaatgatgatgaagggcatttacctgatcgactgtccgggcgtcgtttaccctccccacgggg

SEQ ID NO: 27794 - DNA, 993 bp, Heterodera glycines
tgaatgagcaagcacctcgcgaagttcacgctgtaaatattttaatatttataaattaaacatatttaaaagttacgtatttaagaaatatttgactgtttccggtgtgaaattccatatattgagggatcaaatagcgatccaaccaatctcttgaaaaacgttgtgaccgacaaaaaagattggtgattatggaaagcacttggactcgaagacgaaaccatcgctgattgagtttagtaattaaaaatatttttgtgaaaagcgaacttcgctctcgaggttatcgttgctttgagggatactctcatcggatcgtcgaaaaaacccaaaaatcgcaggtacaataagaaattgaatcactgaaaaagggttaataattgaacggagatgcgatggtacagactttggctctattgctattgtataaaaacaggtatttgttaattgattagactcatattcgtgaataaaagcaagaccttcatgagagagtaagtcagggccatctatgagctcccaaagggtttgcacagaagattgttgcaatgtgaacaaactgtcggatgacaaagacggagggcaagacaaataacgggtgacatgcacaggcaatcgcagattagcctggtaatggacgcctttgttaacaataaaaccaaaaatgtttgaatgcgacctgttcaaaaagactcggacacgcagttcgaataggaatttctctttgcaaacgaaggaaccggaaaagatcgggcagatgactcaaaattgtttgtttgacagttggacattgttcggcttccgtgcacggatcatcaactaacagatgttcaatgtgagaaaaaaaagcatcaatttgttgttcatcgtcaacattgagcaaagtagccatgtcaacaatacgcatggctgcagacttccttggtgaaaaatattttaaacgtgttttgagctatttaaaaataaaccgattatgaattttcttaaaataaa

SEQ ID NO: 27795 - DNA, 1260 bp, Heterodera glycines
  misc_feature (1227)..(1227): n is a, c, g, or t
tttttaatttgttatttaaattagttttcgtaataagatggagcctagaagcaaaaagataaaacaattaaacttcatcatcatcggctgcgacttccactcgagtttcagttagaaattgcacaatgtctgctgattaccgaaaccattgacagacaattaatatgccctgataaaatatcaatttgttatagcaaaatgtgtcctgagtcggattgaaaagcgcaattacatgttatttcctacggtttaccttaaattcaaaaatgaaattttaaaattaaaaaagattcattttttcaaattgaatgaaaaaaatataaacattaaatggtgataaattcaattaattttaattaaaaatacagtttttctcaatttttccctaagaaatttaaaaatgaatttatcacaagcttatgaaataacattaatttagagaaaaaaataaaataattatgattagaagagggaataccgcaatttaatttgtaaatgtttaaggcaccttcacaaatcgcgagaataaataaaaaaaagggcacatcagaactccgagcggcatgcgcagctaataaataagcaacacctatccgagtaaattcccttagtttaaatgattacattttattgaaaaaaagctattgtggttgaataaatttaaaaattgggtcggcatgaatatgacgtaaaaaatattttaaaatatgaaaaaagcgaataaaagaataagtgaaaaaatattaagtgagttcaaagccgaccaacatccttttgcaaaaccctaccaatttccattagaaaaaaggaagaaaagaattattatcaataattttcattttttatcatattttctatggaaaaaaatattaaattctatattgggaatgaataataaaaaactgactaatttaaaataggtggttaaatttttaatatttttgattgaaatgtaaaataaaaatttaaataaataagaaaaaaatttttgacgattgaaaacataaaccggatctattgctcgtgaaaattgattatataaattattcttcaaattttttaatgttaccgaataataaaatataaaactaaatttttaaaacatagagaacatttcaccttatgaatgcttttcatgagaccaactaaaatttaaaaaacattcgcaagattctgattttaacaataaaaactatttataaaagaaaacttaatgggtaacactgnaaaaaaatcgtgtccttagcatgagacatgaat

SEQ ID NO: 27796 - DNA, 1490 bp, Heterodera glycines
  misc_feature (12)..(12): n is a, c, g, or t
  misc_feature (85)..(85): n is a, c, g, or t
  misc_feature (98)..(98): n is a, c, g, or t
  misc_feature (138)..(138): n is a, c, g, or t
aaaaaaaaagantaaagataaatgaagaatttgtacgagtgtattttgagatttcaaatcattaaaaatgggcacccgaaatcanactcaaataaatnttatatggaataattaataattgtcaaaattctccgggtncggtgggacagagtgccagactattttaaagagaaagaaagcaaattgaaattgaaacaatattgtgaaattgaaattgaccatctccaaattcctttttttgtgatttttggcttttatttccgccgtttgcttttttcacaattccgttggtgaacagtgccgtcttttctgctgctgtttttgctgcgtgccaatgccaccaccatcaaacagcagcacgtacgcgtccaactccgcgttgagcagcaccaatccgtcgtccagcagttgaatgcccggctgactgatgccgtacgggcagagacgcctttctaagccgacgaggctaacgcctgcgaaaacatttgaaagtatttgggacgacgggtgctagtgcgtttcttaaaactgcaacccctccgcctgatttcaaaaaattcttgaaaattttttgaaaagttaaaatatttttaaaaatttcgcaaatacatttaaaatttttagaaaattaaatattagaagaaatttacaaaaaaaaattctaacaaattttctgagattttccaaaaatatcaccattttttggctatcaaatatatcaattaatgtatggctaaattgctttgatgactttgacaataattttgtaaaaaatttaagcataaatatcatggtagacaacacttaaagctattgaatgatacaatgaaatattaattttgttgtatttgagcaaagttatgaaacaagaaatatttctttagcaaattctaattttctctgagaatttttctttaaatgaattttttttttacaaaatttaattttcacaaaaaaataaagtgccaaggtttgtgaaatttataaaagagataaaatttatgcatttaaataattaaaaaattaattttgcgtaaaaataattaaaaatgtgcttcagtctttatgagaatatttctgtttatttcacctgaactcagcgctttccctgcagtgttttgtatggcgttgcgcacagtgttcaaaaaactttccaccgtttgcggggaaaggccaaaaaagtcgaacgcatcgccacgaagtgccaacgttggaatggacaatgaaactggcaaatttaatcactttggtaaatattaatgatagggcccagattcaaaaacacacaaaaccactataggttttcttatgcgctgaaaacgattaagcaatcaaaaacttttacccgcttcaactttaaaccggtttttgaagcggcggttcaaaatgccgaaaaatttttcaaaccttttaaaagggtcaaacccggacaaatttggtatcattcgacagctcttaatgagttacattcaaaaacccaagaatgaagt

SEQ ID NO: 27797 - DNA, 1893 bp, Heterodera glycines
tgtcaaaaacttacaaggggtaatgcttcaacaaagaaacctttagtgataaatatttttgtttttcaggaagtgatcggtgtgttcaagccaaaaaatgaggagccttacgggtcattaaatccaaaatgggttaaatgggcgcacaaattgctctgtccctgctgttttggtcgttcgtgccttgtcccgaatcaggcaaacaatttacacagtcttttgacctttcttagcaattcagggttatctctccgaggcgggtgcttcgctggtggaccaaaaattgggcctggacattgtgccaaggactgcgattgtggcattggcagcaccgaccttttactatggacgaattgataggacggtgacgaacacaaaagaacaaattgccaggaattatcccgacttgggccggcatttcaagcgcatcggattgccaccaaaggtggggatgactttcagtttatcatcttccattactcgcagaaattcatttagcggggcagtttccagctgtttgtccgtggcttcaaagatgccaaatattggctcgaccaatgggaacaatctccggaaaagacattgccaaagccaagccgaagagaattgcaactccaatttgagaaaatggtcattctggattacattatgtgagcgatattgataatcattttcttttctaattttcaataatttaagacggaataccgaccgaggaaatgacaattggttgatttgttacacaccaccgacaacaaaagcaaaagaaggaaatggcaaacagagaagaagggttattgaaaagaaaagtttattccaatatttattttttctagtcatcaagcagcagtttgggcgagttgaagcgatcggacagtttgacccaattgaaggaggaattgggcaacgaaccggcaaaattcacggagcacggcaaaatcgtcgatatccatgagccggtcacttacagaagtgaaggtatcagtgcaaacaaactctttatcacttaattgtttgtttttaacccggtagggtccatcagcggtcgtttgtcctccaacagcagttgggaggacgtggaaatgccccaggtgaaagtcgccgccatcgacaacggactcgcctttccgtttaagcaccccgaccaatggagagcatgtgggtttggccgggcacctaccaaaagcacagactgacattgacaccccaattcagaccctttccaatgggcaaaactttcgatggcacagctcccgttcagtgaagaaactgtccacaaaatgttgccggttcttgaaaagagtgactttttgcgcgagttaggcaatgatttgcggaacatttttaaagtgggaaaatctaattaaaaaagaaataaaataaaaatttagacggataagggtttcgacaaaaagacgtttaacaagcagctcagtgtggtctatggccaaattttcaacctgcgcgaggcgttgagggaacggaagacgccggctcaattggttcaggtggggcttttggtgtgaggcgatatgttggaatttcttacaacgctcactagcagttgaaatgtgtctatattagtacggaataataactaatcacgtgtttcgaaaagttagtaacaataaaatgtctcataattttactccgaaaagttggcattgattttccaccttttgctttcagatgacgcccctgtacataatcgagatgaaaaagaatgtgttcaagcagaaagtgcacacgcgttccccgctcttttcatgctgttgactcagtgataggcctttattatcagacattttacgccatttaaaaagttgtaatattaaatttaataaatctcatactatactttatttaatatacataaatctttaaaatatataa

SEQ ID NO: 27798 - DNA, 1482 bp, Heterodera glycines
tatttttattctattcatgaattcccgggggattttggggtcccttatcatgaatttgtcaggtatttgaccaatgccgatttcctaacctattttgcattgataaaattcaaaataatccactttttaactagcgcccattaatttctgttatttgaagcgtaagaattgcaaatttagcgtttgggagaaaaatttgcaattttaaaatttataattttaagcttactgttgttagcacacatttagtaaaatattttggcattttttaaaatccgttccctattaatcactcagatgcaatgttgagtattactcagcccattctctacacgtatttgtttccgcttaactcgcatacagaaacggcaaaagcggcggaaagtcgaattggcattccctttataattcgccacattaattcttatttggcggcaaaaaacaaagagccaacagccgatgccaaagtgaacaaagcatttgccagaaaagcgcaggaaattttcacagaagcgtacaaagggttggcgaaacacggcactttcttcggcggcgatggcatgggacggagtgtgtgcattttgatggcattcaaacggctaattgagggcattttaccattgtgtatgacggacaaaaattgcagcaatttggaacagctcaaaaagtggagtgccaacaaaaattgtgcaacggacgaatgcaaaatgaatgcattcaatgtaaaaaaagaaagaaagtgacacgaaaaacagaaaaatattaaaaattattaaataaattttacaaaggatttttagtaataaatgttgataatatttaatcttaggaacaaagaaactttatggcatctattcacttggaaatgttgaggctatacatcggagaacaaagtgaatttgctgaatttataagaaaaacgcctggcgcaaaaaatcggatgcgcaaattgttagtcaaagaggcgaattatgaagagttgatggaaagttattcagcgactgtgcaaaacgaagaaggtgcgaaaaatatatttatggttaaggttatatttttaggtttttacctcttttttcgtgagttccctcggtctgaaacgcacgaaaatttgttttttataaacaacttttcgagttattagcacctatttttaggtttttatttttagaaccgaaaccctaaaaaaattgaaaaacctatttgacatattttggcgttttgcccaaaattgtaacattttttgtaaaatattatctaatcatgaatttacaaaccaaaagggacctcccattgatttttaataaattaaaattaacactttcaaaattgctcttctgatttcatattcgagatcagcatccaagaaaacccccagaaaccgatttttagctcaacattttttgcatccaatttaaattttttttagtttttactgataattggctggtggattcatatttgggatttctaaacaattttgaa

SEQ ID NO: 27799 - DNA, 791 bp, Heterodera glycines
ttacttttgttgtgtttatgcgttccatgcgtgttttcacttcagcaattttattttccatctcaacgaaagtgtcgtcatactccgacgaaatgcctggaattaatgcactttcatttttaattaccaggtgtttttttaaattcaccggtgtcctcaatgttattggcacggctgatcagtgtttccaattcttggccaagtgtttgcaaaattgcgtcccaattgtcaaagcattcgccgaacgctgggcaacgaggcaatacgccagtgtaactgtccaatgtaagtggattttcaaatgatttttttttagaaaaaattaattgacaagaaaaaacatcgaaattttcgattttttattatttttttggtttactggtcacgtactattgttttcgagtcatcgcttgaatgtcagggctattgaaaatttgcagactgtcagttgggggagaaataacaattgaatcgacaagggcctgaaataattagacattattatcagggtagtaattgtaaagtgccaaaaaatgtttgttgacagtagtataaggccccggggcgggggtccagacccctgcccccgcttaaaaaatcatacatttcacccatttttttaaacaacgaatgtgatccaggggcaggggtccaaccaccatccgttcaatccccataattggatccattgagtgctatggtttgaacttttctaccagtcaaccttgctcgctatcacttgcctatgtgctacgtctatttagggacttagttcacctaacagtttaatc

SEQ ID NO: 27800 - DNA, 1037 bp, Heterodera glycines
ctagaaaatcattcccaacgtttagcatcagatcgtccaatattagaagcagtggtttgggttgaccctgaattaacgcttgattcggcacaccgttatgcgtctcaattccccgcttcatcagctcaataaccgattcgttcatctcagaatagcagtacagtactttggcaggtggtggatcgattagctctgtgtaatttctgagcaacttcatcaaccattgagttttgccactgccagtggctcccgacaaaattagagtgaatggtgcgataaacattccttttttcatttgattgaatcttttttccttatttatatactttccgacagatttgattgtattattttctttaattatatctatttttaataattttgttattattaaattatttttagctcttctaagaaatggtgaacggttttttaaaatggtgtttatacatcaattatcacaaagtaatttggtctatctgtggcctaatggttagtgtgtttagttctttcggagaggggtaaaaagttcggtcccgacactatgtgattggatttttaaatgaattattagttataaattaatgctcaacacgaatacgtatcagtggcctaatggttagtgtgtttggttctttctgagagggggtaaaaagttcgatcccgacaccatgtgattggattttgaaatgaattatttagtcagaaataaaatgctcagcacgaaagcgtattagcggcctaatggttagtgtgttgggttttttcggcacaacctgggttcggttccgcgcggagttagcagattaaatttcaggacaaatggtcgaaaagggacaaaaggtcaacctgggataaatgatccaaaacggacaaaaggtcgacaatgggacaataggtcaaccatgggggcaaatggccgtttgagtaccagaaaggacgtttcagtgccaggactctggtactgaaacgtgtcagaaaatctgggactgaaatgtccgagactgaaccgtacagggaatcgtgggcttacacta

SEQ ID NO: 27801 - DNA, 1000 bp, Heterodera glycines
tgacttgcgcatacgctaaactccttggtccgtgtttcagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagtttacgtccgtaaacgcgaattagaaccccacagtcgcgccagcacaccaaaccccacagccgagctgagcaagtaacgtaagaacacgtacaagtacatg

SEQ ID NO: 27802 - DNA, 1645 bp, Heterodera glycines
  misc_feature (41)..(41): n is a, c, g, or t
  misc_feature (55)..(57): n is a, c, g, or t
gggttttgagtcccgtactgaatttcgcgaccaaaatttgnctgcgggggtgtgnnnctggaaatgtatgcgtgagcatagggcaatttgtgtctcggttcgttttgttggatattttctctcaattcatttagccgaatataacctcttgggtgaatggcggacacttggtgttccaacattgaatcagtccggccacggccatccaacggaagtccaagcagttcgttctcgttgtgctggtccaactccacttcttcgcccgccaatgaaagagtgtcgttgtctaaacggcgagggagcatgttttggagaacaaaattctgagccggtggtgcaacggggtcccggttctgattattgggacttgaagttcgaattgggacccgaagtgagctaaaagctatttcgcgctgatgattttccagaaaaacggcggccggttgaaaattccgcgacgcttcgaagttctccgccgcataatccgtccaattcgtccgcaatccttgctgatgtgcgacgtttatctcgttgtcctcaatttcgactgcaactccattgtctaacagacgacgcaactcctgtcgtgtcatataccgacgactgttttccattgtgaagagaagagaagaatttgcaagtttctacaagaatgcttgctgctgctttttcttgtacacttctacaagaaagtgcacaaatgttgggcgatgggacgatggcgattttgtagttttttttttttttgatggtttgttactcttctacaagaatgagtaacaggcgcgtcaattgatgactccttaatttctctgtcgaatttgtggtgtggacaattgctaatagtccccgaattgttgttgcaccaccaaatcaatagaaattaatcgaacaaactctgctcacccttgtccaggagcgccatgtcgtactcttctggtgcgaaagtgcttttcggtgcggcgatgtcaatggaaagcaattagtgataattcgactccttttgaaaacaattcactgttggttcgactttccaaaattccaaactcagtcaattggtggccaaaaatagaatccaaaattatatttagcacaaaacaataaaattaatgagaagatgagaagacaaccaaaaacataaaaacataatggtccaaaactgagaaaagaaaataactaaattaaaagagacaaaatgccacacaatatagcactaatttaaataattatccaaatatcacaaaggcaataaaagaagataaataaataataaagaatttattagctctgagtttatattttttattgtttgcccaaaaaatattattcggtctcaaattatatacgattagataaaatacgaataccaaaataataaaacttccattctaaataatacaattaacgattatttttaatcatatattagagtttataaaaattataaattacttttacaattttgaaaatattaaaaatttaaaataattaaataataattaattgattaataaatatatatctttcttattcgtgtggaatttattttctattaatcgcgatagaaaaatatatactgaattgaaatatttaatttaatttataatggactatcatagattcgataacaaaacaaatttagaaa

SEQ ID NO: 27803 - DNA, 1304 bp, Heterodera glycines
agattcatttttgtggttcaccattactttgacaataatgtatttttatcaatgtaattttgagtctttttctcatttgtgattttgagaggttaatgaggcgataataaaagccaaataatggtacagcatatcccatttttaccatagaattagtttttgcgactcagaattttcaaaatgttgctttctgacaaaaaaattcgatgcgattatgaaaggcgaaaacatttcatcaattatattttttctttattaattgaaattggccataaataggcatttttacctgctaaaataaggatttagaaagagtaaaggcaaaatttgacttaaaaggtaccaactgaatttaaatttggcattttcaatttagaaaatttcattatttctcacttattttgacactcctcacggttttcattcgattgagtccaaagaccggtcacagcatacaattaatggaaccacaaattcatcgccgccagatatctgctttaccgtttgagctgctcgctgggttgtccgtgccattgcggcattacagactcggcaccgtcaccacagctcatcgagtatcaccaaattggcttttaaataccgcgccggtctgtggacaaacttttgcccggttcatcggagaaggccatcacaaaaacgtaaataaacaaaaacatttttaattatggacttaacatttaaacacttaattatggacttaacatttaataattgattttatttataaattgtgacgataagctagcacaaagatggctttatactgccatcctttttttgtggaagttcattcgtttaattcaaaaaaaaagtggtgtaaaatgcagcgtccaacggtttgtatttactccgtttgaattgcttgtggcaaaaaatacaatagacagtggaccaaaccaaatggttggttctggtcggcagcattcggcgaaggtgaaaggatacgagcatactgatttgttataattatttaaattattcatattttaaataacatttattttaaggtgatatctcaatttaataaattcatttgaaagtctatgcaaaccgagatgattgtggatgaaaaacttcaaaattttagtaaagcaaaaagtcatgatccattttttatgaacaaaaagcatggccaattttatgtctactttctttagtttttttttgagattttaaattgattaagtgaaatagtgatatacaaaagaataaattcacagggtttcatcggtcaatgacacaaatgcatcttctccaaagtaaaaagactatttcagatttaa

SEQ ID NO: 27804 - DNA, 769 bp, Heterodera glycines
  misc_feature (6)..(6): n is a, c, g, or t
  misc_feature (29)..(30): n is a, c, g, or t
  misc_feature (392)..(392): n is a, c, g, or t
aaaacncacttcgccacacatgcaaatcnntttttggaactgccgaggccaaaattgaaacggtgtgtataacgatgggtcaaactaagtgttagacaaaatgatttataatgccaaatagcgtaattctgggtgctaatcaaaaaacatactgatcagtgatcaatgcctttttcgcattggttgttttgagcattcataactcgcaacatcttccagctaaacaaaacaaatttttatctaattttttgaaaagaagtgagtgctaaacacaccgtttcagtttctgtctcccagttccaaagagatttgactttttgtcttagtggtctagtatgtgttagtcaccaaaaggggcgtcccaggttcgaatccgatgcatgttaacgacngggccaggacgttttcgcgtggccattttcgcgtggccgttttcgcgtggccgttttcgcgagcggcacgttttcgcgtggctgttatcttgcgggtactactgtaaaatcatcgattacacttggaaataaatgctagaggaccgtaatatcgccttcaataccctttgatagtttctttggacgacgcataatagaaagtgatatcataataattgacgaaatgacaatgttgaagcgcacagtttttgaaaatattgatttagtctgccgacaattgtgcactcaaaaacagcatttacctttcggtggaaaatgtgttataatttctgttgattgaaaacaagtcactttccatatgtaataggttcttatgg

SEQ ID NO: 27805 - DNA, 854 bp, Heterodera glycines
cgatccacaaaaaatctcagtgtgggcgatccacaaaaaaactcagtgaataattaaataatttggtgctaggtcgatccacaaaaaaactcagtgtgggcgatccacaaaaaactcagtgtgggcgatccacaaaaaatctcagtgtgggcgatccacaaaaaatctcagggtgggcgatccacaaaaaatctcagtgtgggcgatccacaaaaaatctcagtgtgggcgatccacaaaaaatctcagtgaataattaaataatttgatgttgagcggatcttccgcaaatgtaaacgggccgaacttgccacgaagtgtcctttgcttgtcttttctcactatttgagtgccataactcgaatatcttagatccagaccaaagttatgaagcgccgcgaacacatgacgtactacgtggactacttccaccggaagaacatgaagggatggcgcgcctaagataaagactcaattgttttgtaaaatcttagttggatttcagctgaagcttttcaaatggcataaaattgatacaaaatcacaaaagtaaaaaaaaaaagaatcagtcaatcttcatcttgtcagtcataatacctttcgcgcaagagacagttgccagcaaatgtgtgccctcgggcatttttcaattgcatttgaatcacccaccgacactcaatgttcaccacgcacaaacaccaataaatatttgcgtcgctaatgccaaaatataaaaatttgaaatttttcttcgaaaaaaggggcggtaccatcggtggtattacttttgcctaattgcttctaatgatacatttcaccgaacaagagaacatatccaaaatttccagtttttt

SEQ ID NO: 27806 - DNA, 183 bp, Heterodera glycines
cggtgtcatctatgttactagatcgaggatcgatccccgagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgttattata

SEQ ID NO: 27807 - DNA, 1665 bp, Heterodera glycines
tttcggcatttcttcggcattttctgcgtttcttcagcactttccgcattttctcgggcgtcaatacttttcgtcatttcttcggcacttttcagcgggctttcttcggcacttttgggcatttcttcgtcttttgatggcagagtgttgattgatggcacttttggcaatacgccctcacttatatcggattgggtttcctcggcacttttttgcattgcatcgtcagttttcggcatttcttcagctatcgatggtatcgcattcagtgagggcaattttgtcggtgtatcctgtggaatttcttcagtgttttctgttctttccatagaaatttctttggcattatcatcccctaggctgttctttttaagcatttttgccatattttccgatgattcccgtgacattcgccttaattctgtctctgcactgaaaaattcatcgtccattgagtccgaaacatcgcgaaacgttgaatttggcgttaaaaaattcgggctttgaattttatcccgatcatttgcatttagcttaatatgaaaattaattaaaatttaatttgtttttactttttacctcattttcttggttttcattcttttggccgggctcttcccggctttcttggactgttttatcattttttgccgtaatttctggctttgctgacaatttttcctgttcttcattaaatattttttcaacgcttgctggcactgcatttattggtggtatttttggcatttcgtcagcgtgtccatgcatgttaaggggcagtgaccgcattttctgcaaaacatcctttggcacttcgtcagtgtttgcgggcatgtctttgggcaaagatttcactttttgcaaggagccattcggcatttcgctgaagttgggcgggagttttccggcacttttcggcatttcttcggcacttttcggcgtttcttcggtactttttagcgggctttcttcggtactttttagtgggctttcttcggtactttttagtgggctttcttcgacttcttcggcacttttccgcatttcttcggtactttttagcgggctttcttcggtactttttagtgggctttcttcgacttcttcggcacttttccgcatttcttcgtcgtgtggtggcagagcgtttattgatggcacttttggcaatgcatgttttggcatttcttcaatgttccctggcatgttgacgggcagtgaccgcattttctgcaaaacatcctttggcatttctccaatgcttgctgacatgtctttgggtaaagatttcattttttgcaaagagcctttcggcatttcgctgaagctgagcgggagttctccggtacttttcagcgggctttcttcggcacttttccgcatatctccttcgcttttcggcatttcttcggcatttttctgcgtttcttcagcacttttccgcatttcttcggcatttttctgcgtttcttcagcacttttccgcatatctccttcgcttttcggcatttcttcggcatttttctgcgtttcttcagcacttttccgcatttcttcggcgtcaatacttttcgtcatttcttcggcacttttcagcgggctttcttcggcacttttgggcatttcttcgtcctttgatggcagagtgttgattgatggcacttt

SEQ ID NO: 27808 - DNA, 1019 bp, Heterodera glycines
attaccccgtgaatgcgtgataaaattattgcttgtagcaaatcacattaattcacgcttattattagaacaataaaaaattttattttttggaaaaagtaggtccaaaataaggccggattcgtgctcagcatccgaaaataaccccagaaaaattttccgattaagtttattttagagttactaaactccaaaatgtcaatttcgaacaattcaataaatgatggagatgatttgacgccagcagaaaatgagggtaaatgtttagaaaagggaaaattgtagaaaaattgaaaaattgaaatttagaatgtgaaattaaataaataaaattcaacatttaattactgtatttattgaattagagcccccaggggctctattgttcagccccctcaaaaaggggccttgattttaggagggctctaactcagagggtggctataattcagggggggggggctctaattcagtaaattcggtttaatattttcagaagtgaatggcgatgcaattagtttggacaacgatggtcaattcgatgggaaaaacagcaaattgtcactgatcgacaacagcttaaggtgaggggaaggaaaagttgaaacaatttggagaaatatttgaatttaatggaacaaaagtacttttgttgtaatttaaattcaggaatttcgtgaaaagattgccaaaatggaaatggaattgaaaatggccaaattggaactcgaaaatgtgagagttttgccataaaatttggaaaaagaacaaaagttaaaacagcagcaggaactgatgggcgaacagaaggaatttgaggaaaaaactgaattggagaaacagcaacacgaaactacgaccaaaggcgaggaagttttaagcgaataataaattaattattaaagaaattatttatgagttgaaaataatttaattcattaaatgtccatttaaattcgaaaaaaagtagttttaactactttaaggacagtaaacagttctaaaaatagcatatctac

SEQ ID NO: 27809 - DNA, 1266 bp, Heterodera glycines
ttcatcctgaccgattgtccattactgacagatagccctctgacggattgtccgcagcctttcaaaacacataaaatgctaccaacgcagcacatctggcaacaactggagattttgtatagaatagatacaatataattattttataatcacttcttttttaattattgataattaaattttaaaaaatgcatattttttggattttgttttcggatttccttatggaattgattttttattcatatttctaaaaattaagttatttttagatatttgacggttttctttcaaaaatttttaaacattgattaatgcataggccgactaagaattaattaacacgaatttagcagccagggagaacaaaatatttgtgcataattgacattggaatttatttagtcaaaaaaatctagattttttttgccacagaattaatttagtgttttaaatatatatttatggagcagaattttttttaactacatatacatagtattttacatgttaaattttgctcaaattttgcccaatttttttctaatttaaaatttattaatatttacaaatttattaaaaacccgaaaaattattttaatttttgacagaaatcttagcttccttttttgctattttaaaaaacttactaccccttaataatctttttaattaattagatgatccaatttattataagagtaaaaagtcattaaaaaagttcagatttaatataccattagatatgacgaaattttatgccattgtcctaattggtttttgtgtttttgttcacaattttttggatggtcaaattaatcataaagaaagcaacaaaacgcccgaatttatgtcgaacgtatgctgaaaataaattaaaaaatcggtttacctcagttggaccgtcacgtttgggccccagcacgtttttggctataatttttttttatcatctttgtatcattcgaaagcttagcatgtttagaagctatttgtaagatattgcttcgcgattagacaatttccaaaaaagttataacatgaaattgcaaaaaagcccaaatttttgaactttttccttaataaaatttttatatgctagaaaatcttttcgctttttgtaaagccaatagagagcatgtaaagagctttcgaatgataccaagattgttagatttggatgaccaaagaaaaaagtatacccaaaacgtggtggggcccaaccctggcggcccaactgggcgagtccaaaaattgttttttttt

SEQ ID NO: 27810 - DNA, 934 bp, Heterodera glycines
aattatttggcctcgagttcctcttggccaatgctgatccctacaattagcagtgatcgagagtctcggacaattctttgatcgagagtctcggacaattctttggcctcgagttcctcttggccaatgctgatcacttcaattagcagtgatcgagagtctcggacaattctttggcctcgagttcctcttggccaatgctgatcacttcaattagcagtcatcgagagtctcggacaattctttgatcgagagtctcggaaaattctttggcctcgagttcctcttggctaatgctgatcacttcaattagcagtgatcgagagtctcggacaattctttgatcgagagtctcggacaattctttggcctcgagttcctcttggccaatgctgatcacttcaattagcagtgatcaagagtctgggaaaattctttggcctcgagttcctcttggccaatgctgatcacttcaattagcagtgatcgagagtctcggacaattctttggcctcaagttcctcttggccaatgctgatcacttcaattagcagtgatcgagagtctcggacaattctttggcctcgagttcctcttggccaatgctgatcacttcaattagaagtgatcgagagtctcggacaattctttggcctcgagttcctcttggccaatgctgatccctacaattagccgaaattttcagaaaattctttggcctcgagttcccctgggccaatgctgatcacttcaattagaagtgatcgagagtctcggacaattctttgatcgagagtctcggacaattctttggcctcaagttcctcttggccaatgctgatcacttcaattagcagtgatcgagagtctcggacaattctttggcctcgagttcctcttggccaatgctgatcacttcaattagcagtgatcg

SEQ ID NO: 27811 - DNA, 1479 bp, Heterodera glycines
gtcccagttcgagtttttctctagatttccggacagtctgttactcaaataatcgaattcttaatttcgtttttgtacataaaaaaattcggcacttatgtattatctgtgtgccagattagaaaaaatttttttttgagaataaacttattataggttatttttcggtccgcgccccatcccctggttagacgatgaaaatattttccaaaaatttcacttttaaggtgaccaatgtacagtttgtacaatggaatttcgtacaatttttttaaatttctaataaatatagaattcttttcacaaaaatcaaaattatttttttctgtagaaagttttctgcaaatttcaaatgctccaaattttttaataaattttttaagtttttctaaaatcattccatttttcaagagacaaattcgaagttttaattgaaaaaattgtacgaaactctattgtatgaactgacatggcactgctataggatctgcctaagaaaaatttattttatttaaaaatgaaatttatatgaaaattattcagcggagctgaaatatttttcttggtatggaccaatttttctaagaaattgtagaataaaacccacattttacttttacctattttagtacatattttggaattttggcacccaatttttttaaaaactccaaccaaatttccaatctgtattagccaatctcccttttgattgatcaggaaatgatcaaacacaatggacacacgaagctgtgcccattttttgcggaagagcacaaaacaaattgcttcaaaaagcaattcattagggagacgaaaatttatttgcattttaaggaaaaatgatttcatttgttttctaaagcaattaatatgatgtaactggataatttggagataattaagttggttgttcctcatcaatctcttatctttgagcacaaacgtgatgggaaaatgtgcacaaaatatcgtaaaatatattttatattcaaaaagggataaaaaaaatttggattgttctaaattaaatttaaaaattacaggacgaattctaattcatatttctacaagctattttgtacttgcctatacatcgttaaaactcgagacctacgaaatgattttttcagtttacaaaaaatagcttcccgaatatttttatagttttattaaatttaccaaattcaaaaaaattcccttttgaattttttttgtccgataaattgtgaaagtcgtaaatgctggatgtcagtcttaagattggtaaattatcatagtgattgatgtttgagagtttcaatcgggagtttcgattcaaaaaactcgggtttctcaattcttcaagtcctttaaggtttctagactcgaaaattttcatccgacagctgactgacgtctcataaaaatggggtttcgaattaaattaaggacttttttcggacatttgcgccccagtgaaaatcggacacttgcgcc

SEQ ID NO: 27812 - DNA, 1993 bp, Heterodera glycines
cccaaactgggctttttaaatatgggaacctggtaaatcttcttatttagtcaattcttcagccgtttaacgtagggttagactcgcattagtttccgctcggattgagactcgaatacccggcttatacggaaccgaaatatcgagaaagtccaattttatttaagggcataaaaatgatataaaataatatattttgacatcgatccataaagaattgtaatgagtccaggaaaattaaccttttaattgagtgtataattcgcttaaaattttaaatctaatttgattaaaatttttgctttgagattagaggtattttttatatatatttaaatttttttaaatgctaaatattctgcagaatctttccggtgtccaaatttctgttgcccctcgaacaccaagaaatttgacatttattcttggaaatgagctgttttttcttgaaaaacaaaacgcatataaactattttaactattaaaattctttctctatttattaattctcagaaaactcatcaacagttgacgtcggcgaactaattaatttggaaaaagaattggcaaattttgagcaaaatattctccaattttataaattgggtaattacataaattgaccacttattctaattacggttttgtctaaaaaaaatccttcgaaaaatgaataaatggtcgaaagaataatggaattttatgtcaaaacccccaggcacggtaatggctgcaaatttagtaccgtacccgcacatccatgcctggggaaagccgatacatacaattgaaatggtattcaaccggcgaattgcactcccggcacaccgtgccattggcttctgtaaacatctgagtaagggcaccgatcagtttggacttaaaggcaacagcgaaaaacagctggacgaaatgcccaaaattcgaggaataattttgggacttcgtgaagagttcaacacttttgtcatcgaaattatgttgacaagaattgaaaatgaaaagggtgccaatgaaaatgggacgaataaatcgttggaaaaaatgaacgaaattctgaaatttttggaagagaaaaatggcagcgcattttgtgatcagtcaatcatcgaaagtgcgaaacgaaattcgacaatcggaggcgaaaaacataatacatttttgatcgaataattttaaaaataactgatttgaaagcagtttcgcaaaatgtctgatttttgccccaaaaatgtgttctgattttgaaaaattgtcgatccgagccctggttttacacgacttttaaaatttaatttttttcgaaaatggggggaaaaggtaaaaaaattcagggggatgacaaaaaggataaatgttgacacgttaataggggacgaatgcttaaacgacagaaaacttcatgccatccaaatgtctacgtcaaacagagagaaagagggagaggatcaaatttcagttaataaattaacacgcgcttaatgaccatcaattcaatttatttcggaacacagatggaattaaagtgataatacacagcaaatgatatatgcatacaaatgtacaatacatcaataaatacagatcacgattatgagacatcttctttatctttgcatcttctgacaggtcgctcgctcttcaggtttcgtccatccatccgccggtcgttgttgcatcttctcacatgtaggcgctctgttccgggacttctcatgctgcaaaaacaaaagattagtgatgcttttgctctcgtgtcccccttaaaccaaccgctggtggctcgtgcgcgggcgaggctcccatgtaggcgctcgcgactcctgacgatggagaggtttccgcggcgccggacgacggtgcaggctcggcggggccggatcccatgtaggcgctcatgatgaagtgatgagttgtcgcgacgaaatgtgtagacgagcttggcgcgcactggtgttgatgttgcgttgagttgaaggctggctggcactgg

SEQ ID NO: 27813 - DNA, 726 bp, Heterodera glycines
ttttaaacagaattaaatttaaaaaataaacatttactatttttaattgatttcattttcatgaaatttcaaaaatcttactttttcctatttgttaaaaaaagttttctcaagaattagactaggttgccgaaaatttttttgcattttcgatgccgttttgtcccgtcgacgttttggggtgggttgtacaccgtcccgcccactttccgccgaattttttttttcttcgtaagatccgattaatctttttgccttacatctcgctttatggtgttgtcattcaatatcaacaaaagttcctccaacttttcatcattttcatctgtatggtgcttacaattagctgctttatcaattcttgaagaagaaggagaatcattttgtagtgataaaataaatgcaaaacggatcatatcattatcaatcgatgtttctaaaaagaggaatgaattttggctttttagaaaaatataaaatataaaaaatatcctaaatatttaaataggctaatccttaaccaagaaaaaggtgattaaataatgttttttggtatatattgaacaaaaaattggtttttttagaaaaaagattcaaaaaaaatttccgaaatgtccgactttttatcaaaaatttcggaaatcggaattctgacatcaaaaattttttcagaaatcggaattccggccccaaaaatgtcggaaatcggaattcctgccatccctg

SEQ ID NO: 27814 - DNA, 894 bp, Heterodera glycines
tgaagatcgtcttagtgaggcgttttctaacgcaaacttcatagatggtattccgtcggaaatggtggccaattttgctccattgaacctccgctaaaaacagtgactttgccggggaacgcctatttttgttgcaaagtgagaaattaaattgtcttttttatatttttttaaatattttttcgtattttgcttgcttattcgtattttaattttgttattattatttttttcttttttttggcttttcgtttggagatttgtggtgggggaacggaagcgatgagttagcatgcactgaattaattcccccgctttttccccttacccagtcatctcgctcccttgcataatataccaaatacgtcatcatcataatttttccatttccccatcctttaaaaacatccagttggttggttatgttgtttgctttttttcatccttctccccttccatttttcaggtcgctttgcccgtggttttctcccccgcccggccaatggacgacgatggtgtcgacaccttttgctccacctatatcggccaaaactgtggacccgtactgttttcaattgaagaggcagggttggatcggaacaactgctacgaagcgtttgtctctctgtagacggaccatttgagtctcggatttcactcctttttcttttaggacctctttcaacgcacctccgttagaagatacaaatccaacatcatcatcaccagtgaggaacggctgtagatgggcactcgtgaaaaagtcggacatttgcggcctttggaatggcgatggagtcgcttcgccagtgacgccgctaaaaatgcaactgagtcccaccaccactggcagttttttgcttctgtcaacaccgtcgaccacagtgaattgat

SEQ ID NO: 27815 - DNA, 1334 bp, Heterodera glycines
  misc_feature (1192)..(1192): n is a, c, g, or t
aaacggacggacagtgcgaaaaggtcggcctccttgcgcttcagactcgtctccatgtcctgccgctgcttgcccatctcgtccaaattctcgcgtgcaatgcgcacttcgccctcgaacttgcggcgcgctttctcctgctcggcacgtgcacgacgctcgcggtccatttcattttcaaccgactttaaaacaaaagaaaataatatatctgtactttttgacaatttgttttattgaaattaaggcacggcgtgccgttgaaagaatttgaaactttggccacctccaaagtttgttgcagtttctgtcggtgcgctttctccgccgcgtttcgctccgcctccatttgcaagtcgttctgcagtttggctgcaagttcctgctgctgtttgcgctccttggccagtttggactcggtcagttcctgcttgtgcagttcatcggccagtgtccgtaacttaaaaaattgtcaattcgtttgctaattttgccaattcattagttaatggtcgattagattgctaattatcgccaattgattaattaattttcaattcgtttgtctaattattgctaattaattaattaattgctcttttccgttacctggttgtccttggcctgcttctccgcctccaatttgcgcatgccaacgtccatgtcggtgatgtttttccgcaacgactcgcactccgcttcggtgcgtttccgctccttttgcaattcaatcgcacgcgactcttcgttggcaagacgcgaattcacttccaccgactcattctcaagcgcttgctgaaaccgaagagaaattaatttatccaaaattttcaaattttctataaaaatgaatttgaattaattagagggttacagtagccaaagtcaatgttgtgcgtacggtatacaacgttgtcatatgtcgtacggtatgcaatgttttaccattgctttcatttgcgagctaatccatcagttctaagcaagttttgtacctttttgaagcggattatttccaactgtgacttcatctcttcataccaatcaaatgctcttttcaagtgcatcatttgaatgtcggaagccattttttattttagaatgatcggaaacgacataaaatttgaatgatcactaaaattagctgatcagcagaatgagtgatcaatgggcgaatgatttgcgggggggnggggggggaagcgatgcttttgattgttcgattggccatgtgaatggccacacaaaagcagcaattagtcatatgaaggaaggaaaaacacgaaaagggtaaatattggatcgaatttcatttaaatgagtgatcgagtgag

SEQ ID NO: 27816 - DNA, 1153 bp, Heterodera glycines
ttaaaaataacaaaagagaaaaaacgcattaaaaattaaataaccttttaaagctataataataatagtgattaagacagacaaaaacgaattaaagaaatttttgccaaatcctggccattaatcctaacccatgaatgatacaaagaaaagctaaaagggtcaattaaataaaataaacgtcatccataaaaaggacaaactacgccatttattggacggacattcgtccaaaatcatagttaccttatggattggatgctcgagtttgactattttaatatgcgtctttaacgcacataaacttatgaaaataaatgtaattaaaaataatagtttaggggaaagatgattagaataatccaagagatgaaacaaattaatccgttctcttagttcaaaaatttttataaaaatcacattgtgcatttaattacccacgtttaggcaaatgttgcttattcatggattgataaaactcgttaaagaattaccaattaattttaaataaaaattttaaaattacaataaaaaaaataaaattaaactatactatacttttagaaagaatggatgaaaacattgatacagcgaaattgtaaattttaataaattgtcaagaactcggagtacaaatccagcagtagcatggcattctgccattaaaagtttattattaaaatcaaactcggaaataaataaagcgaataaatttaaatgtaacgtagaatattccaacaaaaattgtttatcgtataacttgcaaagaaaaaagattcattcttatcctttgtatactaataagatgtcagtaaaacaaaaaataaaataatgttactttttttaccaatcaatgcgttttaataatctacaaattataataaatcaaaaaatattttaaaaaatacaaaaaggaaaagcaagttaagccataaaaacaataaaaaattaaacaataaatttaatatgaaaaccaaataaaaaaataacaataaaaggtctataaatcatgtatattctttacttggcaaaaatgaacccaatgtatgagctctttaaagatagatatacacccagcattaacggctgctaaaaacaattgttaaatatttcatatttaatgtaattaattttaatagttttcatcggatat

SEQ ID NO: 27817 - DNA, 1071 bp, Heterodera glycines
gctggtcgctgtgagtgggaggtggagcgttttgctgctgcctaggatttggctggccaggcggcatattaagatcatcatcaccaaagaaagcttcttcaactgccaaattgatatttttggcttttgaatttggtggatctgggaggccacagtgcatgcagcttgagtttatatacgttatattgacaaggagtttcgtttcaaaaactaatttgagcttaacggctaatgggacgggtctgaaagtagtggaagggtcttacaactttttgaggagaattcgggaaaactatagaaaaaaattctcgacgcccaactgagtcccgaggagcgatttctcactttttcgtgcgtttgacggcccataactttttttctgaaactcggatcaaaaaattcccgctgtgagggcactccgcagaagtgtcctctataatccggtattttttattttttaatcagaccaaatcccggacctgtacagacacggagactcagttaatttttttttcccacttcagtaccaggctaataactcattaggctttgacctgagcgcagggtggccagcagacttattgtagagctttaaaagcccgatttttccaaattttaaaatttcgaaaattttcaaaatttttcgagctaggcctaaaaaacggttttcgggtttttgaattttaggattttttaacgaattttcccagaaaaacgaagaccacttccaaaacatagttttttgagctctatcgattggtaatttttttggaaaattttcgatttttttccagaaatagaaaaaatttttggcctcagcgggacatttgagtcctgggcccataactcgtcaggggttgattttagcgaaaaattgacttaggacatttttgtagagcattttaaatgctatcgaatggtgtactacatgatgtaaaattttcaaaaattttcgagctaggccccctagaaattttcaaaaaattttttggggtcgaaaaagggtgtgaaaaatatttttctgggctattttgaggtgttgaaaaaaaatataatgtttattttaagttt

SEQ ID NO: 27818 - DNA, 1077 bp, Heterodera glycines
ttttgatttgttgcccatttactggaagagataccgcagtgattgtccctctctcttttctctcttcactctctctctcacttttctcagtcttttttccctttccaactctaattgtttctactctttatctttctacactctctctctgtttccctaattactctctcattaatccccactctctctctctccccctttcctttctctcatccgtctccatcagttgtgccatcttttcatatgcctaaatgaagccgggcgattacttcgagattccgatctccaacagcttaaacaaaacatttctctccctcaaaaaggtgtcgccttgaggtacaattgatcggctcagaccgatttgggcgtggcgagcgactgattggccaagtgcactttggctcgaccgcctccggcggcggcactggcgcatcctccgcgtccgcgcggatgtcaaccgcggcgcggctatggcgagacgcaattgaacgccagtggagcgtgccgcgttgggtcatgctggaggctccgttggatattgccgcgggaggcggcgccattttggagtgaatttttcgggggtatttgatcagcgatcaacggcaaattccctttgattctcccgccggtggatatacatgcaatcatcttcattggataaataattttttaaatccatttcattaatggaagctcctaaaaattaaaatttgtttttaaacttaaaattcgaatattccaaaaaataatgaaattaaaattttgaacaaatctattaaatttaaaaatattctattgtcgtgcacaagagcatttttcgcgggtaattggaaacccttagctatacgagatttgaattttgaagttgcgggtcaatctgataaatgtcaaaatcaagggcttgcaatttataaagctcaagaagcgaaaagctgggaaaaacttatgaaatattttcacaatttttactggatctgaatgcttctgaatccgataactttgttcggcaacggattttgcggaattggcaaaggcttcccatcggatttgacaatttgcattcgcttggtgccattt

SEQ ID NO: 27819 - DNA, 596 bp, Heterodera glycines
ataccgtatttcttcgattatacccccccccccctcgattagaacccccctctcggataaagccccccttttgaggtggttgtactatagagccccggatggctataatccaagcaatacggtactctttttagtgatttacctgccccccctcccatttcagtacctttgtctgtttcgtcatcgctgttcgcccttacacgaccgaattgtcaccgattcaatgtccatttatttgtacaggtgtgtaaacaactattttttgcatatatttccgacttttatccttccttttcagactctccctcctctctctgttctctgtttcgtatgtttcgttcattttttggcaacttttcggtgggccacgcagccccgaggacatttgcgactgggagcgcctgtggggcttcttccactgtctttgggtttgggtccgtctgacgctgttggccatcggatgggcttggattgctatgcaatatttcatcggcgccctctgttgtcgcgtcgcgttgaatttcgtcaaaaatcgctaccggtgagcagagagtgaactggaaacagttcaattacctttttttaattttgtcttt

SEQ ID NO: 27820 - DNA, 1773 bp, Heterodera glycines
tggttgtcacttcgtttcgcaacgactgcgtgttccttctagagccgatggcaatcgaacaacgattcgccgatcactctcgactccgccacaggcattcgttctcccgcccacaatttttcatcctcaacgtcacggacaaactgaaccaaatgagaggaaggggtaattaatcaattagttaattaattggtctcccctaattatttctgccaattaattaatagggtcgcctcccctccgaattgtacctgaaacgcggcctttttccgctccaattggcgccttcggtcgtccagcggtgccctcagccgttgcaattgttcggtgatcgctattcgatgtgctttgatctgctccaactgttccggctgcatctcctccaacttaggctccatgtcctgcaacgactccaagtgcatcactttgcgtaccatctgaaaaacaattccgttgagtgccattcttttggcatttcgtcgtgccaatgccctccctctcacttcctgctccaactgttgctgccgttgcatggccaagtcgacggtggtcaaatcttgcggctccgagggcggctcgccgatctgtcgctcgatttgctgggcccagtctttgacctgtcacaaaatgccaatggtttgatgtgcacggcacttcgtgccaacttctccgatggattgcacatagagctgttgtcggttggtgtcgaacaatcgctgtcccttttcctccgtcgtccgttccaattgttcccactgctgcgacagttgcagcacttccgggtcgatcatctcgtggaattcgggcttttcctccgcgagttgttccgccgcgtggtgaatctgaacaacaaaccgtgggaattggcacttttatcctccctcccccgggggcttttggctttgcctcttcgaggcgccgtttgttggccgccaattccgcttggaatgcttggtgacgcatgaacttcgaagagatcgtcttcgcgtctctgtacgtctcgtcctgagcccggatcattttctcctcttaatttgaataattttcaggaaagtgtcacccgccacgcaatttcttgcattaccgcactcgtctcgacgttccattttcctaccccgcgtccctctccgcttcttccccactcgcgccccctccatcgcttcccccactcgctctcccccccgcttcatccttcatgttcaccccgccgcaccctctccgcttccccccccgcccgtctctccccctttgctccccaattcgttctcacctatccactcgcgtaactcctcgcagtcgctgaggaactgctggacttggaccgcctcgcggagtttgtccagcatcgcctgcgccttctcgcggttggctgctcgtctctcctcaatgtttcgcgcctttttgtgcactttgtccgctgcgtaatgtccgtccgcgcacaactggtcgcccatttgcaccaccgcgcgcattttctcgtcgttggcatccatcgtcgtcatgaagtcctggtgccgcttcagcacattctccgcctgctccaatgagacgggctgttcttcgcgtgccatctgagatttgtttcatggcaatcactgctttacggcaattgaccaacggtttgatcaatctttgatcgatcgatcacaccaaaaaatcaatcgataaaattccaatcgccgcactgactttattttcctgcagagaaaggatcacttccgcttgtttagcgcgtgtacagaggagaggaaggctgaggccctggctgaggaa

SEQ ID NO: 27821 - DNA, 1144 bp, Heterodera glycines
tttgacaatgttccatttttggcaaatttatttgtaatattgatcaatgatcattttcattaatatctcctgacatttgtcttttttcacgctttcttttgtgttttaaactggcgatgccttcgctcactcagaattaaattctctactaatttccattcataatccggaaaaacggtcaaaaattataatggaactaataaatgaatacgaataaacggcaattaaagagagaggagtattaatggtttaaacatcggttgctaaagtgactgcaagaaacgagctaaataaacagagaaagagacagagagagagcgagagagagagagcgagagagagcgagagagagagaggggggggggaggggagacttctgtttagtattgtataataaacaataattattcttgcataaatgacaaagcttggtgtgggcgggaaggaattggtgtgtttggaagaaaatttatttgcaccattttattaattaatatttgtttaatatcattgtggacacgcaaagaaatgcatttgcataaacattgaaaattcattgattttcaatacaatattttatatacatatacgaatataaattgtgcttttcatgccagaaatataattatagtaataaaataaaaattatataatattattaatttatttcatttcgacctacaaattttgataaaaattattttgattcgcttaaacaatgattatttcaaagttattgcttttgttattgagtgaagttttttatttgattccgctgggctcatctgatcgctctgacaaaacaaaacaaatgcatattgatcacccaaacaaatcggaatcaatgggctcatctgatcactctgacagaacaaaacaaatgcatattgatcatccaaacaaatccgtatctatgaattcatctgatcactctgataaattaaaacaaatgcatattgatcatccgaataaaaccgaatcaatggactcatctgatcactctgataaattaaaacaaatgcatcttgatcacccaaacaaatccgaatcaatgggctcatctgatcactctgacagaacacaaaacaaatgcatattgatcaccaaacaaatccgatcaatgggctctctgatactctgataa

SEQ ID NO: 27822 - DNA, 888 bp, Heterodera glycines
aataaatatgtttgtattacccatgtttttacctgcccacacaggtctatgcgcatacgcatataatttataattgtacatagcctagcaatatatatataagtaggcttgatgtcatcaaggaatgtataatattggcggtattctttcactttttacatatttaaaataaataaaaaaaagaaaaaagaatgaataaaataaatattttacatattaatgcataaaataaatattttttaggtgctgttttgttgttaagctaggtttcttatttttcgtttttttcattcccgaacctaaaaaaactaaaaacataaaaaaaaaactcaagtttcgtttaaacaaaaaatattaattaaaatttattttaacttttttagcctaaactgaccaattttttcttctcatttcctgcatacatatttgattttgtcttatttcgatgcatggccaaactattaataattattccacctttttttattaaaattaaataatatattttattaaaattcagattaaaaatatattaaatgtttctaatcattttaattgccattttttcattttaaaataatttaatgagtgcgtcgccgaacaatggtccagaaggccaaaaagtggggcaagacaataaagaaataattaagattctccctaatgaggatcctcagagaaatttgatcaaattaaattccatttttgcactacaaatttcaaaaaaattgtgacaaaaaaagttttacaaaataaaattgtgccaattttggcggatttaccgtacgcatttttcttacacataaattaggaaacacaagaacaacaacatggtacagcagcaccagctgcagcagttggaggcgaaaagcccgagtttaaatcgaa

SEQ ID NO: 27823 - DNA, 1592 bp, Heterodera glycines
  misc_feature (1575)..(1575): n is a, c, g, or t
cttattttagttgatttttggcaaaaactcgaaaaacagaaaaaatgaagtaaaacgataattttcgaatattttacaaaaaaaaaacaaatatttttaaaaagaactaatattgcaattcctgattttgattacttttatcatttaaggataatttattttattttgttcaaaattcgaatttgaagtagctattcataagcacatttaatttttatgcatttgactcatttcattcaaaaggacaaatcttaaaaatggacagatgcttgaaaatgcccttctttttcaaaatttaattttatttaaattaaaatattaagaaaatgccctccatcatttccaaatcttcaattttgctgctttacccattgcttctcaccacgatggtgttcatttccacttcaacttcgtttcccctgctggtcacctacaatttcaatcaaccaatccaactgctcaaacttctcaaaattgacccgagggtaagcaaaatcataaataattttaattttctgaattcccgtaattaggttttagtaagcataaacaaaaaaatttttgcaagaaatatttgattaaaaataggattttttattcttgccgttttccgtaattacctttttagacaatttaaccttttttcgtaatgagataaaattcaacaaattgttaacatgtactaactcgaatatcactaaattttcagttataacttggaatctagatctaattatattcaataaatataatcattttaatttagcgacagttggtcttggcccgcttgtccgattttgggctgaaacgccatgcgccagccgagtcgccaaaatgataactctgccggaggtgcattattgaaattggaaaatatcaaaaaatttcccaaaaatccaaaatccatattaaaggatttttaaaaatttgagcctttttcaaaacacagccctggtccaaaaaattaggcttcttataatttagtaaaaatttggaaaatataatttttcatcccaattctccgaaggttgacctcgctgggctccttcatttaaattctacattaaacatgggaatataaaaataggaaatttcggcaaaattttaatttgttttttttcttaaagcatccatcgtttgaacccgcgaatgccaaaagtgggcgaaaccttttatgcgcttcgagcgcaatacatatgattgacttttattccatgtttttccatcgtgcaaaatatattttagaaacaaaaattcattaagaatgtgtgatgattcattttttgatgagtaattaattaattgcttttttctaaatgttattgctttattattccttcgccttttgagcttcactggtcgacggcaaaagatccgccgaattttgtttgctcgactccaaacttttgccgttcccatcatctaaagagtggaaacaattaactaattgctcaaatttgagtatacattaagtcccacaaatttttaaacatacgtaaaaatttaaatttttaaaaatttcgaagagcttttaagaaaaattccattctttatttaaatagtttgttgagaganaattcattttgttgtaa

SEQ ID NO: 27824 - DNA, 1024 bp, Heterodera glycines
aacgaaagactcagattttcgaaaatttttttgagccagctatctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccctcccacgcccttcagagcacgacaaatatttcaacaaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtcttttttccc

SEQ ID NO: 27825 - DNA, 1596 bp, Heterodera glycines
caaatggcgctgcgcaaatgtctcatcaagttgctatagtaggttcttatatatccatggaatctttaaactaaaataagcacctcgcctatttataaactaattaaaccaaataataaaagaaaaaataagataattaataaagaaaaaaaattcctgtttattaaaaaatggaatataacaaaagttactggctcaaactataaaataacaaaaaaatttttaaaacaaataatttaattaaagaaataaaaacaaaaatgttatggaacaatctttaaccaaatacgaataaattgaggtaaaataaataaaatatattgtaaagctttagcgctctaacatggaaaaatttgacaatataatttaattttatctcacaacactcagaatatatttaaacccatttatgtcaacaaaaagctttctgtggaaagttaaaaataattaaatattctatcgaaattaatgtgacatcatgaccaaagcagcatgtaccttatatactgtaatgctactcgaacgagatttcaatcaaccttaataataaaatagattaatattttaaaaataaaaaaaatatttcccaaagattttcaataaaaaatttcaaatgtttattaatcatttaattttctatagggatcggatttatttaatgattttaactgatattagtactgtgctattactctatttatggagacgcacattttcgctaaaacaatataaaaagtagattaagtttcttttataatttatgtttaaaaattcgtatttgaatttttatgttttttggtctttatcgaaaatgagaaaagaaatttttattcgatatttttgtatatgtatccctgtaaatctgtcaaggaataagtaaataatattaattaaatattaatattttgggataaagagataaaattataaagataaaaaaatttacaattaattctcttttaaattgaaaaaacttttatattcatattttaaacaaaagaatgttggaaataaatttacaacaataaatcttcacatgtattttaaaataagtgaatcaaaaaatctctaaacgcaacatcgcaatgttggaaaattttattatcaataatgttcgtctttgtagcatggataagttataaatatgtcagataaatgttatcttattatggacaaaatgaatcagaataaaataagtttaaaatctaaaaacatctctttataaggcaaactttaaaattatttgtaaaattgaaacaatccaaaacgtaaatagaaatattatttatatttaaaaatatacatttttgtgatcttatatcaaattaaacaaaaaataatttattttatttcgaaaaaaaattttaattcacatttctcaattttgcacatcaaaagtcgatttattgtaaagtcacacctttgccacagatggattgaactgctgatgaatcgcaagcctcgacaagaaaaattggagggatttaaaaaagttaatgagtgaaaataagtttaattagataataaatttacatgcaaaattttagatgaattagaaaaacaattttgtaaattgtttaaaacaataattaatag

SEQ ID NO: 27826 - DNA, 1742 bp, Heterodera glycines
  misc_feature (1522)..(1522): n is a, c, g, or t
  misc_feature (1582)..(1582): n is a, c, g, or t
  misc_feature (1621)..(1621): n is a, c, g, or t
  misc_feature (1689)..(1689): n is a, c, g, or t
tttcatcttttttttcaaaatatccatctcaacgaggccattgaatcccgttaaatcctacacggcctgatgcaaatccccaaaatctcgatcccagatttttcaaaaagtacagtctctaatatcagtgtatgtgtgccgactgccgacgccctcaaaaattttgaaaaccggaattttgagcacaaaatgtcggaaatcggcattccgaatcggaatttccggtccctgacacataaataaaattctcaaaaaaaaaagcgtacgcacttattatttattattatattcattcattatttccacatgttttcaagttgatattccttatttctcccttaaaatttatatatatttttaatgctttagattatttaattgttttaatttggtctaaatgccggacggaaaggcgcctcatttcccccaacagcccgtggccaggcaaaatgacgacggctcgcttgagcttgaatgttttctggaggccaacccggtcccggaaatcaaatggttttatgaaaacgtgagttactctctcacaaatttcgtccatcaaatattaaattttttttattaaattcagaatgaactgaaaccaactgaacgattttcattccgactggacaacagagggtccgaggccttttcggccattctgcaaataaaagttcttgattacctttttttcattttttaaaatttttttcaaattttcaggatttggcggacagtgacgccggtgcctatcgctgtgccattgtgaatccgttcggcaagggcaatgccaacttcaatttgaaacttactggtaatttacaaaaaaaaaaaattttcttttaaaattcctaatttgcttttcctattttcagggttcagttcgccaacattcattgaaaaaccgcagatttcttcacgtgacgacggccgggtgatgatcatggagttcaaggtggagaaatgcattctataaacaaaaaattgtaaaaaaaatttttttaggctaaatccattctgaaaccgacttttgtgtggcaaaaaggggacgaaattgtggccgagtcggaccgttacaaaatcattctgaaggagacggggaaccacgaggtgaccaaaaagagggggaaggaattttggaaatttttttttgaaattttcttttaagtattacgcggcattggaaattgttgagccaaaaaaggaaaaggacgcgggacaatttgtgtgtacggctaaaaatgagtcgggaaaactgacagcaacattctcagtgaagttcgaaggtcattgaaaaaaaaattcaaaaataggggaaatttatgtaaaaaaatccacccctccctccccccttaaaattttgattatttctattggtccccgacctcaacttggtttaaaaatgtacggataagggcaccgggaaattgtgaggcgggggtcggattcttggcaaatcctatctcttgctctgattcccaatccctggtcccggatttttcaaaattccgggctgaatttttanaacttttttcccactttagttccacaaggtgcccccaccttcacacgcaagccacagatnttgcaaaaaacatcagactctggcgacccggccattgtngtcgacatcggatttcaggttaaccatttgtaagagatacaaaaaataactttgatcctaaaaactcngcccaacaaacgaacaattgtcaatttttatgatgaaatttcatggtgcgcta

SEQ ID NO: 27827 - DNA, 2192 bp, Heterodera glycines
  misc_feature (1359)..(1359): n is a, c, g, or t
  misc_feature (1422)..(1422): n is a, c, g, or t
tttttcctctagctgatcactatccccgtgcccccgcccgtcgtggacggtgtgcaccatttgtgcacccaatggacaacgccatcggtgcgcacatttacttacgccggcggcacttcgccttcctcagcaacagtgtctgaagaggacggaatttatcgccttccacgacgcttgctccgtctgacccaaatcccgcgcgagttgggcttggacgcgcaagaattccgttgtgcggggtgccgtcgaaacattggcgcttcttttggtccattcaagtgggtaaaaaatgggcaaattttttgaaatttaaggtaattcccaaaaaaaaaagtcggtgcggtacggcactaccggacctttattttaaccatatttttggaaaatggaccccaaaatggcaaataggtagtcattttttggcgaataacggctacaaattcctgctttctccccggcgctgaacttccatttcttttttaaactcaaaagtggagggtgtacgtttttaattcgaattttataaatatttttgcagtgtctgcgctctgaacggtcattgttattgcgtcggccattgcatcaacgcgaccaatgcctccggggagaacggcgcgacgacactgatccccgcccgagtgctgctcaatggcgactttcggccacgaatgatcagcagggagtcgctgatgctgttacgctccgtcggggagaggccgttcatgcgcttggacatgctcaacccgcaaatttatgcacactgccaactgttgcgcaaagtcagggtaagtgagtgagtgggggatttattttaggtagaattttgaacatttattcggccataaccggggttcaattttggtatagttttcaatcggtctacgcatttttagaatttgaggcatgtgttctctctgcacgtgctgtacttgttttcctgcaaagactccgttgctgaggatgccaaacgtcgcatttggccccaaaaacattggcacgaggacatccatttgtactcaattgcggtcagtttacgaccacacaaagtgtgtcttccatgtttgttttttcgctgctgcaggactttgagagtgtggccaatgggacaatggaacgccggctgaacgcgctgatcatctttgcccaatgccatatccagggctgtcagatctgtcttcaaaagggctttttctgcgagttgtgcaacgcttccgaccagccaatttaccctttccaaacggacatcactttacgggtgtgacagtttgttgcttttctgttcagttacaaggcccattcaaaattggaccccgtaacgaaatagtgccacttttaacaacaaaatctttttcagtgtcncaattgtgcgtctgtgttccacaaagagtgtgccaaaaaggctggtctggacgattgcattgncggtctgagcagcgagcagcaacaacaacaaaataaatgtccaaaatgccttagacgcgcaaaatacgcctcgacaacgacggggagcaacagcaacaacgcattggcacagttgcaaaataacacaaacatcaaatagaaataactaactcatggtcctttcttttttaatataattttaatgccttttcattttgcaagtattttcctgtgataaattttttatgttcgatagggttgtacatacattaacaaatattatgcttttagtttttcatgattatttacttgacttaatataaaacatttggtaaaacacgaaaaattttatcaaaaaataaaaaaatataaatgagcaaaaaatgggtgggtggaatgttgttcaaaaaggtattgctgtttgattaaagtgccatctgcattttgatgggtggcaacgggtcgtacccctcgagcagtacactttcgggtgtaaagtcgtcgatgctcgtgattggattcccatccggccgtttgaaaacaattcgtgggaagggtttcggagttcggcccatctgtaaaaaaatatatagaacgaactaacactcatcatcacttgttccttgagtgattcgacatggtttaggtaaatgtgagcatcgccaagggtgtggacaaattcaccgccctaaaattagaaaaatgaggcattttcgttttcaatttcctcactttaagccccgtgacatgcgcaatcatttgggtcagcagagaatagctggcaatgttaa

SEQ ID NO: 27828 - DNA, 1421 bp, Heterodera glycines
cccagcagtatacaaacgtggatcatttcctggcatcatcctgctgatgatgataagacgaccatgctggtcaataccaacagcgtaattaatgtcgttaactaaacaaaaaattctttgaaaagacaccaaaatttaacttacgttctctcactgggttcactaaaaatatttaaagtttttatgaataaataatattcatattcaatagaaattttcaaattttataaagatcaattttcttaattattatgtatagtgaaaaccttgaagaatcaaaatttgtagtccattttcttcccctaaaattattgctttactattgggcaatataaaattattcaaaatcaaattttaaacacccacccaccattattatcaacgatatgagccccttcattaacttaaaaatctatttaattaatgtaaatattcattaatttaccttccggcccaacaataactaaaaaacattaattagaattttacattaattaaaataataatataaagagaaataaattatttttttacaaaaagacaatcgttgacgatcgggtggaaagtcctcggaagcaacttggccacggcaaactgggcaagtttcgtgaaaaatttgtacaagcctaaattagttaatttttaaatctcaattcaaatagcttaccatcggtcaacacaagctcgatgaaagcgatgctaacaaaaaattattgttttataaatataattttttttaataaaaaactcggcatgagcttaattgcttcatttcctcaattgccgtatttgttaatgattccaagcaaattggacaattttctgccgatgtcgcatcatcattgttttgagcacccgttgaagatgaactcggatcgtctgatgttgcagcatttgtttgtgtcccattattattattaataccattggcattattttgttgtattccatcattgtttatattattattattattatggccagattcattagaatttgatgacccttcatggttttcgtttggactgttcaagtttggtgctggttgttcttccactgggtctgttagaccaaattgttcaagatattctgaattatttacattttaaaataattttgacgagaattgtttattttatttcgtttttataaaatttacatatttaattaaaaagctttcttatccaattttaactgttttaccaataaaactatcgcttgaagatgaacttaaactgtttgttctctcttgttcaccactttcttgtattgaagaatccgcatcaagggatagttgttgtaacctagctaaaatattttttatttctaacttaaaatgagttttttcttaaaaaatatttttgaaaaacaggaattttcattgtttcaaaaaatagaaataacacagcgaagacgtccaa

SEQ ID NO: 27829 - DNA, 1502 bp, Heterodera glycines
  misc_feature (116)..(116): n is a, c, g, or t
  misc_feature (1390)..(1390): n is a, c, g, or t
  misc_feature (1440)..(1440): n is a, c, g, or t
  misc_feature (1455)..(1455): n is a, c, g, or t
  misc_feature (1470)..(1470): n is a, c, g, or t
  misc_feature (1488)..(1488): n is a, c, g, or t
tttagaccagggtgacatcatcatgcttataactccaataacatcaaatgtggtcgatgttgtatttaatcatttttgcaaagtggagcagagcaaagctaaacacgtcaattttnacggtgccccatttgtataaaccgtcactgtcctgaacactgatggtctaccccgtcgacgaacgaccaaaggaagtgctccgaccagtctctcatcacaatcccacatcttcaaaattaacaacaacgacaactattgcctcttttatgctctggaattaatgcgcttctactctttgtataaacgcggaattatatccgaaaaacgatggagatggatgaacaataaccaaactactgttcttcgtcaaaaagtactacttttactccgcgatgccgggattccgacaactgaaccggaatacgatgccgaaatatacatccatcaagtgcagggattgtggagcacaaaatatcccggtgattattttactttttatattgatttttattaatgaaataaattacattatttgttacaggcgagtataaaatattcatctttaatgactaccaaacccgacccatcacaaggtctgacgtcaatgaataccaattctctattattctctaccaccacgacaaacatttcgacggcatcaaaaccctttccaaattcttcaataaaaattattattgcctctcttgtgaaagcgtatacgagcgcaaatctcaacattcaatgaattgctcttcactctgccatggatgtcgggaggtgggcgttgactacccatgcgagccacaacagggatacttcaaaaaatgtgatcaatgtaacaacaatttctacaacaagatctgctatgaacgtcacctacacaaggatctatgcaccaaatttcagcgatgcgaggactgtggggtaatttataatgtaaagtatcacggtaaaacaggtcaccaatgcggggaaaagttttgtcgactttgcaagcaattccatgtaaaagaggatgatgaggataatccgtgcagtagctgttttatccaacccctaaaaccccataaacttaaaccatacaggatcatcgcttatgattttgaagcgacacaggataaaaaagtaggtaataaattcgaacacgaggtaaactttgcagcggctaccatcatttgtaccgattgcatcaatggaaattggaaggactcacttaaaggatcctcttgcaaaatttgtggaccccaccgcacaatcaccttcgcaccattcgacttctcaaacacgatagtggaccaaaaagtcaccactatgcacccgctgcgcgactttgtccaatggcttcttttcgaccacaacaaaaagttccaacagttgcctttgcacattttgngggccgctacgacatgaccatggttatcaaggaagtcatttcgcaggtanaaatttattaatatntaattaatttttatncatcaaggtattcataancctgatattatcaa

SEQ ID NO: 27830 - DNA, 904 bp, Heterodera glycines
aactgaaaattctgttctcaataaggccttaatgacttatccactcgaagattagccaaaatgcattataactttggatgtgagaaattcgaaattgaatatccgactcttgtctgaattcaggatcgggattagatatgtcgaaatgaatttctctattcgtgataagcggcttcgaaaattccctggaacatatcttttgtcaaatggggggggggagaagacaccaatggtggggcactattttgctccaacacttttaacctgactgtaattgaaattttaatttctgattttctccccagcgaagaaattttgaacattaacttcaaaaggatattcgtgcatctctgttatcttctaatattctcaccattcccctaaatgttggcctgtgggatttttgtcgacttttttgcgcctaaatgtcggcgagcaactcgaattttgatttgttttggtcactctgatcagtgagtaaacaagccacaaaaatactaaaagatcacagatccgcataaaaatccattcgcttagatcacaagtactttttaaccttgtataatgcctttgtttgaaatacaaatatttaaaaattacaaaaatttttcacggctgcgcgtctatcggcaccgccggaccccttcttttccaaaagttttttggtgtgccgaaaaaagtgatgtgaaaaacaaaaaaaagtctaccggcgtgcggtggtaccccctctaagctttggaaatattttctttagtttttattagagtgcagcgggaccgggaatttttggcaaaaccgggaccgggacttgccgggacctgagaagccgggaccgggaaccgggaccaaccgggaattttaaaagattcaaaaaaatttttaaaaattcaaaattttttatttt

SEQ ID NO: 27831 - DNA, 1512 bp, Heterodera glycines
tcatcattattccgtagtatgaaatttggccatattccctcgattgaaaaagtacaaattattgttgaacattgatcaactgcatctgaattcccctacctccactgatcagtgtctcatgatcattccgtattttttttaacaatgttgatcaattccatgaaaaaagtacaaaacaatgctgatcaattcccaccgattacaaaaaaaaatgtctctcttctgtccgtggccttgatatgtagtaaagtttattgtatatatttgagacttggaataaacagataatttccctttgccaatcaaattatgcattgatcagagagagtctgtgcaactctcacccgatcactcacattctcatttaattgcacattttaattgctttttaattaaaacaataacaataattagcatagagctgcaatcacatgaacagttacttttacatatataaattgctttttttaccgttatataggaccggaatattattattatttgttttgtgttggtgttctgccgccgatcattacgccgccgccaaatattcgcgccgtaataagcgacaaaacggaattggctgctgctcaattgttgttgttttgatgctttcaccactgccaccacacattgcgcagtgtgttgtgcagctatataatgaatgaaatgccgtcattatggaaacgacgacaacaatggcatcatcatcaacactgatcaaacaacagtgccgggcacagcaagtggggacggcggcgcttggttccgaaaccgctgccgcccaacagcagcagcaacaccgttactaccaccatcatcatcagcctcatcgtcataatcatcagacgaatgccatgctgaacaaaaataatggggggtattatcatagtccggcattaatagaggataatgatcatcgtgatcatcctcatcataatcttccgaattaccatcagcagcataattttcggcatcaacaacagcagcagcagggcaacaaccaaaaaggacggcatcaccaccaccaaaatcagcagcaacaacattatcatcagccttcaattatcaacggctatggaggtggtgatgatggtggagggaggagggccaccgaagcgaatgggcggcagcgccggaggggcgggaggaggaacaggaggcttttcctcatcatcatcagccacaacaggaggtgcacagtcgtcgggggcgggggcggctgcgataattgtggtggatccaccgcgtccgccgttcatcccgaaaaagccggtcctcaatgaggctgggaatggggcggcggttgctgctgttgatgagcatcatcatccacgccctcaccaccaccaccaccgcgaccacaattgcatttatgcacaagccaattgtgacggcaataatggtggtggtggtggttgtgctgcagctgtgaattcatcgacaaattcgacgacggcggcggcggcggtgttcgatagcaacaaaacaaaagttcaaatgacgcttgta

SEQ ID NO: 27832 - DNA, 1303 bp, Heterodera glycines
atttcaactgcccgtgtaatcctcgcttgacgtcgacttccctttcgccgtaataatgcgaaaatctagggaacgaacgacggattagccgaaagtttgggggaaaacaacggatgagccaaccatttccagcagatggctgtttgtgctaatgactgatcagattggtctgatcagctgcccttccctccgccttctgattaatttttttccaaacatttgcgttgttttgagctgccctttcacttaagtcctctgctattttactggctaaatcaaatagtttaagtggtgagattaagccaaagcctattaaattagtggacagagaaatactacggccgataattacccaaattacctaattcattcttgaccatttctccatgccgtcattgctcaccctcccctttctccctttatgtttttctctccccttctagctctatccttttctctccttctgcctctatctctttcgagccctttatctcttccgcctctctctctctctctttctctcctctcactctttcactttgtttatgtctccttggccgtaattgtaaatgagaaagcaaccccaaaaaagttccacctatttttcccatttcgtcaacttttctcgtaaggtttctcatcatccgtccgtctttctctccgattccctcgggggataatccgcttatccctcccttccttccccccgtctccccgttatctttcattctattttctttgtgagtggtggcacttttaaatggcacttttttgccaaaacttttcaatcaaatttccaacattcaaaccgtatgaccttttttctaccaatgcttttttcgtcggctgttttaaatatccgtcacttttcaggttgtacttaaatgatgtgaacactaaattttcccatggcttttccttttaagtgaaaattcattcgttttctgtgagattttcggcattttcccacccatccggtgattttctggtttttgtgtcctctttggttggtttattttatcccattttcccttcccctccccaaccccttctttctttttgtcattttcattctttgtttgtttgcattgccaaattggtcaaattccccgtccatttactattttaatgccaaattccttcgtcatcccggtttcttttctacgttcctcagcaattggaatttatttccttcccttctcactcccacaagcttaaataatgaggggatgaattgaaatcttgcttctccccatttcccctctcccgcttattcccacttctttctctcccccctttaatt

SEQ ID NO: 27833 - DNA, 1606 bp, Heterodera glycines
  misc_feature (1449)..(1449): n is a, c, g, or t
  misc_feature (1486)..(1486): n is a, c, g, or t
  misc_feature (1542)..(1542): n is a, c, g, or t
  misc_feature (1544)..(1544): n is a, c, g, or t
  misc_feature (1556)..(1557): n is a, c, g, or t
gaaggcggtcggcccggcaaattcggacttttccgtaaccaaagtggggaaatagggagggagcgggggctgttttgatggtggcacaactgagggacaaaaaaagggagagaaatgccgaatttagtcccatttagaagtaaagtcattctcacccgatccaacataattcccagcagcagctgaaggaaaatgctgaggaaatggtgatgaattttcgtaataatttgcgggaaaattcgtgtgccgttgttctcccagcgattggtacaaattgggaggaggcgccgccgattggacgtcggaggaattggctaaagtgccggccaaaagcggcgggggatttggaggggaataatgcgacacaaagtgagaggacggagacagaaactgtaaaaacggtaaagacttaagccttacgatgattgagcaacaaagcaattaatgggccaaaggaaagggaattggaataacaaaggaacgccgctaattaatgactcttgagtaattggcctcggctcgagaaaagtctcggcttttggagtctcagtctcgagtatcgagaaattttaagtctcaattccattcttcactgctataaaagggtgaaatgtccgtcgctattccattccttcgccgctcaccgggcgcactttggccgacggagggaatgcgccgatgagcaaaacgggcggcttcgtcgcctgtcctccatcagcgatcggatgcaccgccgcttccgctgccgtcgtcccatgcattccatcgcccgagttcggcgcgtaataggcaatcccgccgagatgggccggggacggcacagcgaatgcggcgccggcgggcgaccacaacggcgcgtattgcccggtgggtgagcggaaggacaattgcggggaggactgctttttgtgtgcggaaacaccgaaggaatcgtcgtcgggctgatggctcggcattcggggaagcatcggcggacgctgtgctgcaaatacaaattggcaaagtcggacacggacggtgccattctgttggcgtttgtcggatcaccgtcccaaaacttttgccacataatttttgctcacccggcggctcatagcggcctgaggcaaatgctcgaactccgtttggcattgtccattcactcatcaaacggttggcctcccgcccaaacggtcgttgctttgctaatggcggcgtgggcccatttctcgtcgatgggacagcggacgacggcaccgttttttccgtaattttcacccctaacattttatggcctttctctctgcttccgttctcctcgttttgtccaatgacttcctcttgccgatgggcggtttctttttgctgcttcctttcttccgtttcggtttgcccttttcctcccccctcggctgcgttctcctccgcctcctcctccgctttttcctgggcggcgcttccctcctgtcnctttggcgtttctcttctcggcgtcgcttgcggctgntgcgccggctcgtccgcggcccctgctcttctccgcttaaaaggtttgcttcggtncntgttggctctgnntcgcccgaaaaagggcattgcgtgaaaaatgggcccaaaatccgaccct

SEQ ID NO: 27834 - DNA, 1003 bp, Heterodera glycines
aatattcatagatttttttccattttcccccacttttttaaggtgttcaactccatcaaaatttcaaatattcatagttttcccgttttcccccactttttgaaggtgtccggccagcattttcttctccgccctctactccgagtcggtgtacactctgttcactcagctcggcctgctctttctctgctccgcacccgtctcccgccttaaccaactgatcgcttccttcattttcgcgttcgcttttctcacccgttccaatgggcttgtcaatgccggctttgttggcttccaattgctgcttgacgccattctttgcgcttcgccgtccgatggacagcccgagtttcgggaatggtctcgacacttggccaaacgagttcggttttaattcaaatttcaaaaccgtttatgtctccaaacttttatcattctattttaatgtagaaatgttactgaaatgttttgctgaccaaaccacccatcatttctatttccggaacgagtcgtttccgtcgaaaatttttcaaaaaaattcgaactaattttttaagaaaacattttttgaaagtttttttttgcgttttttcaaaattttatgatgagtttacgttttttcgaaaaaaattttttcttgaaacaacaattagaaaatttcaaaaaaaattctgaatcacattcactttgttcagctgttccgcaacttttgcttctttctgctctgtctgtgtgtgatggcgctgccggtgcgcgtgtttgaatttgttgtgcgtgacaaattttgcgcaatttctcacatttcgccaattgacgggacaacgacggcatggcattggacggacgaacgccttggcaattttgtgcacaacaattcaatttccatggcattggtgttgcccggagaattgggcaaaatgccgtggtgcaacgaaaggtgttgctgttgggatttgaacaaaaataaaattatgaaaatgatgagaatttcaaaattctaggg

SEQ ID NO: 27835 - DNA, 1911 bp, Heterodera glycines
  misc_feature (41)..(43): n is a, c, g, or t
cattcggttatcgttcttcgttacgttgttgctcattttgnnnacaggtgtcgtttttggtgggtttctcttcttgacaaaggccaacactttgccaataattcgtttgaaaaggtcgcgcaatgtccttacaaagtaccagcaaaaggagctgaataaataaaaattaaaaatacaaaaaagagtttaattgcctcgtcggatatgggatacaaagaaacgaagaattggagcggataagacaaaatttgtccgattggatgacagagccagtaattcgttgtaccaatcgtaattgctcgcaaccaccgttcatcgtaaaaacaatagccaggatttgaatggcgaagccatgtcgcagtgattcgtctgctgtttttgtccaccgattgtgaagccattcccacttcgattatgcgctttaggtgaaacttgggtaattaaatatttaattatgcttttacccttaatccatgccaaacgaatagcaattgccacataaaatgaggacgaaacacccagataagtcaaataagtccacgaatactgtgaaagaactaaacccaaaaaacttttgtattggataataaatcaaattaaaaaatgatttaatatcttacaaatgtaaaaaggagtcaaaatgaaggacaacaaatgcaaaagcaaacgttggagcagaatgcatcttaaaataataaatgtgaatgtgattcaattgttattggcctaaattcaaattgatatgtaaattaaattaaatatttttttaggtgatcgaaatcgagttcgatgattagttgctcgaaaggttaggcgctcaccgaggtcttaaatccccggcactctcttctatggttattttcttcttcaccgaaaattgatcacaaaaaagatgcttattagtattagctgtgatgtaattttgccaaaaaattcacttttttgttattttgtgagagtaaagaatggggaggagcagtgcgtatgctctgtttgctgccaatgcaatgatatgcaaacgattgttgaccaaaccgaacatggtcatgttctgtcgtgcattttggctgatagcgataagacggatgaccaaaggattattcaaaattttggagaataggaagagaagatcagggaaaagctgaatggcatgaaaggcacttttaacttattcaaatgacaattatggcgctgccgtcctccggaggcttacgcactttgctgaccaaaatgtacaaagcggtgcgttctcggaccaatttgaacaacggataaacgcaaaagagcaggaacagaacgcagagcagccaaaaagtgatttgagtgaattggcgcaattttgggtcgatcaacgactgatcagttgcactgctgcaattcattggcgagaatgcagttttttcgtaccaaaataccaagtttaataaatgcgagtgaaatgaataaaatttaattggtatgcactgtcttaaatattatacggcgaacaaattccacccttcaattatttggataacactaattatgtatgaataatttatcttttagcccaaccaaaaaataagccattgccaattaataaaaaatgccaaattataattaaatcggacatgggccacccgtatttctaaaaactaaacaagtaattacgcccacaataaaggcatatcatttgaccacctgccggttttcgttttttattttttctctttacgtcgccagaacgttcaaagttttgtccaacgtctgcttccttcaccggatgcgattttttttcttggtgtacattgacgtatgaaaacggcgtgaattgtgagaaaaattttaaaaaaaccaaggtttttctgggtatggctgtgcccaattgggacgactaacggagaaatttttcaaaattaattaagaaaatag

SEQ ID NO: 27836 - DNA, 985 bp, Heterodera glycines
ctttagtaggaattttgtcagaatttttaggcctgcaaatattgagaattagaaataaaattttacgctaaacatatgaccacctaaaaatggaggtaaatgcatttcagctaatacccaaccagtaaccgcgggcacttttcttcaagtttggcatcattgaaaaggccactaaaaatgctacataattgcttttgatctttacccgatttgtgcctttcttaccgcttcagtgaaaatttaatttcaaaaaataaattatgctaaacatatgaccatgactgtagaaaaaaagttaaagcgtcacaaagtaaatattgtttttacaacagggctcccaagtgtcctgatttttcagatttgtcctgaattagagggtacccatctgaaaaatcaaaaatgtcctgaattttcagattgtcctgaattttgaggtctctgccaagggggtagccagacccttggcttcggagggggctgaagtcaaaaactcgatttttaggggtgtatttttcttttttcagtcgatttttaggggtgtatttttcttttttcagtcgatttttaggggtgtattttttgttttttgaaatcctgaattatgtgagtttcttcgtgaaaaaattactatttaaaaaggggcgatatgttgtaacaaaattcattaaaaattcaaaaattttcccggcggcgcctatcggcaccgccggccaccaaaaactcttatgttttcttaaaaaatgtgccaaaaaatcacaaattttggtcatttttgacaaaatattaacacaatcatttaaattttttcccggtggcgcttatcggcactcttttcctcaaaaaacaaccaacatttgtcatttttttgacaaaatatcttaacaaaattcattaaaaattcaaaaaattttcccggcggcgcctatcggcaccgctggaccccatgtttgacaaaagttttttggaaaaagcgcgccgcaaaaat

SEQ ID NO: 27837 - DNA, 753 bp, Heterodera glycines
ttcctcttatttttctcttcgcatggacgtcccattagaaaagaacgagcggtacgaaaacagcgagcagtcgctgcattagcaaaattggcagcctcaatcgcggccgtgaaaacttttgttgctgcaaatgcagcattaactgcttcagcagccataactttggcggcaatggagcagacatttacataacgattgaattactgaaatgtaaacataggatcattgaattaaaaagatcgagtgtgactctaataactcatattaagcctatgatcactatgaagaattacttgatgacttctttcctttgactttcattttggaggagtatgaattcattgtctccgccaaagattatacaccggatttttttttggaaaaatctcacaacattacggccgaaaaaccgatgaaatctgcattaatagtaagtttattttaaaataatttaaaaaattgatcatatttctttaataaagcaaaaacaaatggcgacacgaaaagtgaaaaattcaaaggcggagcgcaaatgtttggggcgcaaatgtaggggcgcaacaatcgggacgcaaatgttcggggcgcaaatgtaggggcacaaatgttcgaggcgcaaatgtaggggcgcaaatgttccgtcaccattgtttgctaattgatcccattgcattctctactggaattatttcctctaccgtcattcatcatccccaaatatcgggtagccgccattcaaatattataaagaac

SEQ ID NO: 27838 - DNA, 1036 bp, Heterodera glycines
ccccccccccccctcccctctgaattcttttcccctcttttttcgtccgtttgttcacttctcgtccttacgaatttgcacaattttcgccatttgccctctcgtttctcttcaaatgtctggtcacttttcctcatcgctttcgtccttatcttttcctctctctttttctccctatctctctttctctctcctctctctctgtctgttcttatcatgcaacactctttccttttccttctgctgatccatcattctttcacttctatcaaagttcgaatttctattcaagccttatccctctatgtttttttcgtcttccccatcgaacagttggcatcgctttgtctgatccgtgctgactattgacgacacaatttgtgcgtcgattctcgtttgtcccttctctcccacatcaatcatttcaattttactcttgctgatcaattcactgtttttacagtccttttcgatcataccacattcctaattttaattccatcctttttcatttctattataatcactttttgtatcatccgatcaccaatttcggtctgatcactccaaccatcccaacttcgttcatcactctcgtcttctcttcttcgtcctcctccactctgatcattcttttgttggtttactattaccattcatttttttctaatcattttttttctaaattggtcgctttgctcatcattccgtcttttccctcccgtggctttttctctctccgtacataaaatccaattgatcaattctctcgtctcgtcgtcactgatcacacgattcattccctcccccattaatcactgtccgtctttaaaactgtttcatcattactattcgatcacatttattttaataaattcacctctcgtctctatcggccgccaattggtgagggatggaaggcaaatgtattaattagttaataggccctgttatttaacacttttaatttattgaaacttaattaaatgattaaaattttatttttaaaaacttttgccgtttttatttgctcatt

SEQ ID NO: 27839 - DNA, 939 bp, Heterodera glycines
tccttatcatgctcgagagcattagtatgtgtataaaatttatcaaaaaaagagatagccatttttgtgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacagggggcgcttttgtgaggtataaaatttctcaaaaaaaga

SEQ ID NO: 27840 - DNA, 716 bp, Heterodera glycines
attaattgcattttatataaatttaaaatattttcggctttaccccattgcctattttaagtcaattttcgttcagaaacagcctgccaaatgtccacttccccgtccaccatcagcagtccgcgaatgcatcctttcaacgatggtaaatttaacaaatagacgggcatccttaattaattgaccttgactacttttataattttttaaagcgtgcctttcccgcttttgggtacgttcgctttgcccttggcataccgccagcaaacaaaatgtgaaagggccgcactttttgggtggcactggcggagctggtggcaaaattgcatcatctaatatattaataaaaagatatatttattaaattttgttacaaataatttaaatcacatttaagtattatacacatatttttataatcaaactaattaattaattgttttaattaatctttttacactcctccgcccttttttcatcatcttccatgaatgataatccattttggtgatcagtttgtcaggatcattcagcagaaccggtccaatttcacactgatcatacatagttaaaacgaagcaccactgtttgtggtgccatcgtgcccggctcattgctgcgctccaaaattagctgaagccatcgcatgtcattaaatgctaaaaatgaattaaaaataataaagatagtgaaaaagacactaatttagtcttatt

SEQ ID NO: 27841 - DNA, 1133 bp, Heterodera glycines
caaaagatcacgaaataggcacctaaaaaggcagaaaaaatcgcaaaataggcactaaataggcacaaaaatcctcaaataggcaaaaagtcatcgtagacaccctaaaccaagcggaaaatgcgtttttcgtgcttatctgtgcgtattaattgcgcagaaattttaggcatttgcctaaaaattgagttcctatttataaccattattatatgtcctataaagctgggaatttctactcacatttaagcaagaatagtgcctcaaattaatatacaattaaaaattaaaaaaaaaaaaaattctgaattatggtagctaacttcttggaaaaatttccttgacctttttattatgcttttagaatttattcgcaaaaaaatgcatattttgtttacacgtttaggaattgaaggtcgggatgttatttttcttaattaatcgacattttaatttcgtttatatatattatacatatatactatatataaattatatatgttgcatttatatatttaggcgtgtatgttttttttacctttgttcattcatagttaggctatctgatcagtagggcatccaattatatggaaatccatatttttttcctggactgtggaaggcctgaaacgcacgaaaaacatgtttttagcttggtttgaagcttctaggaaggatttctatatccatattttccatatttcgcgatttatgtccatatttccatatttttccatattttggcattttggttcatattttatgtccatatttccatatttttccatattttggcattttggttcatattttatgtccatatttcattttttcgccaaaatttctcgagaatattgaataaatttaaattttcttaaaaattactaaatcatgtcaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaattttcaccaat

SEQ ID NO: 27842 - DNA, 1919 bp, Heterodera glycines
gcgacagcggacaaatgccacccgattacgacaactctttcgccggaggcggtaccgtactaccagcttaacagtgccgaaaatgtcaatggtgaagcaaattgagggggagaaatggatgatggatggcactcctttgtctgctgctgattatcccaatcacacacatgcatatcacattaatcacttactgtacacatacatgcattgtgtagcaggtccaggcttttttttaaacccttagatccaaattccaaatctactataattagagccattaattatgtattccaaactacataatgcacaaagcagcgcatatcatcagcatcatataaatgagtttaactatgcgtaaaacatattatttccatgatggtacgtacaacaaatacaacaacggccggtggggattttgtctccaaaaaatggacgaaaaatgacgcgatgccatcccttcggccatacaataattataatatatatattaaaagaaaatatgtagataaataagggtgtcatgcatatgcgcactcggtgggaggacaacaaaagtaaaaacaataacgaaaaaataaatacataataccgaaaactaattagattttgcttaaaattacgtcgatggaacggaagggaatgatcgacaacaacaaatatcaacaggaaaaaactgattgataacgaagtgcggaccgacattcctcttattagtaacaatattagggtgaaaacaatttaatggtcaatcgcaattcataattagtgattgcgcatcgtcgttttttatcactgaaaactggggggggggggagggggaaacgaagctaaaaattgaatatttcagtgattcattcatctataatgtcccgccgaaaagcaaacccattttatggtctgctggagggaatacacattgtgtgtccgactgcactcccaaaaaatgggtggcctaagtaagcgtattgtagtgatgaaagcacacacacataccgtatgcatgtcgagttgaaaataaatacatactattataagcatatatgtatggtacggtaaaatcaaacaacaatgaattgacgaaaatacacaatacaataaaaatatatattggttgatcgggcgacgatacgatcatcgattgattgattattgaccacacaaaattgggtgggcagcgaacggcagaaaagcgaacggcgtggaatttaaaaaaaataacgaatggacagaaaaatgcgatgacgtcgtgaattacacataaacaattcccgttataaatacagaaaaaggtgggaggagggggtagaataataaaaattgataataaaaataataataatgaaacgatgataatggaacagaacaaaattggagagagagtaaatatgcaacaaaacaaagccatattaaataatataacaataataaaagggaacagcggtaaaatttataaaatccataaaaacagcaacaggcagagagaaagagaggagagtcgtacgagaatgatcaagataagcaaaattgagaaaagtgtgtaaggacgaaaatgacggatacaaaaagggagtccgggatgggttgagttttgttggttgtgtagtgaacggatggatgggcgcgacgacgttgggggaaacggctaactgaggacagccgattggattggcaggtgggcggaagtgaacagtgtcattgaggagaggaggaacatttgcatgcctaaagggaccgaaaattacagggacatgccgaaataaagttgatgaaacgaagtgccaacacgaagtgtggcatggataggtaccacacagatgccatcttgcatggcaaaaactgttttttgacccgagtagtttgacggcatttgggccaaaaataagttattgggaacatggtccttggattttggcttgcgt

SEQ ID NO: 27843 - DNA, 1107 bp, Heterodera glycines
  misc_feature (1086)..(1086): n is a, c, g, or t
ggggggagtgccccagaaaacaaaaaaaaataaatttttttcaagtgttccgttggggttgctcaaacaaattttggggagccaaaaatccaacgcagatttaaaagtacaggctatagggaaagctattccggaaggattcggtctccccataaatctgggcgcatcggttcggggggactgccccgaaaacaaaaaaatcgattttttcaagtgtccgtttggggtactcaaacaattatggggagcaaaaatccatcgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattataaggggcgaaaaatcccaacgcangaattaaagtacaggctatag

SEQ ID NO: 27844 - DNA, 1930 bp, Heterodera glycines
  misc_feature (1922)..(1922): n is a, c, g, or t
ggttaaccacaacattgctctggtagctgacctctcatctgccatcggcactaaagtgaccaccgattgggaaacatatagcgactgtacttgttgaacagcacctgaaaaatgccatttcaatttgcactttttagggggtgaaaagcactgacaatgtccggcacccaaacacggtccaccggcacatgaacactatccaaaccgccgtagttggaagggttccaactggaaaaaaggcgaaacaattcgagcagtacgcacatagatccccataattaggcataattaattaattgttttaattggttgccattgcgcacgtcaatcggcagtcgttccatcgcaaagtcagccaaacatttgactgcatgatttgattcttctcatccacgctgatcaacagaatctgtgcatgtttttggatattatgcttcaattccaaaatatattcgttaatttgctgcttaaaatttgccgagtttggcacttgccatggccatgccaaagtccacgtgcacgacggatgagtttcggcacggcgaaggacgaatcagcggattgtacccgcggaacatgtcaatgccgagccgttcttcgtcctcatcggtggctaagagctgcggccgaactaaacaataaaaaaaaaaaaaaattaatattaattttagaaaaaaaaattcgcggtagatttaatgacttataagacaaacggatggacatttaaatgttttaagttctcggaatattttggcattttgttgtgtgaaattcggcacgttttcttcaaattttctttaaatggtcatttttacggaggttcagttttgaaaacatttaattttaatttaataaaagttaattttctcttcaatattaattaattcccattttcaaattcccaaatgccgtgccatttcaatccttcatatttcattattcatttttacttgttgttgttgaaatgctcgaatgtccgctgttcattctgtcgtcctttgaaccgctgaccaaaatcaaagccaaaaatgggggcaaaaggccaaacaatggcatttcaatttaactatttgccaagaagcacaaggaaatgttgttggacaactcaaaagtcgagtggcattttcagtggaaaagtgcctttttggcgtttcattttttgtaattgtttggccacaaatgtcagtcaaacgaaggcacaaaatgaaaaattggcatgaaagtcatggcacaatcggattaggagaggggggggggggagtgagagggacaatggcacggcatagtgagtgaatgtccccccgggggacggcattttgggaacgaaataaagggcaaatttggcaagaggaaatggtcgacgaattgaaacaatggaggcgaagagcgaaaacaaattgtgtcaatgattttttattctttgaaaagtttggccaaaataatgaacaaatatttccgcaaatgcaacatttttggaaaacattaagggatttaacaaaaataaattaacttttaattaaactattgtttaattttaaatttcgaaatttattcgccatttaaaataattaaacgaaaattaaaagaaatttatttaacaaatacaaaaaaaaaattatataaaaggttttaagttatgccaatccgacgacatacgatttgtttgttttaattatttttaaatttaatttttctctttttcaatttaattttacaaattcacttacctttgccgaccaaaaatgccaccggcagaacaattaattcagtgaaaataataaaagaaagcatttggcaaaatgaaaataaataatattttttgtaaaaggaaagtgaaaatggcataaaatgagaaaatatcaatagaaaagagattagaggaagacatgaggaaaaacgaggacttttttggcaccaattgnggcggaca

SEQ ID NO: 27845 - DNA, 2388 bp, Heterodera glycines
tgtcataattttttctgaacttttagaccagggtgacatcatactgcccattacaccaattacgtcaaacgtcgtggacgccgttttcaaccagtttgtaaaagtggagcagagcaaatcgaaacacgtcaacttatatggcgctccctttataattaccgtcactgtcctaaacaccaatggactaccgcgacaacggacaacaaagggaaaagggcgaccgcctgtctcctcacaatcgcacattttcaaagtcaacaacaacgacaactactgtcttttttacgcgctggaactgatgcgctactactcattatatatcaggggagtaatttcaaggaaacaatttagatggctcaaagataaccaaacaacggttttacgacaaaaggtgctgcaactactccgcgatgcggggatcctcacaacagagacggagtacgacgcggaagtttatatacatcaagtgcaagggttatggaacgtcaaatatcccggtgagtacaaaattttcatatttaacgattaccagatacgaccaatcaccaaatctgatgtcaccgactaccaattccctattcttctctaccacaacaacaaccactttgacggcatcaaaactctttcaaaatttttcaacaaaaagaactactgtctctcctgcgagtcgccgtactacaagaaaatcgagcactcattaaaatgctcttcactctgccacgggtgccgtgaggtgggagttgactatccctgcgatccccaacaaggatacagcaaaaaatgtgaccactgtaacaacaccttttacaacaacagctgttatgagcgccacctccacaaggatttgtgcaccaaatttcaacgctgtgaagattgtggggtaatttataacataaaggttcatgggagtgttgggcataaatgtggggaacagttttgtaaactttgcaagcaatttcatataaaagaagacgacgacgacgggatgaacccctgtacgaaatgtttcatccagcccctaaagcaacaacgaattaagtcatacaggatcatcgcatacgactttgaggcgacacaggacaagaaggtggagaaccggttcgagcatgaagttaactttgcagcggctaccatcatctgcaccgactgcattatcaacggcgactggaacaaatcacttcagggaaaaaagtgccaaatttgcggtcctcaccgctcaatcaccttttcaccttttgactacacggagacaacagtcgaccaaaaagtcgtcactcaacaaccgctgtgcgaattcgtccagtggcttcttttcgaccacaacaaaaagtttccaacagtcgcgtttgcacactttggggggcgctacgacatgacgatgatcatcaaggaggttttagcgcaaggaattcacaacccggacatcatcaaacaaggaaatcgcctctacgagctgaaatcaggaaaacgagcatggccccctcaccatctttcgcgacagctacaacctaatgcccattaaattatctggcctcatcaaatcttttgggcttcatataaaagataaacagcactttccccatatgttcaacaaatcatcaaactacaataaggtcctccagcaccttcctccacgtgaagactattgccctaaccaaaagaagaaggccgatctgcagaaatttgacgactggtacaatagtaattacaaccaaccttttaaccttaaggaaaaactccctgaatattgttgcaacgacgtacaaatactcacccatgccctcgtcgaattacgccgggaattcaaacaactgacacaacggaacggaaaacacggaggaattgacatcctgtggcaagccatgaccatcgccagcgcctgcgtcaagaactttgcactcaatcatctgaagcctaactcgcttgccttcgtattgtaaaaaggtatacatcaccacagattgaatagtgcactgggcatctaatacctccaatggtattcgcatattagcacagtcagcatacacacagctcacttatgttatgttgtatatgtgtgtaagcgtgaaggtcagatatgccaattggacgtttacatcacaggcgcaaatgggaagcgggaaaaaataatggaggtgaatggctgtctgtggcgcggttgtgaggagtgttttgatgagatggcattaaaatatgtaaattaagttcggaaagtctgtgagggagagtaggaaaagggaagagaagaaacatgaaatttttatgtgttaatgtagatttgtaggttatttgggaactcgaaataaatgagaacatgaaaaaggacacaccaatgaggcagttttgtgtcaactggaaggacaatgagacaataaaaatcagagacgc

SEQ ID NO: 27846 - DNA, 795 bp, Heterodera glycines
ttacaatgctaatgccatagaattttattttaaaatatttacatcactgacgcattttctactgacgcattttccactgacgcattttccactgaccgattttccggtcacgttttaacctattgtagtaaatattttttctttaaattttggaatttgatcagcgcgaatatttcccagcgtgctgattgaattggtttaatttgatcagcacccaaaagttatgggtgtttgaattacaaaagatcaaaattatataaagcttcgtactggttaaaaaaatttaaaaatttacccaaatctctaaaaataaaatatactgcaaaatgaatttttgtgagcttgtttacataccaatgcccgctttaaaatttcaggtaataatactttcaacgccatttttgtcattatcagacatgggcatcgatgtcgaccttgtattgttgtttgttgttgctttcccctactcactaatctccaaatccaaatgccatgccacacatcgccggccggaggtgatgcgatcggcggaccggcaattagtaggggaaggaggacaacacagcgatggagcgatggcgctgcaatttgtgtgtgtgtgttgctcgcctcccccgcagtcgtcaccgccccgcggtggcgcggaattgatttatttggtaatggcaaggacagagcgggggggggggggagctatcttttcatatctatatgcaaagattgtttaaccatatttttacctgaataattaatttgaccaaaagtgattaactttccaaatatttaatgaatgaa

SEQ ID NO: 27847 - DNA, 1498 bp, Heterodera glycines
  misc_feature (1360)..(1360): n is a, c, g, or t
tcctattttggcaactcataaattgtgggccgattgatcggcagagtttgctgatcaatcaatcgttattaaaaagtgagtgagtgagtgcccttttcttacccaaaagctccttttggttgatccaactctgtgtgatcacattgtcccatttgaattggatttggccttcgattccctcggttaacttccaaatgaacaaaatgtttgggaatttgtccattgtgccggccaatgcttcgacgaattgcgcattgctgggcccggtaaaagcatcgtttgtgccaaaactgaccaaaacaacgccctcttttgtgcccaaactccgactgatcagtgaatttgtctgtcggattaggtttttgttggattagaatttaatctcactgctgaatgaaagaagctgacaggcgattaaaaggcacaagcaaatgtaatcgaagccaattttcaaagacactaattagtctcgagacggaaagtgttcgaaaattgaagaattattgagtcaagaacagaatgaatctcattaagcatggatctcatgacttttaatccattatttttatttaaattattttttttattttacattttccattgctttttcgtcaatttccgacggatggccaaaatttaagccgccaatgaatttgacccgttgatcgctcttcaaaattttggactgagcaaaatcaatttcgggcagcgaattgatgaagaaaaagcggctcttggcgaacagtgcgtcccaacccgggaaattcaaatggaatttttcctccgccaatttttggtactcagtgtccttaatttatgtatatttaatatttaatattatgattgttttccaccatatttatgtgttctttgattttggccaatgtttgctctacgcaattcctccaaacttcgtcccttctccacttcaattcctcggccatttgttcttttgtgcccatgtttagcagcttcatacgttccgcaccaaacatatttaatgtagaaattccgataaattctaaaatattcaaaagtgagacgaaaaataaaaatgtcccattaaaatttctcttttggtttgcataattttttgtgatttccccggggttttcggggcccctgatcacgaagctctctctctaactatttctcctctccccccccccccctctcactcctctctccatctttctcttttttctttctccgctctctctctctctctcactctctcctctatatatcattcgttttagctttttggcactttttacccgtcggcgttccctccgactttttcattttgctcaaatggcccatcaaatgcagctgaaacggcgacattggctgactttgngtggcgattgtgaccgcaatttgcaggaaatggaaaagtgccaatgaatactccgtcaagcagtatgcctctgccattcccacgtcgaacttttcggcacgtaatccgtccatcagttcaaagtcctcggcaatttct

SEQ ID NO: 27848 - DNA, 1594 bp, Heterodera glycines
  misc_feature (1377)..(1377): n is a, c, g, or t
  misc_feature (1402)..(1402): n is a, c, g, or t
  misc_feature (1504)..(1504): n is a, c, g, or t
  misc_feature (1521)..(1521): n is a, c, g, or t
  misc_feature (1569)..(1569): n is a, c, g, or t
ttgtgtcccatgcgggatgacagtctttggagagcatttctacggagtgccaatcgtttgtgtgccgttcatcggggaccaattttacaacgcggaattgatggcatttcggcacattgggctggcagttgacagggaaaatgaccagcaaacagtgcaaaatgatctgatcggtgcattgtcagaggcattgggacggcagcagcggaaaaagtgaaaaaatttaaaataaaaaatgtgatttttaaaaacaattagcaatgactcggccgcgcactttgatttggccaaatttaaagctgtaagcgcggcatttcgccaaaagaatgtggcaaaaacaatcgctgacgcaatgaaagaaattgaaaaagaaattggccagcaggaaaaataagccattgaatttgaaaaatgtatagaatttaaattatgcagaattatattattctctgcccggcttagttacgctagtcaatccgaattgtcattttttgattcaaagataaattaaatcgccaaatttgaaaatagtttaaaaatgtaaaaaattaagagatataaaatttacgaaattctctaaattgaataattcccttataaatttttaccatttttagggtttaaaaagttcaattcagctgaggtggtctttctaatagagaagatctttgaaaattaatttttgaaataaataaacttttaaacttaaatgtcattacatacatttttttctcctcctttccatatgattttaaaaaatcgataaattccagacagtttatcgtaacgtgagagtcattagtgcgtgtgacacttttattataattaccaccaaaatttaaagcttttttggttgctttttattttgtgcgaaaaattgagacatttaaatgagtcagcgaattgctacttgctaatttgaaaatgtgttcattttaattcaaaaaattttagtcaaattaaattaaatttctttatctggaaagatttttgatttaattttttaaataattaaaaaacattttcaatttttgtccatcactgcacatgcataattcatatcaaaattattattttttttaatgaatctgtctgtagctttttttaattataagctttttcaagaaaaccctaattttgtacaaaataattattgcaattactcaaattatgccgtgaaaatgatgaattaaatcaaaaggatatcaagcccatcattaaatttaagcgcccattaccatgccattgactttaactagcggaaacggcacagaaaaaaagtaattaaaaatataaaacacctgctgtgaagattactttaacacttatctcgttaatgttaattgtattaatttaaaattcaatttaagctcacgnaaattgcagcaattatttggcgtanaagaaatcatttaatttttttatcgctttattaaattccgaaaatcgcaaatgaaatgggcaacaaattgaaggactaaatgaaaattatttcctatatcangtaaagtttaattgggntctttcatttacgtagccaatgctttttcagctgtgggtcaatacaangactctgggcattccccatgctcat

SEQ ID NO: 27849 - DNA, 1558 bp, Heterodera glycines
  misc_feature (35)..(35): n is a, c, g, or t
  misc_feature (55)..(55): n is a, c, g, or t
  misc_feature (109)..(109): n is a, c, g, or t
ctgaggcccgtggagcatatgcaactcagagtacngagcagtacttctggacacnccgaaggaacgtcgtttggaggtgttttttattgacaaataaattcaattcaanaggggtgatatgattaatatttttataaattaaagcatttcgatgctctgaaaactccgcaggaatgctttcacattattttttcgttcagggcgattggtcacccgtcgggtcgacttgtactttatgtgctcctccgtcagctccacaaaacctacggctgtcatcagaattcgacattgctgtggggagcggggaaagcagttcaaaggcaacgacagcattccacgaagacggccaatggcactccgttggcatttgttgggaagccccggcgcaaatgaatggtgccattgtcggtggatactcaattcgtatccaaaggtacacagagcaaaacaaactgttgtcatttattctcattgtcaggttcgatctgtcctcttctgctggtgttacgaaatcggcggatgcaaataatgagaaagcatcggatgagcaaatgcatcacatttctggcactgagtgccgcttcaatatgcagcatcttcgtccagctcagctgtaccgcttggcagttacggcacagagtgacgccggcccatcgccaaaatcggatattttggagtaccgaagtccgccgggagtacccgagaagcccagaaatgtgcacatcgaagtgattcttaaatctgaattttaacaaaaaatgaattttcttattaaggcaataagtacgacggaattgcggctcagttggatggagccgtccacagccaatggctctccgattgtctcttaccacgtgaactgcttcagattgtactcaaattctcgtcatcaactgcaaaacaacttagcagtagcaacagcattttcgagcagcaaacggcaactcgttagccaacaagtggaccatactttgttataaaattcattttatgtgctttttaacacagattgcccccggctctcaacggttgttgatcatacaatcgctggaagccgaaacggaatacgaattgaccattgaggcagaaaattctgtcggaaaaggcgaccgagtaatcattcgggtaaaaattggtaaatcggccgtgttaattataaatattcttcagcaaaaaactctcgtcgaaccgccagaaccaccacaaattttccttgcccaagcaactgcgaattcgttgaaattgaaatggagtgacggtggaggtacggacatttgaattggtaattactgtaaaactgcatcgttccattttcagaaaacaacagttccatcggtgcaaacggtcacggcaattattattactatttggagagggaaaatgagaacggcacttattcgcccgtttatgaagtgattattttttacttaattacttgctaccctttggtgttttattttcttttcggattccaaattttttgcgtttattattttgtctatatttttgcaaataaaccaaatttagggtgaactccgcactgcgcgactgaggggac

SEQ ID NO: 27850 - DNA, 685 bp, Heterodera glycines
  misc_feature (668)..(668): n is a, c, g, or t
tgattgggcacttcgacactttgtccatccgacgacccctcaggggataatataattggaaggagggaactcatcagtgaatgtccccacgtccactcaaatgtccgcagcccttcccattagcatttgtccgcctaagatgagaacctcccacaaccaatcgattctctccccctggcgagtgtttgcgcccaccggcgactccctcaaaccgcggcctcccctcggccacccctccgtccaccccaactcatccgacgcaaacgaacgaacgatggagggttttcagatgcgaagacccccctgccccgcaccaatttctcgtcatcttcgacttcatccgcaatttggtccctcaatcgctgcgatgttcagtgccctcccctcccctccccctttccccgcgttcccttcggcgccgctctttcctcccttttcaattgcagtgtttctgctgctgatgatgagctgatgatgaatggatgggtggtgctgctgctgttggtggtcgtcgttgtcgtccacccgacaaaatcaacagcagaagcaaagcagcagcacccattctccaaatcccccgccgtccgtcttcatcgattttctgtgctgaagatggtcgtcctcccctccactcatgctgctgctctcatcgtcgggtccggtctgcnccaccttggtcctcccc

SEQ ID NO: 27851 - DNA, 849 bp, Heterodera glycines
ctacgtgatattttttagttcaaataattagttcaaactttctgagaattaatctcttgtttttgttcgtatgtatctgttttattttttttaaataaaattgaattcataataattatttgatataataatgataattttaatatattaccaaataattttcggtttattcaaaaaattgtgcaattttttaaataattaattaaattttaatttttgtcaatgttaattcaatgttgtaaaatttttaatatattttatcatgagatcatacagttgcagttgcacacgagagcatcagcggagttaaagcgattttgttatttattctttttgttttttataatttcgttttcatttatcatatttttgctttgtttaataaatttttaatttttaggtatttttaacattttttaatataatttagattgatatattaattaattaattattttgaaaaaaaactttttttttaattgtgattttttccatctcgccatttttatttaattaaaagtccatttacggattttatgccaaaaaatttgcgaaagtattaaatgatgccgaaagaagaggaaataccatcgggctggacaatccgacagtaaaacacacaaaaatttattaaaatgccatcgccgcatgggacagattgtgctgcaaccatcctttacgaaatgccaaacccaaactaattttcagcgaaacaatgttttagactgcattcttacttttttatttgcttattttccttttttgttgataaggcacaattggtcccctgcggcgatggcattttattatattttgtgtattttactgtcggattgtctactgtccgat

SEQ ID NO: 27852 - DNA, 1206 bp, Heterodera glycines
aattcaaaaatgtaattaaaaatcagaatttagtttgaacattttttattttatgaaaacgaatgatatgtagtcaaattgggacaatcggcccatggggggagggggcgaatattacgaaaaaagatgtaatcgctcgctccccgcggtgaccaaaagccgacaaaggaaagtgagttttttcccctccctttttttggggggggggggcgccaaatttggtaaggaatggcgcgtggcttatgtgttttgtgtgaggattggataccattcgcccattctgttcaatgccaaaggcatcaaagaaaaaacatttgtacgaaaatgaaaagcgatgcctttctttgtccattccccgcggggtttttaaaaaacgaaaaaagaaaattaccgaaaagaagacaaatttgaagaaaggcgcaaatataacgccaaaggaaaaatgggaaaaaattaaacaaattgaatttttattggattgatttaatgtctttgcgatgccaaaaggcgaacgaaaggcaattctttgcttcatctgaagtggcgtggagtggttgggttggctgggattggccggccttctcatccatccgatgctcccattttcagatacatttccatagctaatccctcctccccccccactccggtgatgtaatcccccgggctaatccaattgccattgcgtggacaaacacttggtgagattgaagaaattgggaactggaacgggaaaaaatcttctgttttccattgctctctctctctctccaccatcttttttatggtctctctttttcctctctatctctctctcttctctttttcttttctcgtctcttttcctccctgttcggtcactctctttctcttactctctcatcttttcccatttgttcattctttgtccccacatttaaaatgcccgccaaaattgactggcaatgccaatgctaatgccaacctttttttccctcccttttcctctctctctttttcattccttttgatgaccgttctcgtcttgtctccagagcaaccatccggaagtgaatgaattgacgggagtgaccgtaaaaatgggggcataaatgaatgagaccaatgggacgaacggggatgatagatcgaatggaaaaggggcgaggggggcgggagaggcataaagggaccaccaaagggttaatggatgatgaggaggaaaga

SEQ ID NO: 27853 - DNA, 1486 bp, Heterodera glycines
  misc_feature (27)..(27): n is a, c, g, or t
  misc_feature (196)..(196): n is a, c, g, or t
  misc_feature (1471)..(1471): n is a, c, g, or t
ctagtgggagaattggcactgatcagngaaagtgatcaatggaaggactgaatgatcagattgaggactgatcagggagaggactgatcaacgggggactgattactcgagggacagatcagtgggggaaaactcaggtggtaagagtgatcaggcagagacactttgcagatggctccgaagtgcctgcggtgcntccgtcgggaatgattcgtcgcggctttcgcgacttttccatcgactacaccattctgatcatcattgtgatcgcacttctctttctgctcgtcgtcacgtgcgtcgtttaccaaaagttcaaagaccgcaacaatcgcgtggtgaacgtggacatgaaccaacgattggtgcagcagcaacagcaacaacagcagaaggagagcgatcgaggagttggaggagggcgaaatttaatgggcggaaaggtaaaaacggagggggtgggataaaaacggcataatgccattggaacaaaagcaattagccaggaaggggaagatagacggggcgaaaccaatcataggcattggttaatttggctaattaatcacgacagactccgcccatgagagtgacgtcatccgccgcgcacaaagggacggtggccactgcggcattggccaaagagagggcattggcatatgcgcggaacgcggcgagcgcacagccgccgccgttggagtcgcaggaaagcgcactttcatttccaatgcaacagctgcaaatggcagcgatggaactgaacgtaaatgcggaacaaaaacaaaaaatgtgaaaaagagcgacggatggcaccgaaaaagcgtcaaatttttattactttggtcacatttatgccaaatttatatcagcaaaaaataatttcaagatttcattaaaagccaaacgaaaacattcaatggcaaaaggaaccgacggacagtcgccaatggcacgcgccgaacgaagaacagccgacggaagcgaacaaaaggcagtcaccacgcattcgactgagtccgaatcagccgcaagaaggggaggaggaggaacaagaagggaagagagacaatggagatgaggagggggaagagagacgcaatttgggatacgagccaaaactcggaagaggaggaggaggagacggaagcggaccaggagcaggggcaggacgagaagcagcggatggcgaggaggagcatggcggacattgaagcggcattgggcaacggaacggacgaagaaattggaaggcattgggacggaaaagagcatcaagtgattggaagggagaggggaaaagaggagggtaccaagggggccgatggatgggggggagggaagtgaaagtttgacacattgtatggaacgagttaagaatgtcgaaaacgaaaacgaaggcgtaggcgcagagcgcgagtcgttgtccgaatcattgggcgaattccgctggggtggcgccggttgcctggtngtgcctttccgtccg

SEQ ID NO: 27854 - DNA, 1145 bp, Heterodera glycines
acgttgagacaatctcgacaagcgttaacagttcttcacaaccggcactgttcacaaatgacggcgcttcttctccgacgatgtctttcccaacgttcttcaaatagttcgtagtatgtgcacaacccgctcaccgatcttctgttcccgcttaaccatttttgggggcaaaaatgattctctcctcgtcgtctgggaaaatgtttgtccttaggcgtataatgttgtctctgttcgcgtggagagtcaccaacaggtaaccgtacggcagagcacatgcctgtcggtaggcatccatcaggaatccctgctcgcgagggaacatctggttggccaaattacgaatgctaagcatgtcgttgggagcccgcatcaggaagatgtactgggcgttggaccttggcacccgcattgatttatcgaacaggttttgcgtgaggaaaatcacggaaaaattgttatggtgtgactttttggtgtacagatcggccaatttcttggcctcaatgtcacccatcaagtcatcgtaaacaatcagacaaggctttggcagctttttcagcatctcgtcagacggggcacctgcgtgggggacaactccctgccgctccagatcgggaatctgcgtcgagtactcaccgtatgcccatactaaatagcaacagcccactgcacagaaaccccctttgcacatacctattgccttgggcggcgggtcaaacatcacgttggcatgccgtaacaggcgaaggaccagctgggtcttgcccgaagaggacggcccactgacaataatccccgaagggatgggaaaagcgagttcactttcatttattcttgggtagtccatcagaatatcaacaatagaaaaatggacaagtgtttatgccatctgagtcatttccttttgttcttttacgccttcttccaagcttgggccggtggcgtgcacctccgggtgtcgcagcggcagcgtgaacaccttgttccgggccctaatgcggaatttcgcacgatcggcaaagtccacttaagaaaagagtcaaactctgacatacacctgcagcttaccaattgcatcaaacggcacaaagttctcgccgtcaaaaatagccgattcgaaaagatggtcaccccctcgggct

SEQ ID NO: 27855 - DNA, 1994 bp, Heterodera glycines
tgccgtcgtcgtggtggcgacggcgttcggcaacagcagcacggcggtcttgtcaccgcgcccgctgctactgcgcatgatggatgattgagctacttcttcagctcataagcggtgaacacaccggtgccacagatggcctcgctgctgtcgtcggagacggtcacatcatggatgtcatcatggtcgtcgtctttgtgtcaaaaatggccggatttctccattggatcagatcgattccgggtctcgaggcttcaggtgttttatgaaaagttatttttttttatgagtggaataatgcaagtctctgtcacgtatcagctaggaaacgttcacaaaaaagaccaaggtcaaatatttctgccaaaaattcgttggaaaactttttgcgcttatcttagtgtagaacaaaatatttggttaagtatagtcttaattatctttaaattgttgggaaagggctcccaaagaacttttgatgattggtgaaactaaaactttagtatatttgtttacggaattttgacgtttttgggtaagctcggccgatagttagttgtacgtctttgggttattcaattgtgatttcgcaacttttgagtgatcggagcactgacaaagactgaaaataatgactgatcatttcgcgttttttcttgcaattgaattcacattcttagcactggcatgacaaatgcaaaaagtgtgaaaaccccccaaaatcagaggtcagccggggatggatgcgtggagcgcatttatcatttccatcattttggacaggttatttggtgggccaagaatttgcatgggcaaattcgaaattggcgacacggggcagcccccgggggggggggggggggagtggtgtcaattagggtaatcggttaagaccaaaaaccacactcatcaacatatcaccatcatcatcattaacagttaattggtatgaactttccaaaaataacggtcaattataaataaattaagaaataatgactaattaatttttaaaaatacggagattttgacgaacattaaatttaaaaaacataagttaaatttattataacaatgctttcaaagcttggccatcagagttcgatttggtttgtctttcttttgctgacaaatgtttgaattttgtaaagtcggctcttttttagcaaagctttaccttaaacaaattcaattttaatatacttaaaaattattaaaataatttgtgttcgcatttatatttctatcgataaattaattattcatatttaaattaacaaaacacaacgatttgtcgggtaatttccatttttatgaatcattccattggaaaaagcacagcaaaatcatattgtcttcttctccattagatatttaaaaaattatattaataaaagtgcttttgacaaaataaatattttaagtaattaaattatttagtttttcccaaaattaccaataattcttttttttttccctttttttcgaatgtcgtccgattttctcagcgtttttcgcattaatttttacatttttctgcttttgataagtggtaaattgccctttaaatttactttaatgttctccctttccaagtcggaaatggccatgccaatggcaacggatggcatgcgccgaaggaatggaccgactcaaatgtttacggtatgccaaagtcggagcattagccaaatatttaaaatccttccgcaaatgctcattggcattttcattagttttgttttgtctctttcttttggcatttccatcgttcgctttgcttttgcgcagattccctccgttgtgggcttttcctcaaagtcgaaacggatgaaaagcaattgcaaaatgccaaacgtttctttccgacgggcggcgaagagttttccttcagaataatggggggagagaatgttgaggagggcatttcgccatggacggcggcaatctttcgtcaaaagaaagacaaagggaggcaatggggaatgaatttc

SEQ ID NO: 27856 - DNA, 952 bp, Heterodera glycines
cggccacttaaaaaaattattttttttgttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatttttccttatattttggttatatcgttttgcttttggtggggtgcttggaacagtggaatcatgcgcacccgtccgatctggcaagttaagcaacgattgctgactagccaaaaaattcggtgccgtgatgaaacgaaccagcactgcttaccccg

SEQ ID NO: 27857 - DNA, 1316 bp, Heterodera glycines
ttccgctgtttgtcttcatattcggtcattagacgaaatgtctcaaattcaatttttttgtttttatctgaaaatgcaaaaattataaaaaaaaaatattattgagaatgtcttctgaaagtttttgtccttgtgccgatttgcgtgtgccatgccatgttttttcggggtgtttctcttctcaacaggtgcttagcttgggctgtaccttttgctgccagtcgcttcgtccgccaaccgacctactcatcccccgcccgcggcgcctttcccttcgcccctttctccccattttcctcataaatctcttccattctcttcgtctgttcattggatgagaagagaggggcgaagaaaaagagataattgccgaggaccgacccgaaattgggaggaagcgaaggacggactcttcctaagagcgcatccggcccaagaaggtttggccacaaaagatgctcggttggaaggaaggggagaaagaatggaaggggagggtgaagggaagggaatgaatggaggcggaagatgccgcgggatggccaaggccatcaatcatcgcggttggacgcatccgaatgggcggcaggggcggcaatttgttgccgaggtgaagaagatgagggagaggaagccgagttgaggcggaaggggcgggcgtaagggtgggggggggggtgtggagagaaaattgaaacgcacaactcaggaaaatcccaattcggaaccaaaaccaaaatttcctttttgcaatgccataacttgtgatcgctctctccgttgattaccaaagtcaaatccctctcttcaatctccatccatcccttttgcgtccccatttttctgctgtatttctcatcactttattttttctctgcgggaatattctcgacaaacatttgcctgggggaaggatcggatgaaaaaagagaagagaccgaagaaaagatggagaaaaaggaaacggagaagagaaaggggaagggcaagtgatgatgtgccgcaggtggaaaggcagaggctgggagcagaggaggaataatataattggccttggtcctttgggccaattagatgggacggatcggaattcactctctccaatatggcgggcggacaaaccccaaaggtgcgcccgagggcaaacaacggccgacggagaataccctcgggggaagggatgaaaatgatgagcaaaagggggggagggtgtccattaacggatggacggaaggaagaatggaagaacgaatttgaagatgcgaataagaagggcaagtcaattaattcgtcacaatttggggtgaccctaacgg

SEQ ID NO: 27858 - DNA, 1711 bp, Heterodera glycines
  misc_feature (55)..(55): n is a, c, g, or t
  misc_feature (90)..(90): n is a, c, g, or t
catggctttagcatgaggatggtgttgtgcatgtgcacaatggccacgactgtgnggaggtcgccttggaagtggcttttttccgacccnggcgaaattgaggcaaaaaaatgccattaattttttcaaatttgccaatgttaataatggtgtaaaacttatacagataaatctgtcgggtgaccatctgttcattttctgccaccatgaagaacggggcgacgaacacgggtgggtgaagagggaaatgcaccggagctaccgagtgccggaggacgtggacacgggcacaatccgatcgcattactcctggaacggcattttgcagctgaaggcgctgaagaagaacgcgacgtcaaggtcgatcagggagattatggagaatttaaaagataaaaacagaaaacatatctaaaaacttagtttgccttttttgtattcgaaaaactaaaattggcattttttgggttttacattaataatttatgtcattttaatttttcatacctttgatcagtttttttgtccattcaaattctaatcccagtcaaatttattggatgatttttaaagacgttcaagcatcgacgtggaagtggtcgcggaggaaaagccgaaaaagaaaaaagtggcacagaaaatgaaatacggcgcagcggccattgaaaagccgggcaaaaatgtgttggtggaagtggaaaatgccaaaaatggaggtaggaaaagcgatagagcaacccaaatttttttttttggccctatagaaaggcaacgaaaccgaagacacagcattttcgccacagccgaacacttttgcgcgcctcagcaaatgccattgggccctttcggatggtcggcaaaaaattttattcgcttttaaaatttcataattattcttcccaattttaggagctggtataacgttgccttaaatgctgccaaaagctgctgatgaacaccaaaagtgaacacattttgagatgggagtgactgacaatgatgaaatttgatgagaaataatattaattgcaattagtcggtattttgacatgcaaattgtcgtacttaatgtatttattgaaataaagattgaagattctctaaccgagtgattttctctctcggtcaaatgactctcgggtctctttcgggctcgattcccggaaaattcgacactcgactagctcaatggcaaattagcataccattaaagtatcaaattaaatcacaccgcataaacacaaggaaaaaaattacaattaaaggggaattaaattcggattgccggggggggggggggaattgctcatttcgctcttgtcattaaaatgtttatttagaaagggggaaaactcgctttgttcacacctttgttattgtacataaatgcgcattgcataagtgctgcatgtgcatcaggggtgtgacttgtctcagaaaagacgagagcgagagtttggcgagaggcgagagtccccaaaaagacgagagcgagagtttggcgagaggcgagagtccccaaaaagacgagagcgagagtttggcgagaggcgagagtccccaaaaagacgagagcgagagtttggcgagaggcgagagtccccaaaaacacgagagttggcgagaggcgagaggacgagaggcgagagtttttcaattttttctgtagccttatttttaatttaaaaaacttcaaaatcgtatattaaat

SEQ ID NO: 27859 - DNA, 1026 bp, Heterodera glycines
  misc_feature (942)..(942): n is a, c, g, or t
  misc_feature (987)..(987): n is a, c, g, or t
ttctcacgccggtgggacgtactccgacttctgagccttcgtgttgttgctgttgttcgtcctccttcgtcttcttgtgttgcggtgtctgtggcgtttgctgttcggcttccctcgcctccttttagcgttcgttgttccttcctgcgctctgctcggtcctttaaacttggtgtaaagtttaacgaaaattgatgggatggacttaatgccaagtgccattgcccttcaaatatggggtgcacttcatttccgccccgtatcattccccccgcaaggggggagggtcaaggtcgaacgtaagaccccttcactgacgcatcccttgcacatgtagtatattttatgcgcatatttgtttgtcattttagtgcatacaacttcaaacccttttggtgcaaaattagttaaaaatttcattttaaaaacggaataaatttaaatttggacaaatacagttttaaaagattaatgccgcaggaatctataaacatttgttggtattattgtactaacagtattcctttatttttataagaaaaaagagtttcatcatttttgtcataatttaaagtctaaaaatatttctttcattcttaaatcaattttttttcattttacagctgtttcaaatagggttaattcagtccggggtcgggtggcaatgtccggcttagttggatctcggcaccagacccaaattagcccattgaaaaggataaatttggaccatagctaaacaggcattgagctttcaaataataatgaatgtatgttgaagcattgttagtaaaaaattattccttcaaaagatcgaatttgaatttggggccaaagttggccttgactttgtccatgcgccaatgcaaagtgacggtggggtaaaggtcggtggttttgtcaacgaacatgtccgttgtgtctgaaaggcatttcaattgntgtcctccgtttacgcttttcctaatgccccacccatcgctgtcncgtgagcgtgtaaatcatttgccgcgttgccattttaac

SEQ ID NO: 27860 - DNA, 1125 bp, Heterodera glycines
caatttcgtccttataaatcataaatattaaatagaaaaaaaggaattctacccatcaattgatacagtattcagtttgaaaacaccgtattgcataaatacagtaatccaacacagaaaattgccgaattttcagaggctcatcagtcccctcatcaccttaatggacggatgggaagtgagtgtggcgcctctggccacattgtgggccaccagcgcaagcggtgagccacaaattgcgcccaccaccgcattcgcttcctgatgcttgcgcaacacatcgccaacccgggggtcctggaaaaaatttaaaacatttttttttaaataaaacagtcaaattttttaatgagtttgtgttgttaaatcttaacgagattgtgttgtcaatgttctgtacttgaaattcaaagaacgtgcttggatttcggctttcatattagaataagtgttgaaatttaagagactaattgtctttaaaaaacacgaacaaaggaaatttattcgaaaacggtaggtttgttagtgtactgtaggaatacaggtgctgctgcacatgcatacagtaatccaccagcaaaaaaaaatcgaaaaattacattgcaagctgtaaaacttggttctattctttgttgaagaaactgttactatattaaataagtgctttcaaagcggtaccgtaacatgatgaaccgtataaaccaagtgctttcaaatcagtaccgtaacagtaagacgtaaaggaaaaacggttcttgtcacatttgagatgggagcacccttttgttaatgtgtcgccacccccgccaataagacagtattacaggaaaaataataccgtaaccccattgattcttattcagcggtattaccgtaacctatgagacagtttttctttcactcacttccgccaatttgttcgagccgggactgcctccgggcatcaccacagcgtcgtacttcttgtcaaggacgtccttgaacatttggtcaacgtgcaaatgcgtcttgcatgtcagctcaatctcgggcttgtcctgcacaaaaaaaagaaaaatgccgaatgattcgtcattttttcatattatgatttttaattggtcttaaatagcaatcgctcggatt

SEQ ID NO: 27861 - DNA, 1323 bp, Heterodera glycines
tacactttttgaggagatccgggaaaactatagagaaaaattcagtgcggacgactgagtcccgggaagtgatttctcattttttcgtgcatttgggggcccgtaactttttttctaaaacccgaatcaaaaagtttccgctggtagggacctaagttgaagtgttttctaaaaaacaaaaaaaattccaagcctctatctgcaataggaaaggctgtaggttcgtgaactttttcagtaccaactttgtccagttcagtcccggttgaataactcattagggtttgatctgagcggggggtcgccagcggtactattgtagagcttgaaaagcttgatttttccaaatttaaaaatttcaaaaattttcaaaatttttcgagctaggcctaaaaaactgttttcgggtttttgaattttaggattttttaacgatttttcccagagaaacggagaccacttccaaaacatagtttttcgagctctatcgattggtggatttttgaaaaaatttcgatttttttccggaaatagaaaaaatttttgacctgagcgggacatttgagtcccgggtccataactcgttaggagttggttttagccaaaaatggccttagagcaaaattgtagagctttcgaaactctatcgaatcatgtgcaacatgttcggaaattttcaaaaattttcgagctaggccccctagaaattttcgaaattttttttgtgggccaaaatgggggtgaaaatttttttttctggggtattttgaggtgctgagcacgaatatgatgtttgttttccgtttcggaaattttagaattttttaaaaattctttattttttggcaattttttggccctcgggattttggcctaatatttgaaaattcataacaaatcgaagggttgatcaattttacaggaataaagcctaaaaaatagagaaaaatcaggagaattttatgggatttatttgggttttctaacttcaatatgaaaaaaagttattccagaaattctggaaatttaagatttttcagaaaaaaattcagaactcgcttctgaaaagtcattctgtaaaagtaaaatactacaaaaatccgcaattttttgctctattatataaattttattttaaatttttatccctttttaaaaaaaagttataaaaataaaatgattttaggattcgggaccaaaggggggtgaccaggatttttgagtgaaaaaattttttcaccgaaaatattccaaaaacatgtctttaggggtagtttatgacgctgatcacgaatacgtgatcacatttttcttttgacatcg

SEQ ID NO: 27862 - DNA, 1849 bp, Heterodera glycines
  misc_feature (1811)..(1811): n is a, c, g, or t
  misc_feature (1825)..(1826): n is a, c, g, or t
  misc_feature (1839)..(1839): n is a, c, g, or t
aaaatatacataaaaattttaaatcattatttaaatgttttgtcaatttttcatttttatttatctcttttattgtgtttttgaaagacaaattttttaattgctttttttttgctgtgattattttttttgtaacttttagaattttttaatatatttcattctattttcacacattttgtttcgaacccatcaacgagtaatttttagagtttaaacttttgaattttgctttacatctaattttatcttgcaaaatctctcctgttttctttattttttatttttacattaaatttttactattttgtctttaattatattactcttctactgtttttctcatgcccatgcatttgcttgctttctgataacattttcatttttcgctaatatttattgagtgcgtttctcttaagaaaaatgattagatttttatattcttctatagatttattacttgctgtagcatgatttaaattttattttttccactttaatataaagaaattacgttcaaaattgaacaactggcttgttctcggaactacaattttctcgatgtcttgctgtgccttatgcatgttttaaatttgcatggtgctaaattttgatcggaatattattagttatgagtacatttttttgccctaaaattgccccaaccccgcacaccccaccatgaacccgcgaatcatcgagagaaaatccccacagggctggtgaaaaaagcggtgaaaaaaggtgaaaaaacatggtgaaaagaggtgaaaaaacgcagggataaaggtgaaatttaagggtgaaaaccttataggggaggggggttattgacagccatacgtgcaagggtataagggtgccccgcttcataccaccacctaaacccatatcctggttcacccctttttcatgtaattgattataaataaaaatttgctaatcttttcgttatttgtgaaaataattaaacaacttttaatcaattctttggtcccccgttttccaattttccattttttgttgcccgctcccctctccttctgccccccccccctccttccgccgcccgctcaatatctccgattttgatctaaaaatttattttaaatttcgtatttattcttcgcaaccaaagcgttcccatggcgtagtagttatgcgctcggttcgctctctcagcgttggtgttcgagttaagcccctgagggatggcgtgtttggggttcacgccttcgaacgtcccccatgcgcaccttcgctgagagggacgagcccagctcggacatggtggtaatgcataatgaacccagttgaggaccagtccaagacaagggggttccactatttttctatttttctctattatttcattttgtataagatttttgttaaagttaaagaaattaatagtagtatagagaaacgcaaactatttgtgtgaacaaaagtgagtgataaggcataaatctaatattttattaacaaaaaaataaattccaaaatatacgcataaaattattaaaaccaacaaacgacaaccaattatccaaattagcagtttataatatcacaaagtaaatactcagtctcgaaagatcccttgataaataaattggtcaatataactcagttttataataagtatatacccgatacgccttggcattcgctcttacacgtattatatgtagattatccatgttgaggatttcgattttgtttagcttaaagataaatacattttttgtttaagatactatagtcactatttcccgttcatcctcaaagttaaattcttgggtaggcantagcactgaaaganngtttcctcataantattttcaaa

SEQ ID NO: 27863 - DNA, 1031 bp, Heterodera glycines
caaatgaattttattatagcaaaattaaactgaacatattaatacatatagaaagggtgataaataaaataaaaaagttgcaaattcatttaaagttttacaaattcacaatggtattggtggacatattaggcaatgctaaagttttcacagtacacacttaaattttcctatttgtcttttttttaattcgtctacagcctactgtaccacgcaaaaaacaccttattccaagccagtgcccattcagcaaggcatgagccaattaatgttgcatgtagtaattggtcaatgccttgcagtatggacattgacttgggttaggtgagttttgcagatggtacaacaggcaacttcggcaaaggccaacatgcccacaacttccaaaaaatgaggcctcatcaattgaacaaagacacataccaaatttgttcgaatagaacaattttgatgggattttgcatccatcctccggatcaccccagcggaacagcgaacgggaatcaccgcctggctgaacagccgcctcaaatggagttgtggcaaacacattttgcgcagtctgcttgcggttcaatgggccgaattccaacgatagtcggccatgcggctttccgattcgtgccaggtcatggttttatttcttaataattagggaaacgcaatgagacccccccccccgccccctcccgattgggtcgagagcatttttaaattgaaaaattttaaaatgatttggctttaatagcggagaaacaaaggcgcttgttttggcgcaatttgggcggggcttaacacaaagataatgagttcacccgtcgttttacgacaatcatttgcaattttttttaaatggttttggtcagcaaatattgcgcgccaattttttgattgttctcctaaaacacttcacgatcgtctaaaccatcctgaagatcgggaacgcgcacctgaaagaattgacccggaaaaaaattcaaacaaccctaaaagaccgaaatggcatgcgcaaaatttcttttttgatggga

SEQ ID NO: 27864 - DNA, 2058 bp, Heterodera glycines
ctatttatattaatggggatttataaaattatttatatttatactcataattatttttatgctgttttttataatagatgtaattgcaagttttcttcttaaatcatctatgtagatcaaaggcaattcttcaattgttttaaactatctggtttttttgattttccaataattaaagttggattattatattaattctagtccacttacactacgtcacactcaatgttgttaagtgaatttttatgctttaatataaaaaaaaactttgcgattccagaactgaatcaatgattgttctgtttcttcctgaagaaatttattttagatgatataaaatttttttatattaattaattatttgccttaattatttttacattatttatataattgtttatacccaaaatagcacaattttaattagtttactttaaacaataaaatataataaataattaaaactaataaatattagttttttttaaatttaatagattcttatttttgctaccattaaataatttaaatagttgctatttcggataaaagatatttaattttttacgcctttaatgtgacgagccgatttgggcggaaatggctgggtccaaattttaaagaaattaaagcgccgtttcaaaaattttgttctccaccaaaatacatgaactctcatatttttatattaattgtttttaagtaaatccatgtgacccatccagtatttcaggttcagaatttattttaatatttaatattaagctcttattgctgcaatttatataatttctttttgatgaagtttttggtacattaatttatggtcatctttaatatatttataaaattatattttgaaaaatgaatgatgttcattatcacttagttataagtttaaaaatttatcaataaagtaatagagactttaaaatttttataaataaattaaataacctcgcgcggcttgagtccggtttgtttcgatggagaaatcctttctccgaattaatattactattttcttttatattttaattcacttgaattttatagtgcttgggttttttcattgcttttttagttaacaagtcattaaacaacaataaatctgaatcacctaataaaatttatccagatgaattacttacaaagacgataatttgttatatttggcattataaaaattttgccatttttactaaaatcagtgtttattatatttaaaaatttatatattttttcactaagatatataattaaaaatctcgttttatatattttatatttattattttcttgaaatacatccctttaggtatagctttcgcaacttatgcctcgaattcatttatttacatcttcacaaaaatagattaagttttatttttaataattatttttttcaaaacattcattagtttattactcgtctagaaattaataaatttgtgccaatgagctaacatttcctttataaaattctcttagcaaatatttaactttttaaatcaaaaattttgtcaagaaaaaaaatttgagggaataatttttgagaaaatttttcatttcataggaatgtattttttaaaaaattttcggtcgattcttatgggtgtatttttctgaaatttttggggtcaattcttataggtgttttttcattaacccaagcaatctacaattataaagttaaaatttttagtaaataattttttagaacgatggttgaatgtacagcaattagtacttaatttttccattttttgaaaacgattattatcatattgatgataaaaaatatcaactttttaaattttttagtgtattttatcactaattacttttttaagaagatttttatatttaaccaagtaatgtatataggaaaatattagtacggcggttaattttcatacggatttttatacattttttaacgattccgttaccttaaatttattcttccaaatttaaaaatattcaatttttgtaattttacattgttataaacaaccgtaaattgttaaatatatttaaaattttttcgtacaattt

SEQ ID NO: 27865 - DNA, 811 bp, Heterodera glycines
tttctttcctccccctctccatccattctcttcactttttatctcttttcttttcctcttttccccctcttcttttattttcacttcctctcttccctcctcttcttgttcctcctcttctcttcccttcctctcttctcctcccatcccctctcttcccgtcacttctcttttcttccctccccctctccatccattctcttcactttttatctcttttcttttcttcttttccccctcttcttttattttcacttcctctcttccctcctcttcttgttcctcctcttctcttcccttcctctcttctcctcccatcccctctcttcccgtcacttctcttttcttccctccccctctccatccattctcttcactttttatctcttttcttttcttcttttccccctcttcttttattttcacttcctctcttccctcctcttcttgttcctcctcttctcttcccttcctctcttctcctcccatcccctctcttcccgtcacttctcttttcttccctccccctctccatccattctcttcactttttatctcttttcttttcttcttttccccctcttcttttattttcacttcctctcttccctcctcttcttgttcctcctcttctcttcccttcctctcttctcctcccatcccctctcttcccgtcacttctcttttcttccctccccctctccatccattctcttcactttttatctcttttcttttcttcttttccccctcttcttttattttcacttcctctcttccctcctcttcttgatcctcctactctcttccc

SEQ ID NO: 27866 - DNA, 992 bp, Heterodera glycines
  misc_feature (14)..(15): n is a, c, g, or t
tgcccaaagaattnntaattttttataaaaatgggctttttttactttcgtatgcaaataccgatttccaattacaatattggaataaacacagttaaaattttccaagcatgaaagccgaaatcaaagcacgtactttggcatccaaatacgagtccaatgccaagattaattaatttgataattggattatagccaaactgtgcacttctgcttttcctctgtttgtctttgtgtcccattttcttgagcattttcccattctctctctcttttcacccactctctcccactttctcttccactctgtctatctctctccctctttctctttcattctgtctatctctctctcccacactctccttgtgccctttgcctttatatggctgcatccatcggctttagccctgctgcttttctttggcggcaccacagatgcagcagtgccaatgcgtcaatgccattttggtggtcaaacgactacggcattggcttaacatcatttaagtgtatgcaaacattgcgcttgcggtgcgtgggttaaatacgtataaaaagcggcttccaatgggtcagagactcttctctctttctctcttctgactatgcgtgagtaaaaaaaaaggagaaaagagtaagcgcagatgccgtctcgtctctttctggtttgcctggggcacggcattttctgcttttcctccgcctgcactcacttctttcggcatttcctttggtttcttctcctgcttcttccaatgcttttccttttcctatttcagtttctttttatgcttcttctttttcttctgctctctctgccctcccaatttgttcgcctttttttcgtccgtgccgtgccaaaaagtccatgccgtctctatcgccgtgccgtctcacaatatacaacacacactcatagacacatatacacacatagacaaatatatgcaaaaatattagcagccctttttgtcttctcacgtattgat

SEQ ID NO: 27867 - DNA, 1286 bp, Heterodera glycines
aaattacgattttttaatccatttaggagctcgaagacttggatccggaaaacagtggatggaaatattgggagaaatgggaggagcgaagacagcagcaaatgttgcgccatgacgaactaaagtatttgggtggaacgagcaaacaaaccccattttacttctcccgtctgttttttttcagatacaaatatttttggcttcaaaattcgcctgccgttcagacgcacatgcgcttcaccactgaaaaatacaaaacacacaaggtgattttacgaattcacatttgtcagctgttgttgtggttggttagtcggggtggccaactcagtcccaatcaaagtttgggcgtcataactttttgcttttttcgttcaaatccaaatgcttgccgataaaaatccgaccctagttcttaacttattttcttatcatttgccaatttcccggcgtgccaagcggaaccgctggacgacttaattttagaaatttttaataaaagggtattttatcgaaaaacttgctaaaaagttatcatttctcccgcagtacacttaattttggaaaatcatactgttctcttcctcctttcacagttcctcactattcccgtgacgacgccgggcgtttatttgaagcatacgcgtcgactgcgtctcaaacagcgggtgtggaagtcgttggaagagtcggagcaaatgatgaaggaaaatgatggttggggaattggcggcacttggaggaattgatggtccagcaaaattttttagttgtctttgtcattgatgattttttttttgaaaaatttaataaaagttgaaaaagggtgatttctgcaaatcaatggcttcttttcctgattgaatttttttttgacattttttcctacatttatgtatttcatttccatttattgtatcatttttgcaaggtgccaatccctcccctcccaaaaagaatgatttctttaaacgaggcaagtggattgcgtggccgtcttaaagtctgtgatggcaatttgtcgttgttacgcgagaagttggcgactgatccggacagttatgcagaggaatttaacgaacagtttgaacatttcaaacggctgctcaaattgctcgaacttcaaccggtgctccacaggtgagaaaaccgaaataaaagctgttgttttaattggaattttcgggtaataatttgccgacggatggaccattcaaaaaaaaaaagttaacgaggttttcaaggtcggagggtccggttcttaaattcatttctactcatatcta

SEQ ID NO: 27868 - DNA, 1111 bp, Heterodera glycines
  misc_feature (19)..(19): n is a, c, g, or t
  misc_feature (43)..(43): n is a, c, g, or t
  misc_feature (68)..(68): n is a, c, g, or t
  misc_feature (1027)..(1028): n is a, c, g, or t
  misc_feature (1065)..(1066): n is a, c, g, or t
  misc_feature (1079)..(1081): n is a, c, g, or t
gaaaaagcacgccgaaagnaatgtgatgtgaaaagcaaatatnaatttaaaataatattcgatcattnagtccaaaaaatgattaattgtttgaaataattaaagaaatttgtttgaaattttcattaatttaatttagctttaacttttggattttattaaataaaaaacaaaatgaaaatttaattttcagttgaaaaaaaaaaaattaaaatttgaatttttttttaatttttgaatttttttgaatttttaaaaattcccggttggtcccggttcccggtcccgaaaaaaatcgaagtcccggtcccggcttctcaggtcccggcaagtcccggtcccggtttttgcaaaaattcccggtcccgtggcactctagttctgattcctaatttttaccgacttttgcacaaagcctcgggacaaaagttcagcaaatagttcgggttcagcattggacagatgaacaaccggagcagaagtagcggccatgtttgcaactgattgtgagcctgatgggtcactggacgccaaaaccattgaactgtcgctgagcagaaggcacttccgaccagcctaattgattcttgttatatttacaatgatcaaatactgtacaaatggaagagagatgaagcacgaaaagtgcaagtgatcaaattaaaagcaaaattattataaaaaattaaaagcaattatttttttttatttgattagcgaatattttaaaaaaattaaattatttttaaataaacataaaataattattttgctttaaatttggtcacttgaaacttttcgtagttcgtctcacattcagccacattttgaacaattaaactgactttgtccgtacattcgtgccacccgccttggtgttgttgtagggcccgttgaaatttttgttgaaaaaaattggctcggagttgtacctgtaaatgaagactatatgaacaaaagcacagaaatattgagagcacaacacatcattgtgtacacacacaaaccccaatctgcacaagtgggnnacgagtgtcaacaacagccatgaatttatggactganncaagtcaatctgnnngcgtgggcgcatcatcatccatcgagtcaa

SEQ ID NO: 27869 - DNA, 1188 bp, Heterodera glycines
aaaaagttcaacagaatcgttaaataaacccattgtccgttcaatggaactgaggggggtgatcgattgacaaaatgagagataatcaaaagtatatgtttaaaattaatggggtgaacaccgttaagaactaaaactgatcagcgtcagggagggcaagtgaccaatacgaaaacaatttggacaaatccaaccgaaggaaaatcaagcgatagactaaaacaaaacctttctctaattttcttaaaaatttggccaaaatcgcaaatgatcacttttttatcaaaatccgttaatgagttacgctcatatcactgactatcaatataaatttattagttaataataaatatatagaaaaaattaggaaagtgtcatttttcggacggaggtcatttggttattgtcatcatcagcataatcattgttttgttgtgttcggtcggcccatttgaggtgcaacggattatcgaagaactgctggtcgtagctggcgctgtcctcagcgggcgtggtgaccacgtgcgaacgacggggactgaagcgaccgtcgagcagagaacgcgcggagggcacgggaaactctgaatgtttggccgagacatctaaaacgggaataaaattttcatataaaatgaatatgatggacataaagaaaattagtgaaggtaagctgatgcaaggcgatctgttacaattggagaatttattttatcttagaagcccaaaccaagtggaaattttttttcttacttctctacacgtagtgaaaatttgcgagaaaatcgcccttttaatacatataaaagtcagttcaggattttataccaaggaaaattttttcgtgttttacttccatgctttggttaaccgagagcttaatattttttatatggcataccaaacaattaaattaacaaacaaaaactaaaaatagttctatctttctcccaaaaattgcccatatttgctgttctaaaaccattgatccaaaattaaaacgagcaattaaatacatctatgtttatcaatggaaactaaacttcttaaaaataaaagaattctttcggtgttgattgcataagttgatcagattgctgtttaaaggtaatgtccaactcggaaaaatcagaaaaaaaactaatttggtcactccaatttttataaatttatttttttgactctaga

SEQ ID NO: 27870 - DNA, 945 bp, Heterodera glycines
  misc_feature (688)..(688): n is a, c, g, or t
  misc_feature (763)..(763): n is a, c, g, or t
  misc_feature (857)..(857): n is a, c, g, or t
atttcgggaataaatggagtaatgtacgaaataaaccgcttctccaaaaattttcataagtgaaaaggaaaattatgacgaccaaaacgagttcagaatgagtataaatgttataagaagtgaaaaaaatgaaaaaatgaacaatttatgaaaaataaaaaataatgagaaaaaagcaacttttaggactaaacgagaacatgaacaaaaaaggcagattaaacgagtccaaagaaaagaacgggaaaatttatgaaagccattcatttttcaagatggaattgctgtcaaaagaggaggaagaatctctgaagaggttgaagagaaagctcgaacatcaactctgagggtccagcaaagtctgaccgaaagcgaaaaatggaaatccggaacgtcggatgatgatccagtgggaccacaggagtgggaagaaaatgaggaagaaacgatgaaaaagggcgaagaaatgaagaaaaaagaggaggaggagaagaaaggaagagagggaaaagaaaaagagacggaaaagaagaaggaagagatgaagcagaaggacgagacggaaaccaaacgaagcctcagcgtcggaacaacgaaagacgatgaaatctcgattgtggattctgaagaaagagaaagagatgccttcgaaaacccgccgaagccgacaaacgagcgaatggcattnttgggagtcgactttgaacaatgaggcaaaaaaggattcgcgagaggacaaagagaaagccttaaaaaatacagngccaaggtattgtcgtaagctccagaaaacgaacaataaacgaagtcgacccgccaactctgtcaaatgaagccgccacgaaattcggcgaaanatgcggcaagcattgaacaggatcagaagacgaggagggcgcgaacggtgctctccatgctcctccaatcagagaagagcactgattt

SEQ ID NO: 27871 - DNA, 914 bp, Heterodera glycines
  misc_feature (25)..(25): n is a, c, g, or t
atccaagtagggacagcaaaagccncgtttcttcggcaatctcttcccttgtctcacttttaatttctttagttcgctcgtttgactaaatgtcccaataaaattgtgaggcgaatctctctgaacttcaaacatcgtccgtcgccttggcctcgcattttgccggggatgcgactgatcggccgaacgcaaacttttcaagtggacgaagaagcggaggaaggggaggacgaggctaaggaaagcgtggaaatgagctacagactgaacggattcactaattcgaccaaattcgaagtgcgcgtggagtgcgagccggggaaagtgaacgaggaaatggtgggcaaaaggagcgaccgaaatttccaatggcacggaccaaaagggagtgccaaaacaaaaaaggatgccattggcatggactaataatgtctctctcatttagtactcatttgaactaatccgggaggaggaacgttaacattgcgaaatatcaaagaatgaaatttagggcattcaaaatgatatttttatgttgtttataaaagaatattgagcgagaaaatgttaattgatttgaatgataaatttttatttcatctaattggattgatcactttcacgccctaaattagcaaacaaataaattaattaaaggataattggcaaaattataacggtaattggccaatatgatgccattttaattgacgattgacttccgcacatccgccactgttccaattcggtcaatgtcgaacaaacaaagtgcacgccggtcgagtcgccggaggggatgaacctgttcggcgcatcttcgccaaaggcggaagagtcgttgggagagagcaaagagaggggggggggggggcggcgagataggggtgttacaagggaattgggggagggggggg

SEQ ID NO: 27872 - DNA, 1387 bp, Heterodera glycines
aagcttggccagtccgttgagcccgagcagttcgagtgcgtcacggtgttcttctcggacattgtccaattcgctgcactgtccaaccaaatgcgaccactgcacgtggtcaatctgatgaacgaactgtacaccacttttgatgcaattgttgatgagcacgatgtgtacaaagtggagtcgatcggtgagtaattgaagggcattccttcgtttgtccccctctaattggccaattagtgaacggttcatctctgcgaaaatcaattatgaacttcaattttgatggttttaaagattgggtttttgccttacagtaacccatgcaaacttagcttactgtaaacatttaattggccttttaaaaattaataaaatattattccttaaggtgatggttatctctgtgtttctgggcttccaaatcgaaatggaaatttgcatgccaaacaatgcgctgacatgtaattttaaaaataaaatttctttaaattattatttatttcaaaataaataaataaattgtcatttaaattagggctttgaaatttctgaattcgttgcaatccttccgaatttctgagcactccgatcagcgaattcggcttagaattgggctgcacagtgggccatgtgtggcgggagttgtcggtcggtaaattcatgggaaatttcaaattatttttgatcaaatttcctattttccttattgctatcctctcctagtcctccctcatccacacacacataaaattagcaatttttttgaaaacctgtttaaaatgataaaaatttacaattttatgtcccggcgggcggtgcaacctgtgggtgctctatcaactcacaaaatttggttccgaaatcccacggacacctggccaccagggatgggccaaattgaaaaataaaaagcgaaatttgcgaaactgaaaaatgcgaaatgaaaaaaaagcgaaatgcgaaaagctaaaatatgcgaaaggcgaaatgcgaaatgcgaaattttttctacaactttttaatagttaaaagcataaagcaaaaatcattttttaaaattttattccaaatttaaaaatcaatagaactctttctgaggcgcgctttttccaaaaaaactttttgggaagagggggcaggcggcgccggcaggtgccgccaggaaaatttttgaaaatttgattaaaatttgttgacagattttcactaaaaaatgatcaaattttgtgatttttatcatttttctaatgagtaataagagttttggggcgccgctgagaacagtttttcatcaaattaattagccaatttataggtcaaatttttaaaaattttatgggaatttaatccaattcttagggctgtaaaagtcgcgtttcgcgcc

SEQ ID NO: 27873 - DNA, 1302 bp, Heterodera glycines
tggatgaattgaatttttgctgcggctgctgcctcttcctttgactgtgcgcgttgagtgttgccgccgctcaacggctgaagaaggaaaggaggggcagcacaacactttctttcctctcccattttgcctcattcattcccttttgaggagcattttgaatatgcgtcaaaacaaacggaacaaaaattgtaaagcattttcttgtttttattttattttattttccaactcatcccaaaagtgcgtgtggcgttagctttgttcaaaaaacaaagctgcttttcttttacatttctttttgtgtccacattatccaatttgcgacgagcgcaaccgaaccattcattcgtttgttcattcattcatcatctgctcaccgaattgggctaagatgggctataaaagcagtgaactattttcccactgttcagttcacaatggaaatcttctcagaatccactgattgactttttaacttttagggtcattttggcaaaaaaaaattttttcgagaaattccctttcgcttcccatcgatgcatttttggtttttcctccaaatttccctacctttctgatcattatttcttgtttttaggccaaggacaccttggacattgcgtcctgttcgtcttctcgttgctcatctccgccagcgagtgctgctgatttggtaaagccaacgacggtggaggaattcgggggcacccaaatggaaccaatggaggaaccgcacaaagtttcgtcggcgaaagatttgaagaacggcaatgatttgtgtcaagcgacgatgatgtacgttttgcaattcattgaaacagtaaaaacaaatgtattgcttttcgttgctccaaaagtgttacttttaaaattgggcatcatccatcaacttaacagacacatgccgtttttagcaatgtcgtccatgtgccatccgacacttccgagcatcaggtcacttccacttcgtctccgctgctcaaaccgatggctccgcctcggtcgacttcaaagaaaacgacagcgaagtccgcaacactttctgaaagtgtttcctcttcccaatgcgtcgttccgttcggtagcgatatgaacagaaaaatgcccactgctgtcgaatcaatgccaaattcggtgcctccgattggctccaactgttcggatgtttccgctcgtgaaatgcctttgcccaacacttcccttcctcggcccacttcttttaacacagtgaattatttcggcattccccaaaatgtgcctttgcgctttagccctttcaaattgacacttccaacattc

SEQ ID NO: 27874 - DNA, 1047 bp, Heterodera glycines
ttcagaaaggtgcttgagatcacccaaaattttgtagcggttgtcgtatttgtgacaatttgaagcgcaagtgcccgcacgtgtgcacgatcttcggcactttttgggaacaaagggttgggttcggggaatttttctgaatttttattttttgaaaaaccatagaggggggggggggcagaaatttaccgtccaaatattcaatgattgccatactttcggacagcactaaattgtcatggacaaacactgggactttggcgaacggaagtttggacaaaaattcatctttgttctgtggaaaagtggcaaaaattagtttttgtcggtcaaatgttagaaagcaaaaaaaacggcaaaaatttttttgaaaattcaaagaaatttttaacccagcagcggcgcacctaacggcactacagccggtcggtccccttttcccttattttaccatttttttttgttgtaaatttgtccctaaaatcgcaaaattagtcaattttcgggcaaaaaacggctacaaattcctgctttttttggcattacagtttttggggccaattctttttttccatgaacaaccggcaacacccagccctaaaaatcggacatggaccacaaaaaccggtcaaatgccttgttttccaagtaagattgatagcacacgtgtatgttaaggcactgatcggtcaatgtaatggtggattatttaaacatagaaattttggtactagtaaagttcgtatccccattttgggtcaaattttttcaaaattttttttttcttttttattgtcgcaattgctttaaataacaaataaaaggagatttatgtgcttattgggtacaattccgcgatttgggtccacaaattataaaaaatgtccggtcctccaaattgcttacgccacaaaagccattcttcgaattctttgtctggtagagccaatactttgaataaatcggcaagagtgaaatttttaagcttttccattaatctaaaaagcaattgcgacaataaaaaagaaaaaaaaatttgacccaaaa

SEQ ID NO: 27875 - DNA, 1756 bp, Heterodera glycines
  misc_feature (656)..(656): n is a, c, g, or t
aatacgccataggacatgtaagtgaaagatttgaaatgaaaaaatttttccactcaaaaatcatgttctcccccctttggtcccaaattgcgaaatcacaattaattatataagatttttagtaaaagtgataaaaatatgatatgaaatttataaaatagagaaaaaaatcgcggatttcttccgtacagtgacacctcaaccgcctcacaacgcgtgttgcggctacggcactcggtgcgctcccaggcgccaatcactttgcagaaacggttcagtcgctgcccgtcggcttcgccggcatcggcttcgtcatcgctcggcgcaacgttggcactttcggcggcacttccactgctgctgctgctgcccaaatttgacaccgccggatctctgctgtcgcgcatcggcggcgctccgctgacgtgctgctgatggtcggagccattggtgctgctgctgtcgtgatcagactgatcggtgaacgagggccgacctcgcccaatttgacgccaggcattacactataaatgcaaaaagccatttttgcgcatgtccctatttcaccattttgtgaaagcccttccaatgaaatggcaccatttctctcccccaaagccctagcgcttctcattttctgtaagcaaccccccccnccccctaatcacatcaaaacacatacacacacacacaaggaaaaatgaataaatttactgaattttgaaatataaaaatgaatgttttattaaaaatggcagaaaaaatatataaaaattggcaacaacataaaaatatgataaaaagaatggaatgaatgagaaatgttgaacaaaaaagcaaaaatgcgaaatgaagaaaaaattaaaatgttttttattttttaattaattattttgagcggtcaatggcgtcctccaccggaaatttgaccctaacgagtcattcttttcccacttataaaatgggctgaacaaatggggcacactcgccgcaatttcgcctcacgctcaaaacagcaggcgtggaggaaatgtccacatgacgggcgcaccacccgttggccgccgccgatgatccattcgtgacatatgcaacacatcagatttctgcgccccgcttcgtcgtgctcgacaatgcccttgaccgatgagggcagcgtgctcatctcaaatgcggtcccgatcatccagacgcggtcggcggcagccagcgggtggttgcccatcatcaccacttcgttggctgccccctcgacgagcccttgcgcaatttgatcttcaatcgtcagcatctcgtcgtcgtaaaaatgctggtcttcgtccgcaagcggctgctgttgcgccacgcccagcgcctcttcttccgcatccgactcatcaatggtgatgacgttgtggggcgggcgcggtgacaacgtgttgcgcccgcgtgaagagcggggcgtcgagagtcggcgaccctggcgcggctgagcattgagttgacgaagacgacgacgctcacgcgaacggcgctcgtcccgggcaacagcagcatcatttgtgttcatttgacggacaattgccgccatggaacgttgtgcggtgattgaacaagcacggatgggaggcggcgaagagcgaggctgctgctgctgctgctgagtgttgtggcgtgcgcgggcataagttgatgatgacgatggaccaggaggtggagtgggcgggcgcgttgaagaaagccatggctaaaaaagttggaaccatttttttaaatt

SEQ ID NO: 27876 - DNA, 1510 bp, Heterodera glycines
cactgataagcaaatcagttcaatgattggctgatattgactgatccagtgataagcaaacagtctaacgattggcgctgataactgactgaacactgatcagcaaatcagtccaatgattgggtgatcacagactgaccactgataaacaatcagtccaatgattggctgatattgactgatcactgataagcaaatcagtccaatgattgggtgatcacagactgatcactgataaacaatcagtccaatgattggctgatattgactgatcactgataagcaaatcagtccaatgattgggtgatcacagactgatcactgataagcaaacagtctaacgattggcgctgataactgactgaacactgatcagcaaatcagtccaatgattgggtgatcacagactgatcactgataaacaatcagtccaatgattggctgatattgactgatcactgataagcaaatcagtccaatgattggctgatattgactgatccagtgataagcaaacagtctaacgattggcgctgataactgactgaacactgatcagcaaatcagtccaatgattgggtgatcacagactgaccactgataaacaatcagtccaatgattggctgatacttacttaacactgatcagcaaatcagtccaatgattggctgatattgactgatcaccgataagcaaattagtccaatgattggctgatattgactgatccagtgataagcaaacagtctaacgattggcgctgataactgactgaacactgatcagcaaattagtccaatgattgggtgatcacagactgatcactgataaacaatcagtccaatgattggctgatattgactgatccagtgataagcaaatcagtccttgtttctgatgtactaacggtaaaaatttaccataacaaaccggggtcaatttacccacccaccaagtttcatcccgaaactccacattcacttgggggcctctcctttgttagggctaccgaatggtaccaacaatattggatttgaaactgagctaaaccgatccacattcatcattgtttgttttcagaggaggcaaaacacacatgtgttgtacaatattgtttggttgaaaagtttatgcctagcgtttgtaacggtgagcttacgctcaggcatatcaaaaatgaaacgaaaattgatgggaattggcactgcaaatgcgcacacagcaaaaccaaccagggcagagacattggtaaatgggaaaaaattgttgaaaatttgtttaatttcttagaacggcacttttttataatttttcatgaatttttctagcgccaaaatttccaattttccctcggctgcgcccattggcatcgcgggcgccccaaaattcgtttttaatttttaaattgattcaaatacaagcaataagaattaaaatttttgggaatttcaaaatacattttccggacccttcctgcttcctatatataatttgaacaaaaagcacgcg

SEQ ID NO: 27877 - DNA, 971 bp, Heterodera glycines
cattaagcaaatgattaaaataattttaaatataaaaaacactagaaagaaaagttactacgagttagctaatacattcctaaacaaaaacaagttaaaaatgttttgagaataaatgcacaatgtattaataaataaggtttatgcattaaacattaagaaaatatagaattaatatcataaataatacaatataaagaggcagagatgaaatttaattcacatttgttttttaactgtaaaattaaaatattctctgctgataaaattgataaatttttgaaaattatgaaaagctaaatttcgcaaacttttaaaaaatttaaaatatgaactttattctcgagaagttttataaaaaaattagggtcaaaaaggccaatttaattgatttgtccggccgttcgaaacgattagggctattgcttgtctcgtcttctcgtctcatctggtgtctcgtattctcgtgtttttagggcgttaatccatgattttgcgggatttatgcctgcgtgatcccgtcccgcaaaatcaaaaagataaatatggagagatatattttgaatgaagttgttccataatttcaataattttgtttactattttttgttgttgttcttttacagtaatgagatcttttttcacagcaaattgtgagtaaaaacaggtccaatctttacaataaacagagtttaaaatggtaaaatagataaaaaatcaaatattttttcgtatctctgttctataattattagggtgaggattttgtcgtataggtataattgtatatttgtaaatccaaggtatggaaaaataaatttctggcaccaattttgtacattaaatttgatattattgaataaatttaatgctatcaactagagttgagcggtaatcggtaattgtaaaaaaaccggtaccggtactgaccggtactgcaaaaaccgggaccggtaccggtaccaactttt

SEQ ID NO: 27878 - DNA, 1560 bp, Heterodera glycines
aaaaaaagctcgaaatactggtttttgagttccttctagctataacttttttgaaacttgacaaaaatttttgaaatttatcaaattaataataaacacacagaactatcgaacaacaccaacaatgcttaatttggttgacaatgaacaaagttatgctccaaaaattcgtccgacgacgtttcggccgacgttttggggtgcaccgtcacggaaggggggggggggaacgagctgttcccctcgccgctggcaaaaacacttattagtaagggatatgatttttaggcaaaagcctattttttcataaactttgatgcgttgtccccccctcccatgtttttcggtttgtccgtttccgttttcgtccatcccccaccggcgctttccacgttgcagtccagaaacaggtccaagcgcttgtccagcacgtagtactggtggacgaacagatccgcgacaattgtcaacggcagtccccgcaaatggacggtttcctccaagtggtgggcgtacactgtgctgtcctcgtgctgctctttggtgaagtcgaccaatttgtccatgtgcagtgccacgcgtccgttgagtgtgtagcccaaccgatgggtggcgaagggcaaagggtacggcgaagggacaacgccgccggggtggtcgtggaacagcaaaacgctgaccaactcgtcgctgctcaacacaccgcagggcactgcaaaaaattaaaaaatttttaaggaaaaatgtgcaaaatatgacccaaaaagtgccattaccctaaacctaaatagcattaaataagtgccagaaaatgataatttctaataagtgataattagtaatttttgaaagaatcattaattgttcaaacagcagagaattaatgctcttaataactagaagatttgcttaattttaatgctgtttaggccttgatggtttggaaaaaataagtttgaatccgattttggacataggcgcaaatgtttgggcacgctcttttctggataaaaaaaatactgacaatttttcaaaatttttaccattaaatttctttaaagaaaattctatgatttttcttatctgtcgtccggcggtgcctataggcgccgccgggggaaaggtttaaaaattttaacaaaattatttttaaaaaagttggtcctgccctctattattggtttattagtgttttttagttggcataaataaatcgcttgagttggaactgtccattaccaatgtgttcggtgaagtcctccttcgaaatgcgtggaaaacgaattttgaaaagtgccgggccgagcattttgcgccgattctctgccgaacattcgaggcccttttggcggcactgtccgtccgcccaatggagtgccaaaaaattaacaaattaattaattaggcccaattaaaacaattgacccaattatttggtttgaattggcattaccatccgccaaatcgtaagttcttaatgaattgccagcttttctcggtccaaaacttcggacatcagaagttggtcgatttccaaaaaggcgtccgattggtgcaaag

SEQ ID NO: 27879 - DNA, 1208 bp, Heterodera glycines
ttttccttaaggttgaaggcattagaattggacagatctttgcccatttgacgaatgccaaagcttacatggtcaagccaattatcatcatctacatcttccgccagaagtgccaaaatacgctctttcacttctgccattaatgactagaaaccgaaaatttcaaacttgcatacccaccgagacattggaatacaaaattttgcgagatatgtcacgcgggattacttccgattaaaatttgcgggattccgtttgttttcgggatttttggaatttcaataaattagatttaaatataaaaaagaaaaaatgactaattttgtctagttaaaggaaaaccaaggattaggcaaaaaagatttctcttttttttgaatagagaacgagggctaaatagtgagaaggggcgtggaattccaacccgattttttttgcggacaccaattcgagtcatgacatgagtgtcccataaaggttatcggtctcaagccttaccccggatatactaaaacctgataatgtttgattagggctttcgcctgagatatgacccgaattgaaaaaaccaggaaataaattttggacgagaatgttggaaaatggtcttaagtatgagaaatattattaaatatttgtttatgacatttgaaattttcgaaaaatacagtgcggatcctacagtatccctcgaaaaattaaatttgcggatccctctgcgagatcgtaaacaaaatcagcgggaaaggatcccgcgggataatcccaaaaatccgcaatttccaaaaaatgcgggattgttgcagactgtgaccccgcaaaatcccacgccagactattagtgacaccgaatttgtggatgacgacgccgaaggtgcatttgccgaggccgtaaaagcgcggccagcgaccgctgctggcgtctgtaattgtcgccattgcggtcgttgctggggttggagttggccatgtccccatgctgctgcagtcgtggcattggcatttgacagtgcgttttccaacgtactgcccgaggacgacgcaaccgccgccatttgccgttggtgaagcgaggaaattaatgcctatggcccaaatggagaaaaataaaaatatttctgttttccaatctcagttttggttttgaaagattaatttgtagcaaaaacggctagccggggtaatatttttccattagtagctaaaat

SEQ ID NO: 27880 - DNA, 1511 bp, Heterodera glycines
  misc_feature (83)..(83): n is a, c, g, or t
aaaggaaaagaaaaattacaatccaatcatttttcataattttaatgcattctgctgatggttcaatttcctaattctcattntaagatccgaataaaatccgatgtcgccttcgtccatttctattcttttgggggcccagtggggcgacgaaggcaaaggcaaagtgttggattttctcatcggacatcacaaggtcggttacggtgggcttctggaaatccttcgttattgatgttccgaaggggaaaaaaattctgggctttctgcatttgctttgttgttttgtttgttaaaccctctcactttctcagattgacattgtcgcgcgatgccaaggcggtaacaatgcgggccataccgttctggcaaatggccgcgagtatcatttccaccttttgccttccggattggcctcagaaaaggtgacccaaaaaacaaaacaaaaactaatgttgctgttgcaggtgttgaacattgtcgggaacggagtcgtcgtcaatttggacgcccttttcgaggaattggagagcaacaaaattgaggattcggcagaccgactgttcgtcagtgacagtgcccatttggtgttgcctgtgcacatcgcaacggatatcatgcgggaaaatgcgttgggacaaaactcgtaacaaacggaagattaaacatcgatcaaattatttacatttttcagaaaactcggcaccaccaaacgtggcattggtcccgcctattcgagcaaatgcttccgcaatggcatacgactgggcgaactgctcaaccaaccagagaaatttgaacaaaagttagtcgattaataaaattagttgaccttttgtcgttgtttagctatcgttcgctggtcgcccacttcaaaactcttttccctgacattgaattggacacggaaagtgacgtcaaacagttgaaggtagtttcttttttaaatttcattttgcatttgtcctttttttgttaggcccatgccgcacgtcttctccaaatgggcattgtctgcaacacgaccgttttcctgcacaaaaagcgtttggagggcaaatcgattttggtggaaggagccaacggcactctgttggacatcgactttggtcctatccaataatgttccaatttcttttaccatcgattgtcttttcaggtacctatccgttcgtcacttcgtccaattccaccgtcggcggttgcatcaccggccttggcattccgccgacagccgtccgtcgcgtcatcggcgtggtcaaagcctaccaaacgcgtgtcggctccggtccattcccgactgaactgcttgacgccgatgtttgtattcacacaaaaataaagttattgcatataatttttgtctttcatagggacatcccagcgaagagggcaaacgtttgcaagaagttggtgttgagattggcgtgaccactcgcagaaaacggcgctgtggttggcttgacttggtgatgttgcgttattctgcaatgatcaacggattcacttcg

SEQ ID NO: 27881 - DNA, 383 bp, Heterodera glycines
accctaaaatcttattttttggcctttattcttattttcatttttggtcaatagaaaccctggatttagataaaaacacccataaaaattgccttttctggcataatttataatccttaaatttggtcatttttagacaatatctatgcaattataccaaaaacgaattgaatcgaggcgatacatcgaataaaggaatgtggagccaaacacatcattcaaaaaaaattttttgtgagattttttggagctaattaaaaacaaacccccgcccccgtccccggggcgagaaatttctcacccccgcccccgcgactctgacccccgcaatcccccgcccccgcgaaaagccacccccgcccacggggtccgaaccctaatta

SEQ ID NO: 27882 - DNA, 1554 bp, Heterodera glycines
  misc_feature (319)..(319): n is a, c, g, or t
aacttttgttattttcgcaccgtaaaatgtttttgaaaaattcaatttccgactttttgttcgaattcgcgtccgaaattggtcgaaatggatgtcagattcgtgatcagcgacccaattttccccggcggcgcctatcggcatgtgggagccctgttaatgtatgacataattgcaaaaaaatttgagattttaatatcacagtacgaattggctttttaccattcatttcattgccattgttcgtcccaaaatcgattaatcgtttaaccgttggccatcccttccattcattgcctattttttcttcagaatttgnacatcttcgcccccccccacccctccccctttttctctaattgttttgtcattttgattttcccctttctcttttccatcaaatgcaaattcgtcctccccttcgctccaaattttgacatttgccaacaaataaaaatcataccaatcaattgtaatgcttttgttactttcaatttttacaatccactgacaaatgaagcacatatgtataaaaattttctgtctcccgtttcaatgctgcaacttagtgcgaaagctctaaattttcatgctaaacctccttgagccatttaaaattaagaataattttttgtagcctttagccagaatttagttaaacaaaaactcggctctgttctagtttacgcgtccattgagtaaccaccaccaccctcatttttttagatcataacttttttcttacttagtcaatccaaacattcttggtatcattcgaatgcgtagagtttagttatgacctaagtaacgtagagtggtcattgatgggacgcctaaattgtgatagagccatatcgtcaacctttttgttaagagcatcaaattaggcctaaaaatttttgtgaaaaatcaattactgaaatggccgccaaacccctctcttctgtggatcgcatgaaattgttgctgagttcgggggatggggcggacgttcactttttggtgggccaaagggacccaaaagaggcgagtgccgtggaaattcaaagcattacaaaattgttttggcttttagcttttgtcggctcacaaactcattctgatggccgcttccgacgtgttcgaggcaatgttccgttttgactccgcaaatgccacgacttccacttcaaaacgtaataaaactgttggcttaaaaacattccctcaagatttgggggaaaagtaaaatttagagattttttggtattttacagttaattttcaaggacatttttttgttttttcgaaatacatagagaaattagtgcaccccctaagaatgtcctaaaaattgaaatttcccgattttcagcgccttcggatttggccagcagcagcaaccctgtggtggtcagcgacgtcgacgccgatgtgttcagggcgatgttgggctttatttatgcggacgatttgagtgggatgaacggcgacaatttgttcgacgtgctttacgctgggtaaactttaaaattcattattttcttcgtttattttaatcacttttagccaaaa

SEQ ID NO: 27883 - DNA, 1109 bp, Heterodera glycines
  misc_feature (985)..(985): n is a, c, g, or t
attgaccatcctaggattatccaaatctacttttttcttaatgtaatttttatattaaaacatagaaataataatgctgattttaaataataaattaccagtgcgataatccgacaaagattaaatgaggtaaaagcgacatggaaaaagaatgacgaagcagatgattttcaaaaagaatttttgatttttcaataagaatccacatgtggtgctttcggttcctctaaaaaaattcattgttttcgcgaaattcaatgggttttctggcttttcctaatttcttttattgttccttttaaattaaaccatttttattttccttaaatttttttagagttaaactataaattatttattttttgtagagtgccacgggactgggaatttttggcaaaatcgggaccaggacttgccgggacctgagaagccgggaccgggacggggacctcgattttcgtccgggaccgggaaccgggaccaacagggaatttttaaaaaaattcaaaaaaattttaaaaaattcaaattttaatttatttcaagtgaaaataatacaaatttgttaacagattttcaacaaaaaaggctggattttgggattactaggctcaatttgtacggattttcatttaaaaaatgataaaatatgtttaacctcaaaatttgttttttttcatcttttaattattatatttaattaattaatgccgtgagacaccaaataattttttacttccattgttttctttcaaaaattccttaacaaaaaggccataaatcacggcacttcttgaacaggtacttttggataaagattaattctgtacggtttcttcataaatgccttaacaatgtgaaaaggttttcaattccaaagggatgtctcgtttcgtaaatccgccaaggggtgagtataaaaacaaaaaatgtgacacataaaaactcacaacatggctaatatctcatggtatattcaatagcntccgtggatgttctttattagaatattaatttcaatttttttacaaagtataaaaaagatatggtcataaaatttcaaaaatatttaagtcaaaattttttgccataaccttcttttgaactca

SEQ ID NO: 27884 - DNA, 1390 bp, Heterodera glycines
  misc_feature (1356)..(1356): n is a, c, g, or t
  misc_feature (1368)..(1368): n is a, c, g, or t
ttcacattgtcgcgttgcgctacttggaactgttgcagcaggatcttcaggtggcgtgggtgtcgaattgtgccatgccatgcccctgcatgatacaattgaattcttgtatagacttagatagatatcggcacgggacagggtctcaagctggatttacataatctgctataatcccgcatttttttttggaaatttgagattaatccctaggaatctcaacctataacaatttttgtatttaattcccgcagcgggatccttggagtagagagactggaaatgaggggaataagcccccccccgcccgaaaatagaaatgaattttaacgaaaacggaaatatttaaaaaaaaaatatttttcaaaaatagtccatagtcccccggggtgaggactccctcccggaaggaacaaggcatggatggcggcgctacatgcttaccaataagtgcaattataaaaataattagactaatatagtggcgaggtatacgaaatcataacatcacaacccaaaaatcataataataaataaataaataaattagagttagtgaaacattgtcagaaatacaattatggcagaaaaaaaccgagaattcattttccgacaacaactcattacgaaaaaaacggaagcccaataattcagctccaaattggctgggaggagcgcggtgccaagccgtcgtcgtccgccgccggcgccgtcccgccaatgcttcactttctcgtccattttcccgaaaatgatcttacgaataacaccaacagcaaaagcaatgaggacgacggcatggagcaggaactgcaacacaaccatccacagcagcagcggtgccgcacagtgcgcgagttggccatgcatttgttggccacgctgaagcattacttcccggacattcagcgcaggcactgtgccccctccctcactttgggctaataggcattaattggttatccattcattttcggtccctaggcatcaaattttttgaaaaattaattcgaaaataaaattattgtgcccaactcacaaattaaaaaaagcgaattgcataactttgctcacttttcagcttggccaaacattttttgaccatcagtccgtcactgattgccgacttttcggcactgccctcctccacccctgaacttccgtgccacaatttccgacggtcctacgtggtctgccgactttttttagaatgccattagataatttagatttttgaatattaatttaaactattactaatctccccaattttttagtctaatttaggaaatgaatttattacctaaaatcgccaaaatacaattagatttgggtatcaaaactgccattaaaaancaaatatacggnacctaaaaatttattgattcat

SEQ ID NO: 27885 - DNA, 930 bp, Heterodera glycines
  misc_feature (894)..(895): n is a, c, g, or t
ctagcccagcccgtccctgccagcggcattagttgcccaccctgtgagcaggagggacaccgtccgagtgcttgtcagcgttacaccaccgtcactcaacgccggcgacgacttgaagaacaggggcgctgtctgcgctgcctccgccaagaccatgttactcgcgactgttctcgtcaagaccgatgctcaaaatgccaggctaccgaccatcatttcctcctctgtccgtcaattgaccctccagggcgaaccaacaatcgacaagagaatcgggagcggagtggaaatgcgtctcgcaacgtcagtcgtgccacgggggccaacgccgaaccagtccgaccaagagcgacccccaccacaaccgcactgctcgtgtgcgacgagggcgaaagcattcccgaggcgttatgcgccgccgcctttgaccccctccccgtcgacagcggcagttttctcgtccccaaatcgacgagagtggctcatttgatgactcagacccttaaggcgtcatgccaaggaggcccacccgacggaattcccgcctttgtcttccacgaccctggcagtcagtccggctacataagccgggcaatgacagagaagctccgacccccccgactctccgagcacctcctccgaattcacaccttcggagactcccgccccaagaccgtccgatcagcaaaattcgccattcaactgcagcgcctggacggaggctgggagaccctcgagctcaacgtaatcgacgagatcacgaccaaaatcaaggcccttcaatgggacacaaccgttggactcctcccacctaacgccgtcctcaaggtcgtcgagaaagcgccggacatcctcattggcattcgggagtttttgggaattctttcacggctnngtcacgctccattccgggctccacctcatccagac

SEQ ID NO: 27886 - DNA, 1142 bp, Heterodera glycines
gtttttttattattttatttttctatttcttttgtttgcatttgttcgccaatttgtcctttttttctcgctctgccttatgccatttccacccatttttgcctcaattgcgcactcccctctcgtcctcactctatttcatctctttctctctctctctttctctccccgccccaccgatcgcaattcattcgctgaccaatttctgcggaagccaaagcagagggccaattcagagcaccataagaagagtcgaaacaatgacggacaatgccagacgcatttgtaatttttacgccgaaataattcactaaaaagtggaatagctacaaaactgagaggaaaatgaaaaagaagaggggtttgaaatgaataccaccagaagatatttttgcaaatgaccaacacttttggatgccgaattatcatcttttcacatctaactttttctgctacccgaccacaacaacgctggagcgatcggtcgtcggttggggcagggggctgcatctctttgtctcaaaatcatttcatttttttttcctccattttctctctctttaacgtcatttttctttctttttttctctctgctttttccccttttccatatcgctttgttatttttgccgcgagagcgcggcaatgtcgtcggtggggaatgtgatgaaagatggtcattggccggggttcccctttggcttgggcttggagttcctccaccttcctttgtgtcagcccctctcatcactttttgtcccctcaattgaccaactgccccacccttttttgccaccctcaattcccctggccgttcgttcattcattctgataattgttcaactttgtttcgcttggcttggtttttccactcaccaaggaagtcttcacgtcgaagcggcggtggtgctggtattggttgtggaggtgttcctggtggtggtggcggtggtggaggcggtggtggtggcggtggtggggacccatcaatggctcaggggaccagccagcaagttgtacaaaacagattttaaacaaataattaaaaaataaaaacaattagctgacgcgacgacccaccccatttccaaacattctgcgtggcaatggtactaggaatggtggacgttccggaggaggag

SEQ ID NO: 27887 - DNA, 912 bp, Heterodera glycines
ctcccgttgacaaccgaagggtacattgggggcaatggatgttgggctaccgtatcagttattaaaatttttgtttttcaaaaaggatactaaaactgggataaccccattcagagacaagtcaaaaaaaataataataggcttggactaccatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactaccatac

SEQ ID NO: 27888 - DNA, 1148 bp, Heterodera glycines
  misc_feature (140)..(140): n is a, c, g, or t
gggggaattgctgctgtggggtacaatagaaaggcaatggtgtccttttcacttgatgaagcgaaaaggacctcttcgacaaaaatagaaaaatgttgcttttggactgttggagggggggggggggatgtctgctattnatacgtgcttattttgataggcgggtgaagcgaagaatgggcgggagagatgccagacgaagcgtagggaaaataaaaagtgaagcactttctgcacacctttttcagtgggcaaataggctagctaattgcttaacaacagctgaacaatattggaggatcacaagcagatggaagggggatgaagggcggggggggggggaaaatgtgacggaagggacagttgcacaaatacggaccagcgatttgcggctttcaaaccgcttttttgttggtgtgccctttcaaatggacggatggaggtactgtcatttggttatctcattttgaagaagaacgagaaaattgggagtttgaaattaaatttgaaaatatgatgtgattactaattggtcgttgccaattccttcctaacaataaaatatgtccgatagactgaacattttaatgaaagagtgattagcgcgtgatgaaccgacattaaacattaataaatggaaaaggaatgtttccaaagaaaagtgtcatacaaatgtgaccaatttggaaaataaaaggaagagatggccagcagcagcagaggatgatggcaaaggtttgtgttgggatgacactaatggcgcaatgagtgacccccgtccccgtcccctccccagccccctccgccgtctgatttatgtttacgcatgtgttttcagcttataaaagtgcgttaaaatccgtctccgcccgtatgtccacaggcatttgtgttgctgacagtggttgagtgggctttttcattgtgtgggcagtctgccacccaaagcgaattggcgcgttggcgttttgccaattgtgtccatccgtcatgagaaaagaagcgaactaaagaaggggaagagtgaaagagtgagacattccctctccttcccggtggtttcgttcaaaaatgacattgtgaaaatcggagaatggaagagataaaaatggagagagaagttagtaatatgtaaaggtagttaataa

SEQ ID NO: 27889 - DNA, 1701 bp, Heterodera glycines
  misc_feature (1633)..(1633): n is a, c, g, or t
  misc_feature (1639)..(1640): n is a, c, g, or t
cgcaccacgcctaacgtcaccgccgggacctcctattgtcaatagttcttctgaaaaagcgtgctgcaaaaaaaagtgcaaatgcggtgaaatgaggaaaatgatcgatggaagcaaaaaaatattggaaaaaattcattccggagaaaatttgataaaaattaatctttttcattgcatatggtaatatttttacgcttccttaggtttcaggaatttcccgttatgtctctggaaattatttgtatgcccgtctttggaaaccgggtttttccaatggcaactctgattaatgatgaatcacccaacatccatgctgatttgtgaggaggggcatccccccccccccctcccctttcatctcccttcaaaatgtccaatattttcgttgtggattgattctttgaaaaaaatataaaaatatattcatacattctcccctccctctgctggtttattttcttcattcattatttaccccccccccccccacctttcgttgtttttgcctcattctttcgcttttgtcccctccctttccatcaatccacacatcttttgccccttctctctcttaaattcatccccatttaacattctcctcatcagcagcggttctcacctccctcttccacccacccggcccttctgctgctgcttctgatttggtttggcttggcttgaaaatcaatcatttttttgaattttctgtgttcctcgacgtaaccacaaatcgaaagcactaacaaaaaagatgcaaaattgtacaaattaattaatcattttacaaagcaccaatgaatgtaaatctgctgccgaccgtttaattctttgaccattttgctttgcattccgttgttttggtacgcatttccatcatgtccattcttccgcccttctcatctcactttatttccccttccattgtgtttttttggtctcttcacttttcctaaacaattctgcggccgcccttttgagcacaaatccatttggtggtgtgcactttcaaaattactccattggtctctgctgggctaacccatccattctttaatctgaatcgataatttggctactcatttacccatttcctttttccatccatccaccattttcgttgtttttggatttgaatttgaaaaatcattttcttggattgattactaattatttgtttagctgggaataactttttaaaaagctatcatcactttccgctgtaatttgatgagtctgaccgctttcataaacttttgcttctcggaagctcacatttctctcctgggagtcactatttttaccacacattagtcgtccacggttttttcatcttacactttatttccctccgcttaatctgccacttaattgatccaaaaaacatttatgtatgtcccggaaaaatgcttttttaaacttaactttaattccttgtcgatttgttgcgtatgtaccagctacactcattttatccgattctgatttttttttttttgcatcatttcaccgtttagggcctgaatcaaagagatccatttaatttttaaaatctaaactcattagttaggttatttgtaggctttttcgtcaagaatcaagaaaagaatattttctggtcttatacctgaanaataannctgatgaaaccaaaagccttcatacttcgtataaatttcagtgaaaattttcaaaataaaa

SEQ ID NO: 27890 - DNA, 1178 bp, Heterodera glycines
ttcgcggcggttttttaaatttagttggggccagacggccgcttcacgcccgttttccaaatttgtttggcccagacgggcgcttcgcgcccgttttttaaatttagttggggccagacgggcgcttcacgcccgtttttcaaattttgttgggcttggcgggcgcttcgcgcccgttttttaaatttgtttgggccaggcgggcgcttcgcgcccgttttttaaatttgtttgggccagacgggcgcttcgcgcccgttttttaaatttagttggggccagacgggcgcttcacgcccgtttttcaaattttgttgggcttgggcgggcgcttcgcgaccgttttttaaatttagttggggccagacgggcgcttcacgcccgtttttcaaatttgtttgggccagacggacgcttcgcgcccgttttttaaatttagttggagccagacggcgcttcacgcccgtttttcaaattttgttggggccagacgggcgcttcgcgcccgtttttaaattttgttgggctagacgtgcgcttcgcgcccgttttttaatttggtgatttttaggccgctcgcggcctcgtacgggcgcttcgcgcccgtttttcaaatttagttggggccagacgggcgcttcgcgcccgtttgatcgttttttaaatttgtttgggccagacgggcgcttcgcgcccgttttttaggggtacaacagtgattagaagaggtgcaacagtgattcattaaattaaaatgaaaatattttttaacaaatttaattaaaaaaatacatgaaattctatcaattaaaaaaataattaatttaaacttataaaattaaatataattttttatttattaactcaacaaaatattttaaattaattaaaatcattgaaaataacgtaaaaatgcacagaaaaataatgttacaccgtccggatccgaacctgccccctcccccctcaaaatgatgcctcagaatccccaatcacacagggattctgaggtcttgacgatgtcaaaagtaaaatctgatcacgtattcgtgatcagcgtcataaaatagccctaatgacatgtttttggaagatttttggtgaaaaaaatttttcaatcaaaaatcctgtcacccccctttggtcccgaaaccaaaaatcacttttatttttataac

SEQ ID NO: 27891 - DNA, 1683 bp, Heterodera glycines
taaacacaccgtttcaaaaaacgagagatgaaccaataaagagagagcgcagagaaaaaaacatctctctttttggcgtactatttctttatctctgttaatagagaaaaacggaatttacatttctatgtttagtttttttgtcctatgttaaatgcgcttcaaattttgcataaagatagagaaaaaaattctgcatcgaatgttctataagattttacgatttttctatcccatttttgcatgagaccgttatgaaaatttgaaactctcactactcttttctgagatgtcaaattgcttagcatttgcttagaaaaagcttctcctcatcaagggctttcgaatgataccaagatggaccaatttggttggcaaaaagcttcaaaaataattcccaaaattcgtcattttttaatattttggacaaaaataaataaaaatattcatgttgcacaacggactcgaaccaccaccctttgtccctttactatcttacaaaaaccactgagccacacatgcaaatctttttggaactgggaggccaaaattgaaacggtgtgtaaagcgattctttttttgtttttaaattttagtccctcaagaacttattcgtaattcgatgcttttaagttttctttaatttatttgcgtttctttttccattttttttaaatttcaggctaaagttttcatttgacttccccacataaatactgacaaaaacaaaacgcccccgcattctttgtctaaccgactcaacgttgagacatggcctctgttgatgagaatgagcagcttgtgcaggaaattgtcgggaatgttctgtcggaatcagcaaaaggtacagacagacaatcgagcaaaatgagatgtgtaaattctttccatcttttcagaccaccagcaagaggagggaacggtaggttttctgagcaattacagggaattggataactgaggaacaccatgaaaaactaagcatcttatactggtttaacataaaacgcagaatatgaggttatcgttagtactggttcaaataagaggaaatttggcaccccattctccatgatgacaaattcaggaacaccaattgatggacgaagtcgtcaagatggacagcaccgatgccgaggcggaggaccatggagggattggacatgaagtggcaatttcggtcagtgacgtcaagcaggaagggtacgcagtggaaagtccggtgggagaggaagaggagaaagaaacggagggacaaaacgacggcgcaatgcgacagattgccgacaaagttggggtaggcgaatggaacggttcggacaaatcgaacacttgggggaaaacacggagtgttttctagggactttcactggacgaagacaaaacagcgaacaccgacgccgtcgtggaaccgccgatggccacggaagagaaggcggcggacgttggcaacgacaaaccgtcgggagagaatttgaatgaggaaaacaacgaaagcaaagtgggcacaaatggggttcatttaaccctaaaaccattttttgtgtagggctatcaatcgccagtgtcggaggaggagcaccccattcagcacgtcgacgcaaaacaaccgactgttgacgaaggacagacccatgctgctgctgctgactctctgccgccgtctgaaccgaccaccgattc

SEQ ID NO: 27892 - DNA, 1460 bp, Heterodera glycines
cccagggaaaatcggcggaaaatgtgcacgcaaaatttgtggacgattcggagggaagtcgcgaaacggaggcattggaaaaatttaaaattcgaaaaaatacaaaaattgaaaataaatataatttgaaaatgccatgtttgcttgtgccagtgtgcgttggatcagctcggcttctcccccgcggagaagggatgggtgcgcgagttggccacggcgtgcgttctcatcggcgaggcgcaatttggcgaacggcacggcatggacatttcctttgtggaggaaatggcaggtgcattcattgccagatgagaaaatatttgtccccaaaaagccgcgaacgctttacagaagttgaagcggtggctgaactgctcggcatccgtgccaatgctttggtggacgcactcactcaggcaaagccaaccaatttgaaatctccagacatttacgattctcgactcattaatcacgtccgttcagccatccatccgcgtcggtgacgcgctcatccgccgctcgcagccattgcggaaaacgctttgtgccgcccagtctttggccaaatgcgtgtacgaacgactgttctcgtgggtgctgtccaaatgcaattcggccatacggcggggccgaacagggagtggccaaagcgatgaaacggacggcggaagagaggccaacggaatggtcggagtgttggacatggccggcttcgaaataatgccgtgcaattctttcgagcagctttggtttggctgtgcatcttcgaatccaaaagtggcgcccattaagcattaattacaccaatgagcgacttcagcagtttttcaacgaatttatgttcattagggagcaggaggagtacttgcgagagggaatcagctgggaatttgtgaaggtaaggcgaaacgggggatgactcatttgaaatggggcgatgactcatcaaacaaacgaaggacttcggcagagacttgcagccgaccatcgatctgatcgaaaaggttgtcgactacgtccatttgggcatttgtcatttggcaatttcagccactcggcattctgtcgctgctgcaagaggagtgcattgtgccgaatggctctgatcagtcgcttctcgacaagttcgtccttcggctgtcttccgcctcccccggggccacatttttcaaggccaaacaatccaatcggtaatcagcagctgttcttccccatgtgtactgaacagatatcccctcatcaaacagagtgccaaccccccatcacttcacaatcgcccattatgccggccccgtcagttattccgtggacggatggctggagaagaacagagacgcggtgggttttggcactgacaaataggcaatactccaaaagggtgcacaggtggacggtgcactgcttgaactgctggccacctcctcccattcgctcgtctcccaacttttttcccggaggga

SEQ ID NO: 27893 - DNA, 1204 bp, Heterodera glycines
aattgattttttctttcttcgtgttagtattgtaacggtggtgaaatgtttgactacattgtgaagaaggagagacttactgagcccgaagcgcgacatttcttccgccaacttgtccaagcgatcgcttacattcattcaatgggttggaaacgagtttttagcttttaaattgtctctgtgaatattttgaggttttgctcacagagaccttaagccggagaacctcctcctcaccaacgaacaacagctgaaggtgatcgacttcggtctctgtgctaggcctttgaagggactcgacgctgttcttgaaacctgttgcgggtcgcccgcttacgccgcgcccgaattgctccaagtgcgtttattgcacctttgcagtgtcccatctgtttagaacagctattatttcgggaatgaggctgacatttggtcgatgggtgttttgctgtacactctcctctgcggctgtttgccctttgatgacgccagttacccacgactctaccagaaaatcagggtgttttttacgatactttggccaattaaattacactcatttgcagaggggcgtctatttggaacccgattatctgacctcggaaacgaaagagtgagaagccatctcactaacaataagcaaatcaccgcttttgtctatccaggtttttgcgttgtatgctcaccgtcgacccaaaacaacgagcgaatatcagacaaatattgacccatccctggctcaacaaatcatacagacagcaaataaaatggcaaagcatttacaatgtattatttcgttgtttttcattttttgctccatttaattgctcctttttgtgtgtatcagcgggacattgttgatgcagatgtttgtcaagaactcgcttatttttacggcagtgaaaaggaggaagtaattgcacaggttaagcaggtcttttgccgattcttcacggttttatttaatctttcgtccattcagtggaaatatgacagtaaaactgctaattatttgatacttctgcagaaaagtaaacttagcaacagattttccgatttatttgtgtatttttcaagaggagcggaaacagaacattgcgttgctctcccacaaaagagttcagtctcatttaaccttttggtgttaatcgttctctttttgaagtcatttcagttggttaagaggccctcgtcactgacaatc

SEQ ID NO: 27894 - DNA, 826 bp, Heterodera glycines
gccggacccctttggtcccaaaaatttttttgaaaaaaactcgccgaaaaagtgttgagaaaaatgatcagcagaaataaaaaaaaatattggaaaaaatctgccggcgcaaaatacaaaccattagaataaaattaaccattttcatttcatatgataaaatttttacgcgtccttggatttgaagaaattttcccgttatgtccctagaaatcattatactcgtccttgggaagcgagtttttccaatgggaaactctgtataaaatgcttagataatacggtttttggcaagaatattttttgtaaacagaaaaggttgccaaaaacaaacacattttgcctaaatttgcatgttgctggacaaaaaacaaactgttaacaaaaaaagctcttcataatttgctgggcacctgttttgcgtgaagaagaagcatacaaaagcaaattgatggtttgtcaaaaatttgattgttgaaatgaagaaatgcgatgactgagtgatcaatatgatcatgtgtctgaaacagtgatgccaactcgaacccgaaccccgaggtttttctcaacccgaaacccgaacccgaagttttttgagtgcccgacccgaaacccgaaaatttttctcaacccgcggcatcactggtctgaaacgcgggggaagtttgggcactaaattaaggatttaaaaaatgaaaatatttttaattgtctataattgcagccatctaatttaaaagcaaagaaattttagtcaagttaggaaccgaacatttttccacgaatatacgctcaattaaccattcttattttgctaaacttatta

SEQ ID NO: 27895 - DNA, 961 bp, Heterodera glycines
acttgcttttataactttatttatgtttactgcttacttccctagttaaatttccctgcatttccaatgcttttcctttcgtctctctgtgctaaattttgcttagtttatccactaatttctgtcttcgctttgctattgctttgccttctcttccttttactgaattttttccctgcaatgcctctgctgttaatcatatttatagcactatcagtgtcattcagtaattactctgtccattcattcatttgttaggtcaatgagcagggaactgaagcgaccgccgccacgggcattcgattggtgccattaataaatgccaaaaatagcccggctcgtttcattgcggatcgtcctttcttcgccgttgtcgttaacagtgatgcccttgccctttttggcacaattttccatggataattttgtcaagatcactacaatattttaataaagcatggaggaatgttaagtcgtatgtttttgcatttaaatcttctttatcgtcttttattaataattttcttttttgttcactttcattcaaatttcgcgagatattctatatttaccccccacaccccaaataagtcatttatcattctaaatttgaaaaaaaattaaaaagtgtcttgaattaaagccggtgattgacccactatccctcttgtgtattagacaataccatattattttatctgattaatcccttaattctgtgaagggttgtcccaattttatagatttgccaaaaaactcatcagaattttgcataaaaacaaccaacttaaatctttgtaatatagcagcagctcttggattgctttactagcagaaaaatttcagaatttattctgttttcaaaacaatgaaaaacaaaatgacattagcgagtgttttttgttaggccaatcactttcattttatttggcccaaatttggcacttaaacaaaacactgt

SEQ ID NO: 27896 - DNA, 1311 bp, Heterodera glycines
cattgttaaaacttaacaaagggatgaaaaatcgccaattccgcgcatttttgtgccgaattatttggcgatgccttttccaaaatgttccaaaaatgggaataatcctaaaagatttcaatgcttctgctgctgatcagcaaaagtgatctccccccccccccccaattgcccactttgtccagcaactgaagcagcagcgtgcaacagtttctgctggagaaaaaaggcggttgccattgcgacacaattttggccaccgatggcgtcactttcgccgtttgtttcgccactttcgttgttcgtagtttggtcagcttcacggtttaattgttcggcactttcgcggttcgtttcggcacttggcatccttttggctgtgccgtttcccgttttgctttccccgtcattgctttcgtccgaattgcccctgaatttgtcgtccattaataaaattattgtattggtgcgatattttttccttcgaaaatttgtctaacttcgtttgcttttgttttgtggtcgccagcagaagacggttgatactgtgctttgctgatcgactactgtaggcatttgaggcgggcgaagaaaacggaggagagagcgaatttggcatttgcttggacagtttctgagaaaagggcacaatttatggggggaaactattgaaaaacgaaataaatggaaaaattaaaattaaatagaaatatgaaatagtaaggataccataaaaaagtgttgtgaattggttttgctttgcttcaatattttgttaactttttgctgctacgacttggctcgagaattccgactttgttggccaaatgccgcaatcgaatggacttttgccccgtcccttccaatggctgccgccgactccgccccaaaggtggcgccgattggctgctgccctcgccagcggcggccgcgatgagcacgataatatcacggcatgccgaaatccttccccgcggcgggcacacatttcgccaaaggccacgcccactgtgaaggaatttggcacatttaccaagcattttacggaattatgctgctaaaagctttcatttttcgaatactgtgccgaaaaaagatgaaaaataatggcaaaggcaattaaaatcattgcaaaaataattttaaaaaatgtaaaatttgaatggaacgacagcgaaaagtcttccggcgccgaatttggccattgtcattgtgggcggacatcgccgcctcccccgaggcgaccgtctcaaatttcatgccttccccccccccccccccgcggcggcacaaaaatttgtttatccattc

SEQ ID NO: 27897 - DNA, 1376 bp, Heterodera glycines
  misc_feature (1264)..(1264): n is a, c, g, or t
cccataaatattaaatcaatatacggtaatacccatcgagagtaccaatcttttgaaaaatgtttattttcaaaaatcatgaaaatatatttccaagggttttcagggccgctgatcacgaatatggcgtctatttcaccatttcctatctaggaacccgaattcgaacaaaaagtcgaagttcaaatgttttgaatttcgcatttttatataaaaataatttaaatgtttttttattgaagtgttttaaacaaattaaaaaatcaagaatccaagcctggatccaacctttgatgacaagcgaggatttttcatggacctggatttttgtcagaaaacggttctaggttcaacatgaaacccggtcaagggctgcttttaaaaacatataccaattctaataaaaataaaaccgcataactctggtttataaataaatttgtttttccttctacttttttgaatgattttgtgcttttttctagaaaaatgaggactgtcacttcactcaaacattcgtcaaagaaaagcgcactttgcaatatttggctgatgcaagggcattgtctccgggcggagacgtgtctgtacgcacatggaattaatgaacttcgactgtcgctgatcgaattagaaaacttcagcagcagcagcagtaacaaaaacaaagacaagtgagtctcgcatttttaaatagattcatcgcttttttcagtggatccaattgtcgctttttccagcggggtgaatgtttgagaggagacgaatgcaaatttgtgcatgaggtacaactggacgaaaaaagggagcaaagcggcgggtggggggcgaaggagggtgagggtgaaatgccgcatttgtcagacgccgtcttcgtcggagattgggaatggacaaagaccattttttggagatgaacatcggaagcaacacaaaaatgtgcgaaaatggaggggagctttgtcgagaagcagcagcaaccacgaggaggatgaggaggactcgctttcgaattggatggaaaaaattcgagtcggaggaggggcgagggaggcggacgagggacgaattgtccgactgatggtgttgaccttggacgtaaggccctaaagaacgtgacactaaaagagatttatttttagaaatcttccggcctcttttttaaaatcgctagaagcaaaccattgggtatgcttcgtctcaaaattgcagaacgtcttaatatcgaggtaatttaattggggtggtaaaatgttagcattanatatgcaataaaaatttaatattgttatattctcgagtacagcagaacgaaattggccttttgttcatgccaagatggtgacggacaatcaaacggccgacgaattggagct

SEQ ID NO: 27898 - DNA, 1233 bp, Heterodera glycines
gggagtagtgtagagtgtagagaaactacactggatacgctacgctagtgcatttgctacgctagctttcgaaaagggagtagtgtagagtgtagagaaactacactggatactctacgctagtgcagttgctacgctagctttcgacaaaaatgggagcggactgacggtttcgctgcccttttatagacttttctgtgggagtagtgtagagaaactacactggatactctacgctagtgcatttgctacgctagctttcgaaaagggagtagtgtagagtgtagagaaactacactggatactctacgctagtgcagttgctacgctagctttcgacaaaaatgggagcggactgacggtttcgctgcccttttatagacttttctgtgggagtagtgtagagaaactacactggatactctacgctagtgcagttgctacgctagctttcgaaaaaagtgggagcggattcacacagaaaatgtgtctctttatataggctcttagctgatgctagtgtagcatctctgaatttaaaacaaaattaaatttaatgtaaataattaatttatttcatattagttaaacaaaaacatttaaatgaattaaaagcatagaaaataatgataaaatgcaaagaaaaataatgtacaccgcccggcttcgaacttgccccccccccaaaaaatgatgcctcagaatccccaatcacacggggattctgaggccttaacgatgtcataactaaaatctgatttcatattcgttatcagcgacctaaaatagccctaaagacatgtttttagattatttttggtgaaaaaaattttcaacacaaaaatcatgtgcacccccctttggtcccgaatcccaaaatcacttttatttttgtatctttttaaaaaaaagtgataaaaataccaaataaaatttattttatagagaaaaaaattgcggatttaagtaatattttacttttcacgagtgacttttcagaaacgagttctgaatttttttctgaaaattcgaatttttccagaaattctggaatatcttttttatttttagagatgaaaataccaaataaatcccataaaattctcctgatttttctctatttttaaagctttaattcacttaaattgacaaatccttcaccgagttatgaattttcaaactttaacccaaaatcctgagggccaaaaatttcccaaaaaataaagaattttt

SEQ ID NO: 27899 - DNA, 1649 bp, Heterodera glycines
  misc_feature (702)..(702): n is a, c, g, or t
  misc_feature (783)..(783): n is a, c, g, or t
  misc_feature (844)..(844): n is a, c, g, or t
ggcctggcaggtcaccaaatggtaaagtggccaattttataatgggcattccgtcctctcgtcgtgtcgtcggtcaactaattgaaccacgaattatatactatgtaaactgaataattaactatttgcttcgactcattatcagccaactaatttatgaattgttttataattataataattaacaattattcatttactttaatcaaaattcctttttttaaccatatattttatttttatcattattttaatataacatttctcttaattattcaatttgcatatttcttcattccttaattactctttatttttaattatgtctcataataattgattttttaaggtaaaatcttcgcaaatattttttgtttacagtaaagacattaacaaatgtataaacttttttttttctgttttcaaagaaaagtgattctcgagacaggtgcaaattttgtcatggcatgcccttttagggaccttaatttagtctctttgagaactaattaaatttccaattgattaccacttcctatttttatcgtttttaatgcaaataatttatctttctttatataattatttaaattacaaaaacaatctgtgcttaattaattctgaaaattcaaacggttttcatgactccagtcatctctctctatataaattcatcaaattaaatgaacattaaataatganaatttgtttgttctaacattttattaattcaaattcatttcaacaaacttttctcttgatatattttccactttttcttanattgaatttagtactttttaatatcaattttctttttgcctatttaatttaattaaataanatttttttttcgaatattttttctttttgatttttataattcataattatttccacatttgcgctgctctgctgcgtttgctcatcagcagcagcagcaacagaataaaatcattctgctgcgctcatcaatcattgtccgtgtgatcaaatttatttttcgccgctcatttcgccgaattgtaatttttgcgacattttttcgcatcgtttttccctgaaaaatcattcttcagagaaacgagtccttagaatgtgcgcacgagtgcaaaccaaacacaaagattaagcatcatgggaatatttcgccaaaaaaatgtcaaagaataaatgcaaatgccatttttagacacagtttttcattttttgaatccaacaccttaagacggcatattagcttaataaattaaacgaactcgaattccgttaaacatcagagccaccagggaacatttttcaaagaaaaaatttcgaacgaaaataaaaatgtaaaatgcccttttatcaccgacctctgttcctgcgcccgccgctattcaaaactcattttagtaagaaaaaaaattatgacgcaaaatatcgcggagggttcacgccaaacccaaagattaaacatcatcggcactaactgtgcacattcccgacaaccaaaaaagtgcaaatgccattttggcacttttgttgatcccttcaaatgccaaatccctgcccgcctgtgtatgtgttgttaaaccatgatacaaaataaaaatgtttgttaatcctcaccccccccccgccattctggctctaggaaaatccgacac

SEQ ID NO: 27900 - DNA, 1018 bp, Heterodera glycines
catgcataattttttatggattttaaattccttaaaatgtctattcagtcataatgaatttatatttgatagtcatcagaattctctattaaacattaaaatttaaaaaaaattcattgattttcaaaaaagttatggccaaaaattctgactcaagattttttgaaattttctgaccataactttttgatctttcaaagcctttcacgagtgataaacaccccaacctccaatccagtcgacaataattattatggaaaatgaattttaagctatataattcatgatcgatttgagtttttgagtgcgaacattctttataaaacaaaattttttgcatacaaatatttatattatttcaattatatatcttatgattcaaaacaataatgcattttattttcctcaattcgcatatatagttaatattatttgtatattttaattgaggtttataattgttatgagccttgatttatattcttgatatctaattcttataattgaatatattttgttttgtgaaagtcttcatttggttgtaaagtaataaattgtagaaaaaaaaaaaatttatttgaaatttaataaatcatttcaattactatttatcataataattgcatataaataggtatacttttttttctttatgacttgcgattattaaatgttttatttgaaattatatctcttaacatatcgattcttcctgatttattagcaaaaaaaaaccaaaaaaaattttaaaaaattatgtttgttaactgtggtaaaaatatataaagttttttcatttttaaattattgataaaataaaatatttgtgtattaattttttatttcctaattgtttaaaacaggcgtttatttttaaaataaatttagttaattattttcatttgaattgtaatttagctaacatttatttcatgacagcggatcatttttataaatcatgggtactcctaatatgtgccttacatttcttactttctttacaagtgattctattttt

SEQ ID NO: 27901 - DNA, 1242 bp, Heterodera glycines
  misc_feature (28)..(28): n is a, c, g, or t
cagcttgctggctggcaggtcaagaaanattttcgattttacacccctaaattcgaaactttttctcacctattttcccatttttagcacctattttggggtttttttataacttaaaacctacctattttggcagtttttagcacctaaaaatcgcatccctagtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctattcattaattatcacattttccacacatatcaaccaaagtaccttatgctctgtaaaaaattataactccaacgatttttcttcatttcgactacttcccttgggcgaatctagctgaaatttttatcatgcatacatacctcgtaaatattaagaatcacatacataaaaaattggaaagtttacaagaaaaacatttggcgcaagtccagtttatgcgtccattcaattataaaatctaattaattgaattgcattgacagtgtttttttaatatatgagataatttagccttatctgctccaaagtatgttgaatatttttgtttttctatggtatctctgaaaagtgtgtatttaatgaaacaaatatatatgcagcatttcctcaatatgtactctgacgtggttttaccgcaaaataataacaaatttctatttctgtacgggtttttaagtacagactttctttttggcgttcacttagctgatattaatttattggacgcataaaatctgatctgatcggcgcataaaaattgatgggacgcacaaaagtcgattggacgcataaacttgacttgagccaaatataggaatttaaatttaaattttcgaattttgagttttgggtcgaactagatctaaatacattaaaatgaacttaaaagtcatcagtgcttcaataaaagatcgtttggtaatactttgctttgtaccacttagggaaggaacccgactttttgggattttaataaaacaaaaaattttaaaaattcacccaaaatcagacaaatttacgtctgctttagccacagttttaactatgtttccggactcatcgcaaggaggtagcagaattttgagcccatactaataaccacaacacaatagacaaatcacaatacatttttta

SEQ ID NO: 27902 - DNA, 1396 bp, Heterodera glycines
  misc_feature (40)..(40): n is a, c, g, or t
taattggtctaattatgggcaattaaggaattgatggacncaagcaaaggcttttacaacagagaagaggaaaaattgacattggccattgatgtcacagtgaaagatgaaaaaatggacaaattcattttggaacaaagcaattccaatgggacaatttggatggacattgaaaaagtgtcggaatttgcacaagaagtcacttggagtgaacgtaaaagtgaagcggtgcacatcaacggattttcattgcgaatattagcacaaataagtccgaaaaatggaagcactggcaatgagaaattgttgggaatttaccttttgtgtgcttctccaacagaaggtgtaattaaaggctaattaatattaattaactaattaatttacattgagcagaaaattggagctttaagtgttcggcaatcattcgaattgtttcacaaaagtgcgttgtggcggatttaatgaccaaagttaatctacatattcgaaacaatgaacataatggccggggattacgcaatttcattacttttgcggtgagtgacaattgaacatattttccttaattgacgtaattatgggcaattaagcaattgttggacccgagaaaaggcttttacaacagagaagaggacaaagtgacattggccattgatgttactgtgaaagaagcaaaaaaggaagtagtagtgatgagagcatttttttagggcaaaaatgtacttactcatcactactagcggataaatcatagacaattttgcaatttactcattgaatctctcatttgtctaatattgctgttattcatattaaaaaaaatttttggttagactaattgtcctgttttttattctataggcaaacaattttttttaaattaaaaatattgactgagttgtgagtagttaacagcccgtgaccgtcgtagctaaacactaattagaaatgacaggtggcgggggaggggtgtcaattagtgactaattgactgaccggaaggggcactaattggtcagcggccaaaggagcgctaattaaattgtgggcctatgcaaaatttcaagaaaattaaacaataggaaaatttttttacagggacaaagtttttcctttaagtcggtttcaattcttaattttttcaatccctgatagccgaaatagcattaaaattaaaaaacatagtctgatagtttaatagagcattaattctgttgtttgaataattgctgattttttcaaaaactaactgatgatcaaattatcggtcataaatcatttaatatcatttagttaatgctatttagactaccagggatagaaaaactcaaatttgaacccgactttagacataggcgcaaatgtccgaggcgcaaatgcctggaaacgcttt

SEQ ID NO: 27903 - DNA, 713 bp, Heterodera glycines
ccagcccaagtttttgggttataactttttttcttgttaaccaaatccagcaatcttggtatcaatcgaaagcttaacatgtttagaagatatttctaagctattgcttcgcgattagacaattaccaaaaaagttataacatgaaattccaaaaaagtcgaaatttttgagtttttttcttaataacttttttagaagctaaaatttttgtttgttttttgtaaggctaatagagcttgtgaagggctttcgaatgataccaagattgttagatttggtcaacaagaaaaaaagttataataaaaaaactgaggctggcgccaaaacgtcggcgccaaaacgacccagtccccacttagggctatcgaatgataccaagaaaatttgatttggttgacaaagaaaaaagttagttcaaaaattcgccccacgcgaaaacgaacccgacccgaaatttacatacctactacattaaaccgctgcccgtcatttcgtcccgcgtcgtttcgtcccgcgtcgtttcgtcccgcgtcgtttcgtcccgcgtcgtttcgtcccgcgtcgtttcgtcccgcgtcgtttcgtcccctaagccaaaatgagtcgtttcgtccccaaattaaattcttttttaaaaggttagtgcttattttggcattttttagagcctaaaaatccgatccctagttaatgaattaataaaatactttat

SEQ ID NO: 27904 - DNA, 582 bp, Heterodera glycines
tccgccggggcccgtagaataagaaggtggttaaatgaccgggtcaaacgaccatggttatttgacctggtcaaatgaccacgaagttggtggtaaacccgtagaataagaaaatgaccacgaagtgccgtttttaccaccaacctccgtcaaacgaccatgaactatgatcttattctaccgggttatttgaccacgtgcacttttgggacaatttgtttacacattttttatggaaaaataacttttgttttttaggtctatcgcataacacatcattcctattgatcaatttttatgtttacccaaaatgttacatgtatttttgcaccgccaatatattatttatttgtgagttaaagacgaatgatcaactcataaaataataatattttataattaaatctaagatcacaaataaatttagaatgtcaatttttaccaaggaaatgtcaagcgctttagcgcaaaaagttcgcgacaattacgaagaattgtttccgcaaagcaaggaggcagcgttttcgcgccgttcgtaaaatgcttgggccaatttaacttcagaaattaatgccgaattcg

SEQ ID NO: 27905 - DNA, 975 bp, Heterodera glycines
tcgggggggggggggagtagggtgcggggtgcggggagacggggacggggaagcgtggacggggaggcgggggacggaaaagcggtgaatggaaatacgggggacagggaggcggatgcggaaagaaatttatactaattttatatatgtattttttaagtttgagtgttttcctgggggggggctgccgccccataaaatttctcaaaataagagatagtcattttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcccttcctatcaagctcgagagcatttgtaacgtataaaatttctcaaaataagagatagtcaatttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcccttcctatcaagctcgagagcatttgtaacgtataaaatttctcaaaataagagatagtcaatttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataaagagatagt

SEQ ID NO: 27906 - DNA, 1848 bp, Heterodera glycines
  misc_feature (1842)..(1842): n is a, c, g, or t
gcggtgcagataggcgccgccgggggaaaattaagaattttgaccatatttttagcagattttcattgaaaaaacattcttaattttgtgaattttcggaaaaaatggttattttctggttttggtacttttgcagtttccagcaggacagttttaaaacagattttcaaatgcctataaatgtattttagaaattaatgaaaataagttttaattggtctttgaggtcgctgatcacgaatacagcatcctttttgccaatttcgaacccctgacccgaacaaagataaaattagaaactttcgtatgtatgatatcctcattggcatcttgctcatgagggtactcttggtattggaagcctatcaattccttgtccctgtacagctcatgtagtgaacggtagcgctgacctgggcacggattcatgatcagcgaccctaaaaaccccttaaaacttattttctttaattttaaaaacacatttatgtataggcatttgaaaatctatgttaaaactgtccggtaaactgcaaaagtagcctggtttttatgaaaaatttaacaaaattttttggaaaagttggaagaaattttcgttttgacgctcttttaaaaacccaaattattaaaatgattgtcaaacattatgacaatttatcaaaattcataaaatttaacagattctgacgattttccctaaaggcctcaaaaatcctcaaaatttctcaaaaatccctcattttgaaaatttatcttcactgaatattaaaaaacaacaaaatgaggctaaagcctcagacctgggaaccctgattaataacaagctaattatgagcaactttctgtgattaaacattagggcttccattttttctaagaaactgctaatttttttttttgaatttggacctaattaaatttgttttacaataacaaacggacattctaaagacaattttttaaaatgaaatgatattgtttgacctcataaataattctttttaatttctaagattatgcactagttagttttttaatttcatttaatcgccatctctcagtttgatatatttctttaataaattagttgacattcttcctttaaaattaaagaagaatcggcacaaataataacccaatttgatatttaaatcaattagttgatcattaattaatcttctatatattattaataaaagtattaagctatttttcatcctcaacaaataattataaaactatggaaatttttgacgagtttaccatttccgatgaaaattcaatttcgttttttaccgactcaaaatttttaatggagtcttctttcgctgcaatgtaaaatttataaaaaaaatattatcctaattgtagaaaatacctaaaaaatattaaaatattttagcgaggccctgctcgacagtttttggctgaaattcaaagatgtgggaaacgttcttgaacaaaatgtgccattagcacaaatcattttatgggcgtgggacgacaacggggcacaagtcatcaaagaagtgattaccgaccaaaatgctgtttcacaaaattcttaatttagtcagtgatcctgaaaagcggcggaatggtttctttaccggtagatgcaatttcatcgccttcaattgtcgtccgttttctcaaaaaacgcgaagactcagaaaagtgaaaaatttacttcatttgtattttgggtttcccctaattttttcatttttctccagtccttgccctccgctgagttcgccaaccgatgatttgactgtgcatattggagaccggcagctaagaaagctgctaattgctctcttttatataagccaactnttataa

SEQ ID NO: 27907 - DNA, 922 bp, Heterodera glycines
  misc_feature (23)..(23): n is a, c, g, or t
aaatttactatttatgtatttanttcgtaaaaataaaaaagtcatcagaagggtgagaaccacttactctgacgactattcagtaaatgtgtcgtagagtaagttacaaaatatatggatgatcacaggaattaaaaaaagacaaaaatgtgaaaataattaaattaaaaattgaggtcagagtcaaatgaggtcgaaatataaaaataccaaatcacttacgacaattttaactcgaaaagtcctattacttaaaaagtcctttatccacaaaccgtcgagtgtaaaagaattttgttttttgtagtgtttttggaatagtcaatgtgaaaaattgcgctaaatgatcagaggaaaaaacaccaccttcaatagtacattgctttacaatttgatcattcgctgataaaactaagtctaaccacgaattttccctggtgggtccattcgtggcattgaaaaaggaaagtttactaaaaaagtggcaaaaattttcaccaaatttactcatagaaatgggctgccctccttccataccaggtctttacttgggaaattaaaatcacccaatacaacacaattattgctatagaatgtttctaaaaatttaaaaagttccttggtttgtctatatgttgtcttgggtggtcggtaaacaagcacaaatctgattgattttagtttttgtaattgaaaaaccaaaatttcgcaattatattttgtttcagaaaatttaataaaaaactcaatttctttcttaattaaaacaccgaaaccgcccccacgcgttaattttttgtgatttcctatgacaaaaataaaggttatagttttcgcttatcatggataaagaagggattgggttttcctccttgcccatgtttcagtaacagaaaaatttctatgttttatttaccaaatt

SEQ ID NO: 27908 - DNA, 1143 bp, Heterodera glycines
  misc_feature (67)..(67): n is a, c, g, or t
  misc_feature (1064)..(1067): n is a, c, g, or t
  misc_feature (1073)..(1083): n is a, c, g, or t
  misc_feature (1085)..(1085): n is a, c, g, or t
  misc_feature (1088)..(1090): n is a, c, g, or t
ggtttggaccagttttgaccgggaaattcccggcgtttttcccggttttcccagccaaaaaatcccnggtttttgtcaaaattcctggtcccgctcaactctactttaaatacatattattaaatttcagtattttctaacaattactttctgattcgtagaccgattagtttgttttggaaagaatatcttttatcccccccccccgttttttgtgattttttcttataaataactcttctttcgacgaagagtgtcaattgcatttgtcttcttaatctgtgaaaatgtattggcaaatgaaaagagaaaatccaaaaatgagtgatgaaaaaattgcggaattttgcaaattagcagggatgcaaaaaacatgcaaatgcatattttttttcctggcttctccatgctctaaatagtaggaaaaacactttcttttttgtgtttgcgtataaaaatcgggacttttatttgcatatttttgcatatttcgaggtttttgtgcatatttatgcatatttcgccattttttggaaaatttgttaacaaaaatgcaataaaaacggaaaatatacccctaagaatcgaccgaaaatttttaaaaacacaccactaagaattggaaattttctcaaaaattcttcccccaaatttttttttcatgagaaaatgtttgatttaaaaaatgccaatatttgctaaagagaatttttttaaaagaaatgtagttggcaagtgcactagtaaaaaaaaaattttttttttttttgaatttgcacccctaattttcaatttttttagtgcatattttacgatttttgtgcatatttggtgcatattttgtgatttttgtgcatatttggtgcatattttgtgatttttgtgcatatttggtgaatattttgtgattattgtgcatatttggtgcatattttgtgatttttgtgcatatttggtgaatattttgtgatttttgtgcatattgaaaaaatattttgtgatttttgtgcatatttggtgcatattttgtgatttttgtgcatatttggagcgtttttaaaggnnnncccccnnnnnnnnnnnanacnnngcgaatctttgatgtatgtggtgcatattttgtgattttaatgcatatttggt

SEQ ID NO: 27909 - DNA, 1649 bp, Heterodera glycines
  misc_feature (46)..(46): n is a, c, g, or t
  misc_feature (1600)..(1600): n is a, c, g, or t
  misc_feature (1630)..(1630): n is a, c, g, or t
gaaagaataggtaaatgataaaataaataataaataaaattatttntaagaacatggggactgtgtataatctccatttatttcaatttcttcacattgtgccgcaaaactagtaagttagactatgagacaatggaagattgaaaatatgggaatgggaaaaggcgaaggcaatctaattaaatttaatgataattaatgaaaatttattcaaattaactaaatacactaaaaaaaaacctgattttaggcttttagttttttttgtgccatacttaaaatttattgacaaaaaaaggcatcacagaagaggatgtaaccaatgcaaattgaaaaattaaagtttttaatatgaattgaaatttatttacataaaatcattgtgtgtttagcgcataagaacacaaaatatttgcaactaattattttttttaattaaattgtaaatttttcctctcacaacactcattaaagcaatttgtttcggtaatctccatattattatgttttctctattaaaaattaaatgtcatatttttatttccaatatcaaaaattcgtattttattttgaatttttataaataaaatctctttaaaaatattttttattgcatatgtttttcaaaataataaccatttggtgcgctttattatttttatcaccttatcagtgtcaatcaccgttttcgctttgttattttcgtgaaaaatggatgaaccgagaaaaggattgataataaaactccataaaattgtcgtgttatcagtgatagtaattttctaatcacaagtcattcaaaattgcttttcaccaccattttgaacggaataaattgtcattgccttgcattaatttgctcatttattcgtatttgggtgtcaatcttgggaaattttcatgtttattttaactttaaatctctgtgaagccatattattttttttttggaaatttaatcaaaatttgcaagttaattaaattgcaaacattatttgtcgttaattataaaaaaataataataaatttaaagatttttttaataactttaaaaatcaggcataatcaaacaaatatatttccgatttggcatattttttattttgaaaaagatagaattttcattaagaaaaactaaattttatttggcttttaaaaggcttgagaatgaaatttaagaatttaattcaaccaataaaatttaaaaataattcaaactatcattagcaagaacattatggtaaacaagtttttaccgctgatcattttcgtttttctgctgattgacaccgccatatgtcgccatcaccatcggcactcccatcatcaccatcaacaaaatgagcagccggagatgatcaggcaaatttctttgtttccataatttaattaattgaatatgtgtgtggtctttgaaaatttaaataaaatttttaatgacaacaatttaattgaaatcttagtgtaacattttgcattttgcttctacgaaagaatataatgacagtaaaatagttgagctaccgtacccaccttaaacatctgctgatctttcgggatttttcaagctaatcatagggtttatgttttgttaagagangtaaaaataattttatgtctataattagcnaaaaaaaattaatttcgga

SEQ ID NO: 27910 - DNA, 956 bp, Heterodera glycines
ccccgaaatttccgtaaatcgaaatccgatgccaatcattttccataaattgttaattggaatccgaggccccgaaatttccgtaaatcgaaatccgatgccaaaaattttccataaattgatcattggaatccgaggcccccaaatttccgtatcctgtgccaaaaattttccataaattgatcattggaatccgaggccccgaaatttccgtaaatcgaaatccgatgccaaaaattttccataaattgttaattggaatccgaagtccccaaaatttccgtaaatcgaaatccgatgccaaaaattttccataaattgatcattggaatccgaggccccgaaattttcgtaaatcgaaatccgatgccaaaaattttccataaattgttaattggaatccgaagtccccaaatttccgtaaatcgaaatccgatgccaaaaattttccataaattgatcattggaatccgaggccccgaaatttccgtaaatcgaaatccgatgccaaaaattttccataaattgttaattggaatccgaagtccccaaaatttccgtaaatcgaaatccgatgccaaaaattttccataaattgatcattggaatccgaggcccccaaatttccgtatcctgtgccaaaaattttccataaattgatcattggaatccgaagtccccaaaatttccgtaaatcgaaatccgatgccaaaaattttccataaattgatcattggaatccgaggccccgaaattgccgtaaatcgaaatccggtgccaaaaagtttccaaaattgatcattggaatccgaggccccaaaatttccgtaaatcgaaatccgatgccaaaaattttccataaattgatcattggaatccgaggcccccaaatttccgtatcctgtgacacaattttccatatattgatcattgtgatccgaggacccgaaatttcc

SEQ ID NO: 27911 - DNA, 1249 bp, Heterodera glycines
tcacaaatgcaatgaacgctgggtgtgaaaattgtcacattttccacgaatttgagcggggatgttttattcgcccattggagccgaacaagaagaaagaaacaaatgggtggcgccttgtcatcttcgacgttgaaacaatgcagcatgagcctgcggacccgcatttccctaaacgaaagaagcatcaagtgaattttgtcactgcaaaagtggcatgcccggattgcatttcgaccggaaaatggaaagaaagccttattggaaaattctgcaaaatttgcggctatcatccgacaataacattcagtcaaatgccgttccgtgagacaacggtcgacagacaaacaattgaccgccaccctcttgttgcattcgttaaatggcttctctacaaacttccaaatcaatacgaaacaattgcctattcccatttcggcggacgtttcgacatggtcttggtctttcgggaacttttcatggagggactgaacccctcaatgatcagaaagggaaaccgtctgttcgagatgagggtataattgtccatgcgttttttatttaataattttcccatctcaggtgaaaagcagaaagaacttaaacccgaatgtgacatttcgtgattcttggaatttgattccgggactgctcgcctcaatggtgcccatgttcggcttggacgtgcaggacaagcccttctttccacacatggccaacaaacctgacaattatgggtgcaaaattttaccggcgaaagcagattacctggccgacggaatgatcccagagaaacggaaacaatttgatcaatggtaccagcaaaacaaaaatattccgtttctgctggatgaagcattggcaaggtgaatatgaataaatcaattttgacaaaataataaaaaattaagctattgtaaaaatgatgtcgacattttaatggctggactcatcgcttttcgaggcgaatttttggagatgacaaaacgaccggcaggtctcgatggaaaagcagacagagcggcgtacaaaacagcgcataacggcattgaccctgttcgacattgcgtcacaattgcgtcagcctgcatgcgccattttcgaactaatcacctaaaacctggacatttggcacttgtgccagagaagggttacgacagctgtggagataatcagagtgaactggctctcaattttatgcagtggtaaggggaaaagcacagcgttcgaattcaaaatgcattctcgg

SEQ ID NO: 27912 - DNA, 1106 bp, Heterodera glycines
  misc_feature (11)..(11): n is a, c, g, or t
  misc_feature (26)..(26): n is a, c, g, or t
  misc_feature (71)..(71): n is a, c, g, or t
  misc_feature (73)..(74): n is a, c, g, or t
gagtcgcgganaacgagaagggtacnggatgggcagacgcgcgcggaattcggcacggacgtaaaccgcgncnntaaaggcacaataaaaggggtggatgatcgaacaaggtttgaatccaaaacgcgcctctccgtccaaactgcctactcgcgcgggttgcaatccgtcggcgagcagtcgcgtcgtcaccgccggaaacgcttcgcggtagggcgagttcgcatgcgcgctctgtgcgccgacgaacagccgttccgcgacgagcaatgcggcggttgacgcgtccggcgcattcgctgccacggggatgtgctgccaagtgccggcgatggccgcgtgccgttggagtcgttccaacgagggcaattggcgaagttggcattcgcctaaaagcaaaaattgtgcaaaacattttcacaagcgctttccgtgctccccgaccttgtcttgtcgagccacagatgagcagagcatcggcaaaatgtgacgacgcattcagtggctgcacaattttgttccacgtgtccgtctccgcaattccgtcgcgtgggccaacgcacgaactgagttccgcgttgcagaacggacctttaggccatgtcatgtttttggttccaatttccatttcgactcactgtccaaaatgggcccggtcaccgcttcgtgcacaacactcaaattggccaactccaaaacgtacaaccgattgacggcgccgacaacaagctgaaaatgagttaatttgtctttcaaattcgccatgccaatttaagcttggtccgtgccaattcgttcagtttccttttgcccgtctcacccattcgccgtctccgctctctttaggcaccctcagaaattggttgacacggccatgcgccgcaaaggaggccaaagttcgggacggattggaacaactgaccaattaagggaggggggattaagggtggttttaaatggtaaaataccggcaaaagggaagcttttgctggagagaaaggagaaaaagcaaaaggaaaggccaatgaggggataaaaggcgaaaaaagtgccgaagggccatttaccgactcagttgtgcctgaggcaacgttcattggcactaa

SEQ ID NO: 27913 - DNA, 1950 bp, Heterodera glycines
gtggctgtgaggaagtgcacaacatacaggcacctccccccggattacggtaatcgtataccataccgatagtttaccttagaattacgataatcgtataccaattgactacggtggaattacgatactcgcataccgatcaaactcctaaaaatgtctggtttttttttctatgccaaatggccatccctgttattactatttattttgaattatacaaaacgtgccctctctttaagtttctacagtatgcataaaatacagtataacttccccgttttactgttgcagaaccatttgtactggcgccagaacagtcccgtgttgttgctgagcttgtacgcggttgtgtgcacgttcggcacggtggtcaatttgtttgtgctgttgtcatttgctcgggtttcgcaggtgggcaaaatgaccgattttttggattttttatttttaaaaatttaaaaaattattgcaaaattatttggcacaatttgtttttttatttaaaaatatttttctccaaatttcaaataattttaaattcaaaataaattattttaaaataattcaattatttaaataattaaattaattttttaataaattaaaacaaaaatttacaaataaaaaaatatttttaatttttttagcttcgcaatttgcacaattatttcatcgcaaatttggccgtctccgacctgcttctgtgcacagtgacagcaccaatgacactgtacttgtccatgaatttcttctggccatttgggacgccggcttgccaaattgtacgaccaatttttttcaaaaaatttttttgcgatttgtcccatcaaaaaatctcataaatttccccccccccctccaatgaggctaaatttaatggggacggacacaataaaaaaaaatgcacagctggcaattaaaaatgtccacatctgttgagatggcttttatggccaactttactgaaaaatggtgtccaaaaaattgtacaattttggagaaaatcggtgggatttttcattggtatttcaaaaaaaaaaaatttttttttgggattgaggaggagttttgtctcgctaatcaataagctaattgagggttgggcctgatcagaaccggtgattaggcttgatcagctcggtttcatttgatttttgattactgcttgatataaatgcatgatatcattgcttaatctcgatcagggccgatctgttttggttctttgatcaatcaatgctcgggtttgatcaggacgcaattgtttttctggtccctttattggttttgatcaagttcttaagcctgatcaattccagttttgttgtccaatcactttttccactgtccatcacagatttcttccatccaagcggtcaacatgttggtctcctgcctgacgcttgttttggtcagtcaatttttaattttgaccatttctgatcacttttcttgcttgtatttgtgaccgaagtgtgccccctgctctgatcacttttccattacgttaaatgatccgaaagactgatcgaagttcaaagcaaaaaaaaacaaatttcatttcaccattcatctctctttattgacttctgctgatcaccgtgatcactgctttgatcaaaatttcttgttcagatcgcaatggatcgcttcttgttaacactgttccccgtcaaatggtcagttggccaaggccaaaaattaaaaaaaaaataataattaattactagagctcgacctggacatggatccaggagttgttttttcctggatccaggtccaggtctaggacgttttctgcaacctggattttgctggacctggatttttgtccgggtccaggaaatccaggtccaggtcaaatatgaaaaaaaaccaggtcctgatccaggttaacacaaaaacctagggggcttgacaaaatttttgaacaaattttcaaaaaatgat

SEQ ID NO: 27914 - DNA, 1029 bp, Heterodera glycines
tttcatcatctctggcgataggaattgtgttctatagccttgtcaagatcgaagtttgggttgaccgaagtgagcatttatcgaacaagtgtacattaatttaaaattttactcgaggcacctcaactccgccgtgggattgggcgcgagtgcgtgacaaatattggaaatttccgacggttctgtaagtgcttaccatcagtcttacaattaggattttttcttatttatttttttatttctttcgcagctatgacccgaccggcattactcatgttcgactcagcccgatggagaaacttcaggaccaaatgctggaagctgctaaagaacgtggaacccgcgattctaagggctattgggttggaaaacaataggaaaatggatgtaatttgatgtgttaactgttctttagcttgtattctcatataatatatacgtggagtaaataaaagaagattttagcccgatgatgacagatttttaagagttttaggcaaaatttaaaaagggaggccaagggttgccggttagcgcaggcccgtaaccagggagcagttgcggctcctccccatcaccccaaattaaaaaatttgagaaaaatgggaaatttttaaaatttaccttatttaacaaatttgacccaaaattttctaaattttgtccggcggtgcctaatggcactgccgggtcccaagctttcatcggtgaccgatttgttgtgtccttcaaatgagaatttgtggggagggcataacccaaaaagtgccttcacaatggttgcctggcaacaattaaatgacttttactggtagacttttgctcttctctttcgtccgtctgcaagaagaaaaaagaaataattatggacggagttcgaacttcgcaagagagagatgaagaccactattccgggttcaatgactatgaccatgcctacgatttgttggaggctgcggggggacgaataaggggaagggtaatccatccaccgaatctttgcctttccttttcccgaaggatgtttac

SEQ ID NO: 27915 - DNA, 1995 bp, Heterodera glycines
cgattctctcatggtcagtgttaaattactttcccaatactttctaggaggtttaaatggggaataaaaattgatgcaatttcaggaaaactctctccaaatcccactgattggcagcggcacctttcgagctgtgccttctgctggttgagcatcgccagcgacttagccctgtggttgacttcgtcccccaacgattccatgtcggtcgtcgactgtctctccaacacttcaatttcggctaccaaatttttgcgggtcatttccaagtcgtccatttgcttaataatataaattaaactggtattaaatcaccaaatgggacgacctttcgtcgctcttcttccttcgcccgcatctccaccatttgttcctgcatcatctccaattgttgcatgctgttgatcagactctccacgcatttgctggtcacgagttgttcgccgtattccctctccaactttcggtcgttttgcctaacaaaataaatgaccaattacaaaaaccgaacgaatggacaactgacactgcttgatcatttttgcgacggatgtcctccacttcgacctccatgttggacagctcttcgatgatgcgttccggtgagttcacaatgttgttgtccaatcgcttgcggttttcctcttcctgggcaaacaatttcttgcattcgtcctataatttttattaaaaataagcgaaaaatcactaataatatgttaataaatccaaagtttttgacaattttccgcccctttttcagcatttcatttttcacttgcattttcgcactgtgcccccaacaaaattttgtcaatgcgttcgacatttcttttctcatcctccgctagcgcttgtcgatcgttcaatttgtccttgagtcgtcgcactttgctgcccatttcgtcatttcgcttctccatgcggttaagcgcttcttcgcgatctttcagttgctaaaagggaaaaactcttccgcgtataattaattacacatcatctcatacagcatgtgtggaacgttcacagttcttctcaaagtcatgcgctttcatttgttcatccttaaatttgtaaattccgactaaattagcccaattgataaactaaaactagtaaactccgccaaattatacactcacaatgtgattgtccaccgccgaaagctctttggcaatgtcacactttgtggtgtacaagcgaatcagttgagcaatttgcatcttcgttctgcaggggtccggttgaaatagatcggagtagagaaattcgttagaaccatcgaacaacttgttgtacaccaaattgctgaacaaattgtggatgcaatgtatataaaactatacgaaaatactaattgtaagatcaaaataacaaaaaccaacgtaccaatgctgttgcgttcggatgatcatctggggacgagccctcgtcagttcagtggccatttcatactcgttctctttggtggtgccgacattttcaaaaatcaaatcacacagaaagtagtaggcctggatcaactgatcggacggctgaataaaaaaaaataaaattcaaacgatcataaagtcaaaaacctgtgaattgtcaagcaattcctgcgttactccaatctctttagcctcacggttgaagaattcgagaataaaacgagagtcgggtccagccatttaatactcttaagttaatttggtaattattacttaggcttattttattgtaagagttgcttttttacgggttgctattgactcaacgaaggaaagatttttttaaatatctttttttaagtggtagtgctacgcgtaaaagtcgattggacgcgtaaactgcattagagccgtagctgctacctaatcttatataataaagttgattgtttgtggctatgtaacatggtttgaatgtggcgttttgtatttgctgtgaggagagattgaaaagaaaaagagatgaaaagaaatagtttgaaaaagaagaaggtaaaagaaa

SEQ ID NO: 27916 - DNA, 1080 bp, Heterodera glycines
tttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaatttttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaattttttaatttattctctatgccaaaaaaagggctctcttttttacgagaaattttgtaccatacaaatgttccc

SEQ ID NO: 27917 - DNA, 1051 bp, Heterodera glycines
  misc_feature (34)..(35): n is a, c, g, or t
aagggattatcggatggcggaattggttgtgccnnccgagtcaaattggattggttgtctgtggcatttgctggcgtgtaaaacgttttcccccttcccccccccccccccgggctaattttcaaattttgtcagtctttgctgtccattgtaatcaatcccaggggattgactctcgcctctggtctgatttgtcacatcccttttttgcggtgtgtcaatttgtgctccgccatttcagtcaccgccaccacttccgccactgtccgccgttatgcgttctttcatttcaccgccgctcaaaggaaaacagccgaaagagtacggcacgcttaaaagggacggacggagcagcaaatttaccattgtgcgactaacaacagttgccttcattgtacaacaggtgggacattaattaattaattgtatggaaaaacaaaggacagacaaaggggccgattgaccattaaaagcaaatggacactaaaagggcaattaaccgggaaggaattgggggaattcggttgaacttttgaaatttttgagactgcttatgcacccctcccgttattgttcttcgattttgttgttttgtcaaaaatggcactgtgtgttgtgtaacgattgttgtgccaatttggccaaagtcagattcaaaatttctaattgaccctcctttgctttttgccattcttctttgtttgcctccctccccataaatcatttgttaattaattaattattcccctttttgattttccgtgcctttttaccattttttttttgtactttgccaaaacaaatgctgccaattctcttaattgttaggctgaacaacaaacatttgccatttccgcccttttggcattttgaaaaatttcccctcgggggggggggggggggggggctgtttcccgccaataattattgtgcgctaaatggcagccatccaacggcggatttatcggataattaacacaaaatggcactgctggtgctgctgttgtacaaacggaacataaaaatagggtaataataaaaatcataataa

SEQ ID NO: 27918 - DNA, 1383 bp, Heterodera glycines
  misc_feature (1115)..(1115): n is a, c, g, or t
  misc_feature (1119)..(1119): n is a, c, g, or t
  misc_feature (1142)..(1142): n is a, c, g, or t
  misc_feature (1148)..(1148): n is a, c, g, or t
  misc_feature (1262)..(1262): n is a, c, g, or t
  misc_feature (1280)..(1280): n is a, c, g, or t
  misc_feature (1301)..(1301): n is a, c, g, or t
  misc_feature (1331)..(1331): n is a, c, g, or t
gaatctatatttggatgttcacgctaaaaatccctattttgagtgtttgcccctaaaataatttttttccccttattttggcatttctcttaaaatgggtcaaatcaaaaaattaatgtgtttgtgcacatctacaaactcttggctttcgaatgacccagggttgtttgggtccggacccgggaagtgccctaaaaagggaggacaagcgacaagcactttggtcgcgatttctgtgtgtcattggttcgatttcttatttttgttttctgttcacttttgttttccgttcaccttttttgtttgccatttttaattttatttatatcgatggtgaaatttgggtgatgcaaatgtacgaaaatggcccttaagaaatgggccgttaatgtacgggacacaaaagtcgggccgtaaatgtcgggcgccgcaaatgtccgattttggcttgggacgaaaaattcaatcctttttgcgtagttcaagtcctgaaagtggttatgagtgtctttgcgattgatatacatttcgtccatttttggctctggactatatgaacgatatatgccaaatcacgcgagctatttattaattagcaaactaattaaggaattggtacaagtggctaatgagttggacaacgaggaggacacattgacattggaagccgacattcagatcaccaattaaccaagagatgaaaacaaaatatcatgtttgttttatcatttgataaggtaataaacaacatttgcgctattttcttattccattctttcattttttctcatttgttaatgcacataaaccagtgccctactggcattaaaagtgatttgttttaatttatttttaaaattgaaatagcttcgctatttgcactgtctctagagggcgctccgttccaaatatcttttttaataaatttaattaatgaaaaaactaaaataaaataaataaaattaaaaatggcaaacaaaaaaggtgaacggaaaacaaaagtgaacagaaaacaaaaataagaaatcgaaccaatgacaccacataaccaaaggcagacacactaaccacttgactattggtccgcttccacacctcccttacaaattaattanattntctttcttttttggagaaattgngaccanagtgcttgtcgcttgtcctcccttattagggcactttcccggtccgggacccaacaaccctgggtcattcgaaagccaagagtttgtagatgtgcacaaacacattaatttttntgattgacccattttaangagaaatgccaaaataagggngaaaaattattttagggggcagcactcaanatagggatttttagcgtgaacatccaaatatagattcctgaaataaatctat

SEQ ID NO: 27919 - DNA, 864 bp, Heterodera glycines
aaaaatattagccctattaatatatctcaactttctattcacattctgaaatttaaaaaaaatatttgggtccaaaaatatttgagacggaaccggcccttttagtactaagacggaactggcgagacggaactgacccctactgcaaggcactgccattgcgttttcaccgtccaattcgctcaaatcgtccgcaaaattatttacaaaaaaataattcaatatcgctcccatgccagccccgaaaatgctaaatcgtaggaccatcgctgtcttctgaggttgcattcaaaatcttttaaaaacccagctcggaaaaaaggctacaagggtcggttggtactgatacagtcagtaacataacaaacattctctgaaactggcagattttgttcggggcattccgagaccacccaaatttcaaacagaaatttttcaagcaaaagcgattttttgaaaaaaaatgtttttgtttaaatttttgctaagaaaaaacacagaaaaatttaaatgaggctagttgaaacgtaaaacccaattttacatatatggccaaatcgtactgttttacgtgggaatatgcatttgtaaacattagacagtttatgtgcatatgcaatacgaatttggggttcagaatggtctcgacggaggaaaacaagcgaaactgagctgtacagttggttaaaaatgggttttggaggcatgggttgaaatcaacttgctgtaaaataaaatttattttgggcttccaaaaaaaggaaatttgtgattataacagagaagtgggtttgaacccgtttctacacagcccattttaaaccaccttttacccaaaaacgggagtaaaaatgcactggtaag

SEQ ID NO: 27920 - DNA, 1678 bp, Heterodera glycines
aaaaccacaaagattagttttagcgatttggtgcctttttggcgttttttcccgaaaaattccattaaaaattcaaaaaaatcgaaaaaatacacccctagatctaaattcaaagaatatacctttatgaattgaacgccaaaattcatttttttttcttgataaaaaattttaggtttaaaaatttccttattgaaaaacattataaaattgaattatcaataaatcagcaaaatttagtttttggttagtttttacgtgttttgctccctaaaaatcattaataaaaaaatttaaatgccttttttcatgcctttttcgggatttttgtgcctttttcaatgctattttgcgctttttggtgccttaattgtgagctcaagccataactttagggccggcggtgctgataagagacgccggaaaatttttttgtaatgttaatactatttgttaacagattttgtctaaaaataccaaaatttgagattttggctaattttttaagaaaagagctttttgggcgggcggcggagccgataggcgccgccagacgaaaattttaataatttttagtgaattttgtgaaaaaaatggccaactgattgtgtcaaaaaagtcgcgctattgattcggacttgaaaaatttcggagaatccgtccattctttacactttgaaaacccagcgaatcctttctctaatatcaaactgttgctctcctgataggaataaatggccttgaatagaattttcactccaaatatagacaggagaatttgtgagaattgaatcgcttcattacaatttgaaaaccgagcgaatcattccaaaaaattcctaattgttgctcacctgataggaattaaattgccttgaatagaatttttcacttccaaatataaacaggagaatttggtgagaatttaatcccttcattacaatttgtacaccgagcgaatcattccaaaaaattcgtaattgttgctcacctgataggaattaaatggccttgaatagaattttttcacttccaaatatgaacaggagaatttggtgagaattcaatcccttcattacaatttgaaaaccgagcgaatcaatgcaaaaaaattcgtaattgttgctcacctgataggaattaaattgccttgaatagaattttttcacttccaaatatgaacaggagaatttggtgagaattcaatcccttcattacaatttgaaaaccgagcgaatcaatgcaaaaaaattcgtaattgttgctcacctgataggaattaaattgccttgaatagaatttttcacttccaaatataaacaggagaatttggtgagaatttaatcgcttcattacaatttgaaaaccgagcgaatcattccaaaaaattcgtaattgttgctcacctgataggaattaaatggccttgaatagaaatttttcacttccaaatatgaacaggagaatttggtgagaattcaatcccttcattacaatttgaaaaccgagtgaatcaatgcaaaaaaattcgtaattgttgctcacctgataggaattaaattgccttgaatagaattttttcacttccaaatatgaacaggagaatttggtgagaattcaatcccttcattacaaaagagaaccgagcgaatcaatgcaaaaaaattcgtaattgttg

SEQ ID NO: 27921 - DNA, 1213 bp, Heterodera glycines
  misc_feature (48)..(48): n is a, c, g, or t
tccaactttcgcgcaatgtccagcgccaatccagtccattaaagacanctttcttcacatacattttcaaacctataacctcaaaatggtatttgggtgcacccacgaccggtgaaattaacacaaagtcgttgtcgttgggcaaaatttcaatgtccaattcacaaaaattgatcagatacaacggctgattgaataggtcggtgtcaatttttgcaatgaattgagctacgttgctacccgcaaataaatcgcgtcgcgctgtgcatccgcctcccatctccaatgtatcgcccgtgtcccggtagtacccggttgcattcagatgggagtcttttgcggtcgttgaataggagagttcatgtgagaaatatgatttgtaggccatcagggcatttgcattaaaaatttcgcgcccattgatactcatttttatgttacggatgaaggttgtccgatcatttgaattggtgcaatatttatgtcatcaatgtctaggttaacgagttgactattaacgttttccttacggattagaaactcggtgagcaaatagcattggagaggtcaatataattttgactggagtgaagtttgaagtggtagggtgtgtcggtaagcggattgctgggcagaatctcgaatacctttgaagatgagacgctcacatttgtcgggggtatacggaaaaagtcaagagcattggtgattgagttcactgagtcgttgtcgattttgggaaatgtcatttatttagtaaagtccaaaggcgtccgatcgaatacgctatgccggcgacatcaaatgatgcttcttcaggcaactttttttgtttgattttgattatcaattgacattatttacagtatgatcactttaaaggtgctcgtcaacaaaactttcaagaagaattttttgaagttaaattcaaaaagttcatgaaagagaaattggatgaggcgaagctctgcgcggaatttgcgctcaatgcggctgagcgcaaaatgcgggagcagatggatgctcagatgcaggtggagcgtgagcataaccgccaaaatttgaagacggcaatggaggagcagaatgcgcggtgccgtcgacttgcccttcaaagcttccgcactgcaaaagaaatggtggagaagaaaatggactcctcccaaattcttcattctccaccacaactgcttcttctgctgctgctaccatt

SEQ ID NO: 27922 - DNA, 1262 bp, Heterodera glycines
gctttccggaaggccaaggaaaaccagtgtgcggtgtcgttcttgttctgtgagtgcaacagtgtttgggtccaggtcctgtgcaggtgccattgaacgtttggcgcgaggcggagtgatgtttgttgcgtttgttcgcttcatgtcgaattagaaaataatattttttgcgatcttaatcggactatcacttaattggacaatttcttgtcgattaaaatttcggtgaagcaaaaccaaatggatttggattcaggaaacgcacccattcagagttttttgaaatcgttgttttttcgggatatattatcaaacaatacccgggttaggatatggaggatggaagcaaaaataacaaagacaagattccgtgttcaattttcgcataaaatatttctaaaaattcgtcattcctggctaattaaaaaaaacagaagcctggttccattctcgacatagaatatttttaaaactgcgttatccctggctaattaaaaataaacaaattcccattttaaagaaggcgatgatcagtcgcgacagcgacgcgttcgccgccgtcgcaaaaagcgtgacctatcgaaccgggcaattgtcaccattgttgcggtcgtaatattgtgcctgttgttctgcgtggtgtacagcttctgctggcgaccatcgtgcgctgactgctgcgatggtggcagcgcttcaagcggaaataaaagtgcccaaaaaagtggtgtcagaagtggtggcgctagcagcagtgggagcaacacaaatgatggcaacttgaacaaaccatggttatcgatcgacttcaaaaccaacgacaattactccatatggaatccaatgcattattttccggacaaataatgggagaaatgtttgtacagaatgccaaaaaatgtgggacttatttgataaattattgaataaaattttaaaatttctgaaactcatattgcaaacactcaactattttgtgacgacacttttatgaataaatactttgatgaacagataaaaatgttttctattaaaataaaattgatcctttattgacatccaggttaattgaattaaaattttgataagataacataaacagaatatttgtctaattagatgacttagttgtagtaaataggaaataaaagtttaattaataattagggcttggatctttgcggatagcatttgatgagagaagcacgaaaatcatcacattttctccaaccaattttttgaattataatttttagtagcaa

SEQ ID NO: 27923 - DNA, 2120 bp, Heterodera glycines
ttcccgggtttgggtacaatcaccagcggtgttgccctttcagaagttgtcacttgctccaacactccatctttgacccacttgtcgatgaccttctccacttcgggtctcaatgcaaaaggcacgggacgcggtttgcacttcttcgattgcacttccggcttaaatttcagcgaaatttgccttgtgcatcgaccgagtccgtcattgaagacctcgccgtacttcagaagcaccgctccaagctctcggttcactgccttgctattgacctcgttgactgatcggatcccgaacgctttgttgagatcgatttgtaattcaccaatcaaatctctcccacacaaattttttccttcgccgtccacgacataaatttcggcattcacttctttgccgttgtacaccacatccgttttgaacgatccaaggactttgatcggcttttttccatatgccatcaatcctgaagtttgtccaagtttcggccttccgatggacatccaatcattcttggtgatgagtgtgacatctgcgccacagtccaattcgaaatctgtcgcctttttactcagctgaagctttatcatcgctggtggcacagaaatcgatttgacttcttcagacttggccagtgttccaatgtcgtgtgctttttggcactcagtgttgacctggtttactggcttcccttgcctccttggccaattggagccctgttttgtcttacatatcacagcccagtgtccaacattgccacactcactttcggcattttgagtccttgttcgggcattcgtttttgcggtggccattcctcccgcatcgatggcattgcatttgctgcgttggtgtgctactctttctttctccctttggagcgaagactttagccacttcggctttcttatgcccaccgatttgctctgcatccaattcggactgctcgagaatcactgccgtttcaacggcatctttgaacttcatttcgttcactcccttctttatcaactcggcccgaattgaatcttttttaaggccgttgatgaaaagagcgctcaggcacatgtccactgaatccttatgccattctgccttggcaattaaggtccgaagttggattgaatagtcccgaatggacagtcctgatgtctgtttggccgaaaacagctcaaacctttttgccgcaatcgtcttcgtctcaccaaatcgttcttccatcagcgctttgatctacacaattggcatgtcgcggacgtcgtctggcaacgcgatttggcgaagctctcatagattggcccaatctccgaaaagaagagcaattttttggtctcgaaatcggtgatgcctcgaagtttgatgaagaattcgaatgtttcttcccaaattgtccatgatgtttcagatgtgtaaggacctggtccgttgccagcctttacaactgctgccattgttgcactcttcttaatttgtccaactcggatcaaatttaagatgatggtcaactgttatccaactgggattaacagtgattgtcaattgttatccgaatcggattaacaatgaaaatggatgatggatgttcactgttattcaactcgaattaacagcgattgcaattgttatccgtcccggattaacaattgaatgttgaaattctccaaattcggcgattggtcgctggctgctatccaactcggattaacaccagtatatgagaattgccaccactgggtgcgcagctattccaactgggaattagctttattctctgacgatttggaaattgctattccaaatcggaattagcaattccaattgctgtttgttgcttcttcctctccgcttttatttcgctcgtctgcatttgctgactgcgccaataactgttgtcgaggggagagagcggggtcacaataatattggaaatacaacaaatgaaaaagcgaggggagagagcggggtcacaataatattggaaatacaacaaatgaaatgaggaagaaatgcacggatgggggaaaagggcgggtttaaatggactgaacgaaggggtcaaaataatgatcgataaacgagcatcttttggcgttaattcaaataattaacgaacacaacaa

SEQ ID NO: 27924 - DNA, 995 bp, Heterodera glycines
gtcgatttcaccaacatcgagggataccatgtcgtgttggtactgtatgggttggcattgcgttggcttctcgtccgccccccccctttccctgaacattcatttaaaacgcgtaatttccttcagatcgcttctatgcccgccttgttctacaccattttggttatgatggaccagcaaatcacagcagtgatcatcaatcggaaggacaacaaattgaaggtgggcgaagagaaatgccaatcttttgctgattgattgccattcggtgccaactcagaaaggctgcggatatcacttggatttgctgattatcaggtgggttgactattgatcagaacgaccagcagctgatcttccgctgattgatcacttcagtttgctcgtcctcatctgttcctttcttggccttcccttttacgttgccgccactgtgctcagtgtgatgcatgtggaggtgaaattaatcaatgaaccaattcatttgctaatcgctgagtgattgccaatttgagtctctcaaagaaaacggcgattgtacggtgcccggggaacgacaaaagttgcttggtgttaagtgagccgtttacaatgatcaatctgctaaatggacaattaatcccaatttccaaatccccccccccccagggaacagcgattgtccgccattctctcccacatttttatcggctgttcagtgtttctgacccctcttgtcaaagtctgttcttccatagccacctttgtttcccaactttgcttttaaaaggtcgtgcctttgcccgtcctcaccggcattttcctttatatgggcgtcgtttctctcatcggccaacaatttgtccaacgcatcgctttgctttttatgccggtcaaataccaagtgaaaaagcaataaaagagtgtttgagcaataaacaaataattaagccggattacgtgtggctgagaaatgtgccgaccaaacgcattcacacattcacaatggttttaac

SEQ ID NO: 27925 - DNA, 1348 bp, Heterodera glycines
aaaataaaatttttaaatttatttttcgtcgggaccgcaattctgcagcgttaccagggagtccgtcggtgtcttagaaataagcacacttgggagtcctggcttaaacaaatttttattaaaaattaatttgattccttgatgcagtaatttgcacctatcgatttgtctcaataaattaatggccatctaaattaattccttaatttaacttttatagtacgatgagcttgtttaatacacttaaattctttattcatttgtaaacataatacaaatacacttatttaaattggaattcatcagtgagaagtcagtggaaatttgcaaaaaattcattctgttagaggaaatagcccagcaaatgcgcagcacccaaaatgcgtttttcaccctcaatcacacgcaaaagttcgcagaagcatggccgatcggtggggttggaggacaaagcgcgcggtacaatttcactgaaaaaaagaatttgcaatgatttaaaaatcattttaaaattttgattgatgtcgaaaatgtcaaaatcaaactttttcgttttgttttccctggcaaattatcctaaaacttcttggttttgttttggtcaattgtataaaatgatggcaaaacgcacgccaatgtttcgggagctgacggaagaaaagcgaacgcctttagaaagagcattttttgacgacgtctgaagagcataaaacatagtaaatgcaattttaatatcacagtaaataatgtttttatttcattgctttaaaattgctaattggcatccgaaatatttctgaaaaatgtttgtttttttgtgagttttgcgccgatttcattgcctcaacaattttgcattttaaattgaatcagcaaataatttcgcactgttcgggcatgcccaactgcgcctgtcgtcgagtcaaatggcccggcatgaaaaaagagtcgtcaattgcggcggacagtgaaaggaactcggcaagagacgaataactgacaatgaaagtgggaaaatgaaaaaacaatgcccagcagccaaaaaatgactgacaaaattcggtttccgaattggcaatgcgtgtaaatttgccacaccaaaagagcgaaagaccacacttgggaagcactgaaagaaaaagcaaatttaaaacaaatgctaattagagttagcaataacacgcggcgaaaagcgtgtcataaaataatatgctgaaaaaacggccaaaaattttgagtttttttttcttttcaataaaacaaattaatcaaacaaattgtgggtggtgacctgtcaaatttggactaaattaacgtctcagtgggaagatatctgaaaagggagaga

SEQ ID NO: 27926 - DNA, 1488 bp, Heterodera glycines
  misc_feature (1476)..(1476): n is a, c, g, or t
ggggggcttccccgaaaacccaaaaaaaaattttttggataaaaattatttaaataaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttggataaaaattatttaaaaaaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttggataaaaattatttaaaaaaactgactagataatatttaaaataggttatttctcttcctttcagtatccctgcaaagtttggggcgcttctgataagtttctgaaaaaaaagttaagcctaaactttttgccctgtttaaaaaggaattaaaaatttttaaaaattttattcatctccctttttgatagaaaaagcatcagagtgcctaaactaacatgtaaataaaatttggtgcgtttcagaaccctttctgtaaaaatacttatgaattaattttgcaaaaaaataaataattaatgaaaaactcagaatttctaaaaattttgaaaaccaattatgggccagattttttcaggttaagttagtccttttacagaggagtacgcctgtaaaatttggtgagtttatattgattttagagtgcgctagattcaatgaaactttttaaaatttaagcctaaactttttgccctgtttaaaaaggaattaaaaatttttaaaaattttattcatctccctttttgatagaaaaagcatcagagtgcctaaactagcatgtaaataaaatttggtgcgtttcagaaccctttctgtaaaaatacttatgaattaattttgcaaaaataaataaataatgaaccctcctccttaataattttcctgcgcccaaggtactcactcggccgcttgttgcttaacttgtcagatcggacgggtacgcatgattccaattttccaagcaccccaccgaaagtagaacgaaataaccaaaatataaggaaaatatttttaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagcgcgctaggttcgatgaaactttttaaaatatgagcctaaactttttggnctgtttaaaaag

SEQ ID NO: 27927 - DNA, 1878 bp, Heterodera glycines
ccattgtaacttttatttttttaaaatttatcccaccgaaaatttccgaaaaaaagaaaatggttgggatttaatgttcccactttttgtattcctccacaaatgtgttgatatcgtccgaagtgagatcggcacgtttgaactgatcaatcagtgactgtttgtacaggttgcccatcacaccaatttgactgcccattacacctgcttgactgcacacattcacaattctgacacatacaaaaaaatacattggcaaatttattaggctgcctaattatgtattattgtcatccattaacggcacttcttcgtcattcgtcatgccaaattttcggcaatggtaaagaattgcggtccctaacggaaaagtgccgtcaattgcgccccttcccctcaccttcccccgtctctgatcagtgggcccagctgatcactgatcaatttggtaccataataattgacaccaatcgtaacatcggcttggattgcggccgattctgtcgcattttgctgcagttttaagaggcaaaattttgccacccttaaatcctaaatccaaaaatgccgactttgtacgcaaagccggcattgttgatgagcacgtccaatccgccgtgggttttcttcaaaaatgccgcaaaatcggcacaacttttctcatcagtgatgtccaactgatgaaatgccaattttgaaatgcgttttgtgcccaattccttctccaagtcatccaatgccttttcgcccagtgaaggcgttcgtgctgaaagtcaaaatatttaaattaaaaaaataaaataaaataaatagtgcacgggacaaaatcgcgccaccaattcaaactttaatttttcaaaaatatcagaattttttttgtaagaaaattttaaattttttagcaatattttcaaagttttattatttattattattatatattttttaaatttttctaaaaaaagctagcaaaattttcataatttcgaagtttgaaatttgaaaaaaattatatggttttattcttgaaaaatttcagttatggaattttttatataaatttcggcagcgaggttttgggggtgcacccataaaaaatgacccgtcatgtaaatggtggcaccattcacttgttgggccaacccacgcgcaatgccgtaaccaatgcccttgtttgcgccagtgacctaaatttttaatatttaaaattattttacataaaaaattctttcatttaccacaaaaattttcccggccatttctttgtttgctttttttctgtggtaaaataaagtaatttcctaaattaaaaaaaataattagttaattgaaaataaaataaattttattaaaaccatttttatgaaaaagaataaaataattatttttttttaaataaaatttatttttattgaaattcattttacgaaaatggtgaatgaataaaattaatggcaaaatcattctccgttaactcgccttaaaaaggcagaaaaatataaaatacaaaacaaggacagaaaaaaaacaaactatgtacatattttattgggtaattttgtcaaatgatcaaattaacgatgattttgtgatctgaaaacttttttattttcaattgcattaaattcaaaatttattttaccacaaagaatttccaatcattgtattctctgtgatagaaataaaagaaagaaaaaagagataagaaaatattataagaaaaaaataataataaaactatttttgaaaataaaaatttttctaaataatacagtttttgatactctgaaatattcttcacaaatcatagaataaaatacaaaacagaatgccaaagaataaaacaaatcatcaccaaatcagtagaaaatgaaataa

SEQ ID NO: 27928 - DNA, 1194 bp, Heterodera glycines
tcagagatttgttatttgtattcgaaattggcaaaacgtttcctttctttgtgctgcttgacgccaatgataaggtaagaaatatttataaaaattaaaaatttattcaattttaatttcaatccaaagattgccctgtgcagtaatattgcgatgccattgtattcactgttcaaaaatttctactcagtccaacaaaattgtgacatcgtttgtaatccttctggggtgcttaccataaatatctttgcaaatacatattacaatgaagatccagtgtaagtataaatggtatcggataggcggaagcattttgctttaataaagcaatcaatttaattttttgtattttctaaaaaatttggttcttaaaacattttttaaaccattcttcccggataaaattataaaatcgtttgactgaaatccctgttctttttggccaaaattagtttttatctccatccgttttattaagagtgaagaaaaaaccactaaaacttcattttataaaattgaaacaaaattaccaaatttatcaatttatgaacattttttaaattaatttattttcaatattttttcaacagcgcctatcggcaggtgggtgaggctaatcctcccatcttaggactttatttaaaatattttggtgcattataagtcaaactatttgaaaaacccaaatataaaattataaataaatgaaataacatttaattgcagtgccatgggaatgggtgacacattgttgtgcaaagccatagaaccattccgccgtttaaaactgagcaccgaagaatttgtacttattcgagcaatcatttactccaatatgggttagaagttttttataaaaaatttctacaagaaaatttatataattaatgacaaattcaattaaatttttagtttcgccagggcttagtgaccaggcacagaaattattattatctgaagcggagaaatattcttcacagttaatgagcattgtacaggtagctttctttcttttttgcaattggttctcttgacttatacgatgtttttttctcgaggaccaatctcgacgaatatggtacaaatcgatagctctcgatgagacagatcgatctaggggtgggggatgttgatccgacaagtaaaaccggagaagactcgaaaattgagagatttggcactataacttttttt

SEQ ID NO: 27929 - DNA, 1120 bp, Heterodera glycines
cgctttggattgacaagcccgatgataaatagctcgagcgcaaaacgcgtgcatgtttggaaagtatcgttcataccaatattgaggggtttatttttaattgaaattttatgataaaccttattatctcagaagctattaattgatttgaatgtttttatcgcggttaattagagcaacgaaaattggtttgaatcgtgaagtttatcatttctaactcacttctcaaaattgttgataaattgcaaatatatttttccaaaagtctgtggacactttctgaaaataaattctatactcttgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgtgtgcatgtttggaaagtatcgttcataccaataattgagggtttatttttaattgaaattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatattttccaaaagtctgttgacactttctgaaaataaattctatactcat

SEQ ID NO: 27930 - DNA, 990 bp, Heterodera glycines
  misc_feature (764)..(764): n is a, c, g, or t
agtgatcgaccaacgttgatcaacttgtattgtgttccgtttttcattgcattttcgtgtcacttcgtcccccacccctccgtcagattgcatttggttcccaagacggcgtcgtgtcctttgttgacattcgtcaggtcaatcggcagttacccgtcgccttcaaagtctctcaacatccgatcagtcgggtaaaatcagaatgagccgtaacgaacttgtcggttttctcctgcgacagatcaaattccatcccatcttcgccaataatttcttctcttcctccgattctggcctaatccattgggatgccagtgctttggcccaaggagcgaagtgagttcagccgaccgaaggcaccaccccattttattggcataatcttccgtttgcagtttaaatccgccaacaaacggaagagaaatgactggccacgaatctgctgcgggttggtgatttgctaatcgacactaatgagccgaccatgctgatttccatttctttcaaatttagacatgcggacgaccggagaaaatgaacacaccaacatttggttgattgactattgtgaatccaaactaatttcatgttcaggttgtctccccatgcttcgacgagcgttaatttggttttcaaattcaattaatcacttttaatttttcaaaatcttaagcgagtgcttattgacgaggaccctcttctgctgagttctttcgacgttgtgaacggtgcgatcgtcgccgcttctcatacggctgaattgngtgtttatgagcaatgataaatttacaaattgaaaaataatcagctgactggaaatctcattattattttgttacaataataaaaacacttgagcaattcactatctaattttaaaattggcgagttccatttaattatttcattaaatacacagcaagcattcctctcgacgagggaaaccaaaacgacacacataaccagtcgcatttatacattttaatcatt

SEQ ID NO: 27931 - DNA, 2039 bp, Heterodera glycines
tttaattaatttttatatatgattttaattcttttttttttgttggccatccgtcggcggatcgcattttgaatttatggtggaatccaataaatgtacatagtttaaaaaacataccctttaaaaagcaattttaaatataaaagaaacattgaagtattgcatttaatgataaaaggtaacgacttacttaatctgatcaccttgcaaagtataggaaatattctggaaaaatcccggctaaactaactatcatatttcctatatttaaattgatttttggtcgattaaatatttccgttataaacatatgaccaccgaaaatgaggtatggcacaaaaatcaaatgcaattcggataataactaatattcattgagggcaaaaaagtcacacaaaataagttcttattgtagtgatcaattatttagccattttttaaaaatgtgacaacccaacaattttttggaaaatttctatataattaaagtttgctttttcaattataaataatattatgaatgtcatatttttgtgcctttgtagctgggcgaatatgatgttttcgttacaattgccattttggataaaacctgctgaacgggatttccatcccgcgcccttcaaattgaatttgccgattaaataaaatctatctgctttttggttttaagccatttttccatattttgcgtcattcgtgtttaacaaagcacctctcagaggagaatcgcagtatagcaatcatcctaatgtcatttgtattttgatgagcccaattgtttttcatggaaaatattttctaaccccctagaaatttttctttcgaattaccccgatttttcagatttttcatcgacaaaaattggggtgtaatgcattttggaaaactcaactaacactgcataaaagacagggttctgttgtgactgggacgtatatactattattcctttgaatttataaaaaaattaaaagcaaaactaacatttattttttattttaaaatgacaaatctgagtgaaattactctttataataagataatggaataagcatttgtatttcccaaagaaattaatcacactaatgctttgttaatataattatgtttacttttttcagacgagctccatccctgtcagtagaatgaacgtttcgatcgtttaatgtgcccaataattctataaaaatgattattcatcattggaaaatatctctaaccgttttattggttgcactgcaatacatttcgttgaagcaacgcgttgacaaggtaaacccttgaatttttgaattgctctaaaagagatacctgctttattgcttccttgacttctctttttttgaactgtttgcacacgaattcaaagtttttgttgatttttttcgctatgcgttcccgtatcttgccatcgtaatggtaatttgcgctgttaaggatacctactttttccaccactttttcttttttatcttcgtagcggtagacctttaatttaattatttctcaaaatttttatgaaaataaagagaactataaacgaaaaaaattaaattacgcttgcatgtgtagccgtgtcggcctgaagccaatcgctttcggccgcacttttgtcgtaaacaccaaatattgttttttctgatgccgcacctccttaagatgcaaaacaaattttgggttaaatttgaaaaaccaacctaaaaaatactgtagtgttgccattacttgcgcaagtgtatatttttcgcgaaaataaatccaagtgtatccatcattaatcccttccggcactacatctgactgaaattaatgaatttttaattctatcaattcaaaattttactgctaagcactcagtcccatgcttatttaggtggtttgccataatgtggccggcttcatggtgtgctacccttcggcgaacagccatctgatttagtaattattttacattaattaaaataacattcatacaaagtaggtacaacagctttctgagccgttgcacagaaattcaatgcacttaattaatttat

SEQ ID NO: 27932 - DNA, 1928 bp, Heterodera glycines
atttgtattttcttcgtgatggcaggcatcaggaagatcgttaatataaatcaaaaataggatagggccgaggacagagtcctgggggacgccagagccaactgttttatttgaggataaagcatccccaattttaacactgaaagtcctatgactcacaaagatttttatccacattaaaaggttgccccttataccagattttccaatattaactgcttaagctctgccttttacgtttagtaagttcatgttcagaatatgtctatttgtttcgagagtgttgatgggatagttttggagcattaagtatggacgaaaaaatatacatttttgaaaattatttattatttttctgatatttgctcaaagacatatgtgcatttttaatactattgaaggaattctatgttttttgtttttgaaatatttaaaaatttgatttaaattattttcttatttaaataatattttgcgcttgttgaaacgtgtacaattttgaaaattttcacttatttaatgcatattatttatgtttattttattggccaacaatctgagtaattgatctaaatttaggtttaaaaattaaaaacttgtgcttttccaaaacaccattttttgttcgttaaattaacatttatgacgccacataaagtgagaagaaacatataaacatttttctgataaatgggtaattttaataatttaataaaatatatgggtgttatttagatctacaaattaaatctgaaaacattatatttttttaagagctttgttccatataaaattttttattattgtagattagattacaagtcacaaatctgtatttgttagtgttaaatgggactcaaatgggccgatgattcccatagcatttaattgttctacaactctttcaattatttaataatgtattttatgtttttctcactttttgtgctgttcacattttgtttttaaattatcgttcgttttactttatctaatgaaatcgtcgtttaaaaccttttgcatatttctatttggattcttgcgtaaattgattttgatttttttagtttttaaaaacctttttaatttattgtaaccttgatttataatactttatcgtgtttatattcaatattttaaatttacttttgaaaataactatttttaattcatagcaaaatttactatattgtcccaaaaatagaattcggagtattcggagtattcgcctgtcccattggtttttaaaaatttaacttttttattttgtataaaaaaatcaacatttttatatttaatcgcaattatttgattttttaaaataatatttttaaacgcgtatagtcaattagcaacattaatattaaaattttggattgatcagatcttcttgctcatataagttgtttcttttattcataaattcaacaaaatgttattcttaaaactgttttaaaaggagtgataatttcattgtgattattttttaaaagaataatttctagcaaatttaaagcatatccgtgttaatcatttttgctcttctgcttgggccaatggcacaaaaagacaaaaaactaaaataaattaggaaaaagaaataatgcaattgcacttgctttcgagtcttatttaattattataattttatgttacgtaaaatttaaaaaaataaaattcaaaagcattcattttatgcaattatgaaattatttcgataagtcattataaaacaaattttattatgagaggattttttaagatatgtttttttataattatataaaaatctaaaaatacaattttattgaagagctgcaagaaaaaatgcaggaacacaatcggagataaaaattttctcatatacgtcgcgatattgcggataataattattaaaatgcttaaatcaaataatatttcataaaata

SEQ ID NO: 27933 - DNA, 822 bp, Heterodera glycines
taattactagagctcgcattttgaggcctatgctttttttttgggcactagttccgatatattaagcataaaaatgcattttccacttggtttgaggcttcgtttgaaattttattatgcttttttggccttttatcgagaatttcgtgccttaaatacctttttaggaacctttcccttttggtttccttttaatctggtccggcgattttttagaaaaatagggattgaccggacccagaatccggcacaaaatttccgttacctagcctaatttcattttccataccattttttattttggcggcaacgtggcaatctttcggttcattggtcccgaatttttttaaattaaatctggaaatacatttctaaggctactttgagcagatgagtatgaatctgacgaccttttcgaccaattttgaatcccgaattcgaacatttaaaaaaaaaattttaattccatcaaatatttacatatgtacgactaacaataagcattgacaacttttttccgttgaactgtcgggggtaaaacggccaagaccgcataatatatatgcatcgggatttaattattttttattttaaaatttttaaaaattggtttaaaaaactggaaggttgtgagtttttaaatgcgcgatccgcaaccgcggcaaattgaatatcgaccgcggattttttttgtccgcgccccacccctggtacatatttgagattgccggcaacgttccggcttcattaaaaaacaaagaaagatattttctaaaattctaaattcgggttttttattttgaataattttttaaattttct

SEQ ID NO: 27934 - DNA, 1185 bp, Heterodera glycines
caaaataatatttaatttcataactttttttaagctctccaccaagatatgggataaggcacaatagatagagtttaaaattctctacaaaaaagttcttggaagatttttcgctaaaatcaacccctgcatagttataagtcataaactgaaataggcgccaaatttcggaaaattttctatttccaaaaaaattttgaaaaatttttttgaaaatgccaccaatcgatagagcgcaaaaaacggttgcttgaaagtggtcttggttttcccgagaaaaatctgcaaaaaataataaaatttaaaaacggaaaattttcgagggggcctagctcgaaaatttctgaaaattttcaaaatccgaaaacatggatggatgcagttcgtcgagctgcacaaaaaagtaattatcaccatcccgctcagatcaaaacacagcgatttattcgcgaaattcaaaaaacgccaaaattggttttcaaaattcgccgaagtgtacaggccaggcctttgatgctagggcctcgctcaagaggaaaaaaatttcccaaacattccaacttagggccctcccagcagaagtttttggctccgggttccctgaaaaaagttttggcgcaaaaactgcatgcatttttccccaaaaagccatttcagcgccgctggcgctcagttggcctccggaccggaatgccattatttttcctggatgcgcctcaaaaagttgcttaagcaatgtcaacatttcaggtccccccgattagccgttccggagattttagttttagcaatgaaactcgatgttgctttagttatatctaaactagggtggacagtcggcttctggtgctgaggggaaagcgcttcgcgctcagggacgcggctgcgccgcgtctctagggttcgcaccgccgtttgtttgttggatatggctgtttttgttccgcatctccgacatcttcgcttacagcagcagctgctgcagttgcaaacgacagacgtacagggacccgccacgtgaagccgcacggtggcaaaaacagcgaaaaaccatgggtccccttttttattttatacagaaaaaggcaaaaaaggtttacaattatgatgacatattaaatgattaagatcacaaaataaagagaagtaaaattaagtataattaatgaaagacttaataaaata

SEQ ID NO: 27935 - DNA, 1100 bp, Heterodera glycines
  misc_feature (53)..(53): n is a, c, g, or t
  misc_feature (57)..(57): n is a, c, g, or t
  misc_feature (1079)..(1079): n is a, c, g, or t
tttattggtcatatgtatcaggctttttaggcgcgctttctgaggcttaccgnatgnctaaccgctgactaccataatgctataacaccaatttgtccattagcgcattaactgacccaattgtccaccaaaagatttttatgagtttcctccctttccgtcgttgccatttttaacggtgtttaattgggccagagctgaacatttgacagcagcatggcaccactcactgcatgatgatcatgtggacggggacaccttttgtcctgcttcttctggctgctgtgtgggcggacaaatgaatgcgtgtgttgtgacatttgatcactccgctgacccaatgatttttcaccgtaaaaacccacgcatcccacggccattaatgcatgtgttgttcatcatccattattaatgggggatgttgtgctggtccgtcccatccgtcggccgatccgatctgccgatgctttttgcccatactccgatcaccgccccctttcccccattcactcatccccggaccacttatgcatccgatcgacggatggcgatggataccccgcataggtatgtaccgaccagcagtgattttacaaaactgatctctccttcgtaatcagtcacattttttcaccccaggaaaaacaaaaataaaattttaaagtttattttccgtcgggaccacaattctacagctttgcctaatttggttgttcattaagcagcggagaataaaaaattttaatttatttatttttttgttcagcaagaagtgaatgagaaattagtcgataagcaattcgccatttggcgcgttgacgccccgtggcttccgcgggtgcggcgtccgccatcaacaaaaaagggcggtgggaaggggcccatccatcactacgagacaccggtcagaaccggacgggtcattttggagctcggcgggtacatcactgaacaggaggtgatggcggtggattggtggtgctgttttaaagcgacatttactttttgaaggctcgttctattttgatgcatctctatttgcatatgccattcccagaagagatttgtcagccaagaanttgatggacaaacgcaaggga

SEQ ID NO: 27936 - DNA, 1899 bp, Heterodera glycines
atgagatttaaatataaagaaagcgaaaacataaaattaataaattattttacaattattaaaaataaacccattaataaaaccattaagtgaacagaaaaagcattcattaaatataattgatatttgcataattaaaatagtcggtcaagaatataaattattaaaaccacaaattttttaaacataaattaattttaatatgcattttttgccttatctatcgcaactgttcaagataaatatataataagcaaaaatattagaaaataatgaagaaatctatttatatattttaatttagattcgaaatggcgaaaaattattattagctttaaatttttatttataaataagagtaattgttataattttatttactttataactttttattaagttaattgtaaaataagtttatttaatgcttttaacttttttgatcattaatctcacagtaattcgaccctccaaattgctttcgaggatgtgcttttgagattatctgaatcgctttaaaacccaaattttcattcagttaattaatgcgttttaaggcaaggcaaacacaagaattgacggaatattggaacaaagcaaaaataatttaaaaattcaaaatttaaaaatttgagcataaacaaataatttacggttgatattctctagtttcactattgaaagacattgaaatttgaatatttagattattgaataaaaaacattaaataagatttcgaataatttttaattaaacaaccacactgctggaatagatacaagcgggccattaggatatgtgcttgccagaaaataatcaaaaataagcaatcaaaggttatgattaaaaagaaaaactttaacggtaagtaaaatattaaatcattttaaatacttataataaaaaaatatattgaaaaaatatcaaaataatataattaaaaattaaatatgatgaaatgttccctttcgaagataatttatttacagagattacactcaaatttctgacaaagaatgcattttaattataatcaaacaaaatttttaatggcaaatttttaagtgattaaaaaaggcccatcgctaaccttgtttaaatcttcattttatttaaatacaaaataataaagcaaaaacttgaaaaagaatttttttttaacaataacagcacgcgaatgaacgtaatcatggaacacagcatgagatttaaatataaagaaagcgaaaacataaaattaataaattattttacaattattaaaaataaacccattaataaacaccaccaataaatgaataagaaaatcattcattaaatataattagagtcgatcaaaaaaaaaaaacttagtgtgggcgatccaaaaaaaaaaactcggtgactgataaattaaataattcaattcacaaaataacgatgccgtccagttaactctaatgtacgtcgggacgcaagtcattttcaattttttgcatcacttctccccaattttctccatttgtagtagacactgccggacgccattgatacctgttttgtagagctcatcgagctgtacaaataagccgctgataccggcacgctcagcttgggttggccatcgaccgggtcggagcgaggctgagtgtcctccggcagatgtgcccgacccatgacgggttacaagtgaattgatcaaaaaccggacccggcctgggagatagcccttgaaaaactgaaaaaaaattgttcgtaaccgggccggttcggattccgcatcaggcactttttgtgttccgaaagtggtgcgatcggcttccggaaaatgaccaatcaatcacaaacacaagaactgacagaatattagaagaaagaaaagaaaatttttttaaattagcaaaattaaaatgtgcata

SEQ ID NO: 27937 - DNA, 730 bp, Heterodera glycines
ggagagagaagatcggggattaggggggggggggaaattgtccgacaaaagtttggcacaagcctacaatgagaaaatttcggagggggggggggatccctatttattttattttttgctctttaccccaaagttttcccatgtaattttacatgagggtttttggcagatttgtggcccaaaaatgccaattttgggaaaaaatctaaggcgtaattaggggtaggggggggggcggtgccgtgccgaaaggcgccgtaatgggaaaatttaacaaattttgaaattcgtatgcgcatagattgccgaggttggcccagcagcgggtagtgccatgcaaattggcgatcaattagtggaaattgacggcgaaagttgcattgggatgagtcacgagcgagccattggcatgatcaaggagaggcaatgcgtgaggctcacattgagccgacaaaagctgtaacatttgccggacaaagaaagaaaggatggatgaatcgacgaatcatcatcatcaatcacgcgaacactcaattttaataataatttatataaataaatcattacactctactgaaaaccataaatattgcaataaaaaaaccatttttaggcaaaaaatgcgaaatttgaaaatgtgaagtttcgactttttgttcgaatttgggttcggggttcgaaatttgtcgaaatgaatgtcagattcgtggtcagcgaccccgaaaacccc

SEQ ID NO: 27938 - DNA, 1346 bp, Heterodera glycines
ttattaggtacaactattataccaggagaccagggatggcacaacattccgatttccgataacttttggggcctcggaatgccatcccccccatgtacacaaaatgtcatgggacgcgtaaagtgttgttgggacgcgtaaaatgtgatgggacgcgtaaaatgtcatgggacgcgtaaaaccgactagaaccttattaaaaagttcacaaaacccacataaaacatcataatgtaatttaaaaattgcattttatattaattatttcttaaaatgaatgtaaaatctacaaaacttccccacctgcccattgctcacaggggagtatgatcgttatgttaaatcccaaaattgtgtttgaactggtcaaagagtagactttttaatgcctctttagactgaacataaaggagaccaactatcgccgtgatcattcgctggactctgctaaggtgccgtcatgcctgatcagagaagtgccaattgtccgtgtgccgtacccgttctctggttcatcttccgcaaccatcggcggatgccgagcatttccgtccgcgcttgaaattggcgattatccgccacagcgacgccaacatttgtatgagcggcgagaggaatttttccatcgaacggcataatgccaacagaatggtgcgagcagcacaaaattgagctgggagcagcttgaccgctgatctctctccaaccccttaaaaaatcttggtcaacccattaaccccttttcattattggaagagatgggaaataaatcggacagtttcgccgaagcgatcgaagaaattgcttaaattttataggcctcagaagaattccgggtttgccacttccatttttgtataactcggtatttccggtttccgtaatttttgatgatccaagaaaaatgtttccataatttttaggcctaacaattaattaatttctgttttcgaaaaattttttggtggccttgaatttcttacgcttcactcaaacaaacaattaaggctaaactattgacgtttacgacaccaaaaattggaaaatatatgtattttaggcacaattctaaaaaattttgataatgtatctttttaacaaataaattcggatcacagcataggcaacaaatggaacaaggagagacaaaaaaaagtattttgtctattaactgttagcattttgatcactttttaatttcctaccattgattgatttgataagattatcgattgatcagaaatgagggggagggaacaatcggcaaatgaatgaatgaattaatgtgtgtataagtgctatcaaatagagcaaacagcagatgtcgttgcgaagagacaattagt

SEQ ID NO: 27939 - DNA, 1789 bp, Heterodera glycines
  misc_feature (1671)..(1671): n is a, c, g, or t
ttaaatgaactgactagataatatttaaaataggttatcttctttggtttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaatttacactaaaaaagttaagcctacattttttggcatatttaaaaagcaattaaaaaatttttaaaatttaataattttcctgcaccgaaggtactcactcggcctcttcgcggcctcgtggtgggccttcgatgaatagtggtgattatctccaaaatgaaaaagcgagtttagacgcaaaaatttctcagaatttacaagaccccggcataagcgaggacctcaaggcgaagagacatgattggctctataaagaaagacgtacgataaaggggatacttgaaaataggccacagaaggtcgtgattgagaatcatgtacccggtccaaatgttgcaccatatctgggcctcaataaccaatccaaaccacaggagaccgaagaaccacggaaaataattattcctaggaaaagacttaaagagcgaactcctgatcctgaatcagataatgatacccttgaggagttaactccggaaccccaaacaccatccacattaaaaacacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacaccccggggtgcaaaatttctcaaagataggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggccagactgtagagaaaattttatcaaaaatttattttaatttaaaatctgcggcaagttttgttggaattcaaaaaattttaaatgatgccaaaaagattgacccggaaattacgaccgatgacgttaataaattcctagaaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatgatcgaagcttttgatcgtgtgntcgaaaagtctaaaattatcccgatgaaaatatatagtgacagtgggcttgaaatccaagcaggaaaaatgaaaaaatattttgaggaaaaatcatcatcaaaatgtaatgtatagtc

SEQ ID NO: 27940 - DNA, 927 bp, Heterodera glycines
ttatcgactagtaatgcagtttaattattagattaccatacatgttaaaaacaaaatatgtaattaaaagccaaaattctgttctgcaaagcaaatttagttaaatgcataacacaaatggcaaaataagctatacacacacaaaaatataattcaaataatgaatgataaatagaaaaatgtttagttttattgtctcttttgttcacccattcaatatttagaccttcattcatccctttgccgacggcaacggacgctgctcgcggctattagcaaattttgtactggttccatatgtatcctccccccccttcattaattaatttaatgtataaatatataatttatccccccccattcttattaatgatctaattaatttcatatccccgcctataattattttattttcatgtccctcccctctttgtatatatccctaattaatgtattatcatacctttctccttataattaatgtattttcgtattccccccccattttcttatcccttctaatgtattttttctcgtcgttattatattttatttatttttttcatataatatattttggcggctgttttcgttttgtgagtggcacaacagctcgtttagcagctccattgcggattttgtggccataacttattttgaaagtaatcaatctgtctaaaaaacagcagttcgccgttcctaaaaataagaaaggcacatcagaaaaagagaaacccttttgcttttttgtctgatttttttaagtcagagccctaattgtctggcattttatacccctgtaagcccatcgctagggaaaatcaggaatggtttatgaattttgtgtatttgtacttttttgaagcagtgtaaatatgttatggcccaaaatcaaaccgtgtcgtataaagtttgatttcattttta

SEQ ID NO: 27941 - DNA, 911 bp, Heterodera glycines
ctctgtcacttaagcttttgtttgcctttgtccgttctcatcaactttcagtcagcccctttcaacatttcatcatcattcactccatatcattttcatcatcatcatcatcgtctctttattatttcgtctcttttttcggatggtcatcaaaatgccgtaattattattcatgggcggcatatgccttaatgagggaatgggccaaacgccggggggggcaactgactaaatttccattttccctttcctttgcacattccgcaccattctcttgatgggaattaacgaaaaaagaaaagtccctctcgaaaaggcatttctttttctgatgaacaatttagcgatggaagcgaaaaaaaattaagggaaattatcggagagaaatcaaatcagaaaagtgggggagggagggagccatcacttaatagcggtggggtgggaccacacaattgccattttccgggggggggggggaatgacagcaaactccgccgaatttcatcagccaaaagcacaacatttttgagaatgacaatgccaactaagcgcaaatgtcatgaaaattattataattggcatgagaatgctttcattcagcttaattttgaatgagaaaatgcggaaaaagccatcaccaaatgagacgccaaaataatactgagaaaatgttaagtgttatgcctttgctaaattaaaaagacccaaataaaaaacgaaatagcaatggaaattaatttttatttaaaaatgggttaaaaaactattagaatacctatataaaatagagaagtgcccgaacattgggagcaaaagcattacggggaccgggaaaacataaaaagacagagacagaaaaaatcacagttcatgaaatgcaagaagcagctcattttttacataaacttatt

SEQ ID NO: 27942 - DNA, 1166 bp, Heterodera glycines
taaaataccgaaatatcttctcgtttcaatgaaatctcattacttgtttgaacaaaagatcaaatttattattaattttttcatttcgaatttatgttcagaaataattcgaaatctacacgcggaaattattcaaacagtttacacagtcattaaataaccatccgtattgctttgaaccctcgcgtttcgattttttattggaattctagttaggagatcggattgaccgaaaagaatgctatatcatgatctgcaacccgtaataccccagaaataaaacaacacatattttgagtggggggggggggacaaaactgtacattaaaaaatgtcgggcgggttgggtaacgggacgcaaccctatggcatttttgaatagtttttcgacctgtccgtccaattgagactcgacttggcaatctgaaaaaggtcaaccggctctttgctgagcagcacacaaacgatgttgtctgtttgaacttctgccatcaatttgagaagttcacctctcatcgcgtgacaccgtaaaaggacgcgcaaagtgaacgaaatggccacagatgccaaacgtattctttcattttcgcagaataattcctccaatttttgcatagcctttatctgtcccaattatttaatgattttaaatgattaaaaatgggtcgaaagacgtaataccgggaccggaaggcctgttttccgggaatccccccggcgttttgtgttaaaaactgggagcaagagttacggcaaaatcccggcggtgccccggtcccgtccgggctctaattaaactcgattaaaattagctaaataatgtttgcttcaccatttgttcccctttggcactgttgacattttgtcccctgacaatcttttcgaattccttctcaatttgtttttttgccgttcctatacaaaaaagaatcactttcatttcactgatttcttctgccacaatttgtggcacttttccactgaatggcatttccaaaagtccgagcaattccctgaacaagcgaacataaaagaagaacactttgagccttttcatttcgccattttcaactcgggcgcctcccatttgctggtcaattaaactgacaaaatgagagaaattagtgaatttaaatgattgtcttctactgactctagaggtcccc

SEQ ID NO: 27943 - DNA, 1499 bp, Heterodera glycines
  misc_feature (1360)..(1360): n is a, c, g, or t
  misc_feature (1362)..(1362): n is a, c, g, or t
  misc_feature (1392)..(1392): n is a, c, g, or t
ctttgccagaatatgaaattgaggcaacattttaatcatacagtaaatatacatacatatgcctactgtgacaggtggcagaagatgcagaattgatgacaactgtttaccatatacaagcaacggatgacgacagtaccatgccgaacagccgagttcggtacagtatccaccaaaccttgcctgttattgatgggagtgctaacacatccatattgggcataaacaaatggacgggcgaggtaaaaactgtaattccttttactgtacataatagacatatactattgtatattcggacatatacaattttactgtatttcatgtgtaaaaatgattttccaacctagaaatttttcaacaaaacttagtaactttttcataagaacatttcaagaagaaaaaagttttggaaaaatttttctacgggttttttcaatttttgatatattgataagtttttcaaaaaatttttccaaaattcgctaaaaaattcttgaaaaatttttattgaaattttcataaaaaaactgttgaacgtttttttgaaagattttttatgtttgaagctttaaaaaataattcgagagggaaacgatacggggcggggatgaacttactcccttaacttacaattagacctattatatcattaatgataattcattaacagattttcctgcgcgaacagttggaccgcgagcattgtgccaaatacagttttgaggtggaggcacgcgacaatggcattccatcacggatggcacgcgcacaactgcatctgcgtgtgcaggacatcaatgacaacgcacccgtgtgcacaccacaacagcaagtgattgtgataccgcctgggcaagcggcggcaggctgcacgcgcaaaacagccgccgcactgggcacgctgcgggtgggccgcgtacaggcaaatgatccggatgcgggtcccaatgggatggtgcgctttcgcatgcagcagccaaacgaatggttcgaattggatgcaaaaggtagggtaccttttttcggcagaatttttggctttgaaaccccccttttccttcagcgtcaattcttgaagaaaaaatgttttttttttcaaatttctaaaaattttacgaaattgacctcaaacccatatgctcgtttcgctttttcctccgtttcatgttttttgtgcggttggtcttctttgttccttttttcccctttgtgggagttccttctttgtcagtgctttctcgtttctctccgcttgttttccggtcttcctttctcttctcttgtgctcttccgcggttgcgtccctcccccctcttcccgtttgcgtagctgggtttgctttctttgcgccttttcncntttccggtgctctcttccttcgtcgtccgnttgatataggccatgcctcggctgctttttcttcttcttcctcccctatgagccatcattctgattgcggaagaccaaagctcagaaagacctcaggcagcaagctg

SEQ ID NO: 27944 - DNA, 2102 bp, Heterodera glycines
  misc_feature (659)..(659): n is a, c, g, or t
  misc_feature (682)..(682): n is a, c, g, or t
  misc_feature (747)..(747): n is a, c, g, or t
ataatagcttctgatgttttgattttttgaaaacaaataaaattggatttttttcgtttaatgcaaaatgccaatgttgaaaaagtgatttggaaaaagagaaaacaacaaataaataaatgtgatagcatccgcaaaaagatcatattgtccgcattctttcacaaaacatcaaccagcagcaagcgccaaatttgtcgtcgtcggtcaagcggacggaggcggcggtggaggggctgaaaaaaattggcaaattaaaaaaaatggttttcatagcgggaataaggctttagcacaacaagagaaaattagcggcaagggtcaattagtactggagaaacctcgttaacccaatgccgttacgggtgcagtacgtttcccaacctcccaaaaaaaaatttttttcactaaataaaattttaaaaaattcaggcggccatatatgaaaaaggtggggggggagggtcaaacgaaattcgaaggtgtagtattttgctgaaaattttcgatttttccttgtcggtactccctccaagactttttctcgaaaagacataaaaccagcaattttttgatgtaaatctgcgaaaaatatgcaaattttgtcaaaaatttcagcgattttttggaaattttttgtccctgtaattttccaatanaaatagtttctaagaccgctgangcggcggtggcggcggctgaggcgtcatggtcggagtgggcggctgcggaggcggcggcggtggnggcggaatgctctgtctgcaaaagaaattggtggcacaaataaatgaacagacgcaagacgagaggagacaaatttaaaagaaaaaattgacacaagtttttttttagtaaaaaaaggttatttttaaagactaaattcttttaaaaaaatgttactttattacaagtttgaacaaattccgattttttatagattaattaattaatagataaaaaattaaaaaaaagaactcagtgcatgcggaaccgaaccccgctaaattgaatcgttagggccgcgccttaaacattgcgccattcgcacgacagtattgtaactaactcattgagaacattcattccgcactttttctattttgattttgtttgaaattgatttatagtacaaaaatctataaccaaaaaaaaatggaaaaaacaaaaaactttgcatcagcatcaattgttgccgcgcaaaaagcgcaatggttaaagcacgccacttgggattcaacccaagcgcaggttcagtcccgcacgcacgcaacttttctaatttgacctattttctccgccggtaattcaaaaaatttaaatgcttctcgtttttttcttatctaaccttgcaaacaaaaagagcttctttttcattatggtaataaaatataaactttgattaaaaatttgggtaaaaaaaaaacttaaaaatttttttgttgataatgaatgataattaatttaccgggacatcggagggggcggcggcgcgaacatttggcccatttggggcggcggtggcggccgctgggccatcatttggtgcatttgcattggcgccatgggcaggccggccatggcggcgtgcggaagaaaactgaaaaatttaaaaaaatttgtttaatgacaagcaaattatttaaattgaaaagtgtcgccaaaaaattttttttaaggcacggaattaaattaattttttaaaatgcaattaaaatctttaaaaagctcccccttatttaaaattttcaccatttttagcaatgaaattgcgcaagaattatttttgttcgaatagtgggtttaattcattaaaaaaaaattttttttttaattttctattaaaattctttgtttaagtttcagaaaattctttaaaaacacctggaatcctgaagaaatcaattccttatatagtacaatttattttgaataaattttccatcaaattccttgtttagggttccaataaaatcttgaaaaaaaattccggaattttttttctcaggtacgccattaggcttttttttaaattcatattttcaattcaaatgcattgatgttcatttaaaaaatatatttggcataaaaatttcaaaggg

SEQ ID NO: 27945 - DNA, 1345 bp, Heterodera glycines
  misc_feature (70)..(70): n is a, c, g, or t
  misc_feature (76)..(76): n is a, c, g, or t
tgttaaaaaatgggacaatttttagcattaccattaaaataaaaataatcggaaatgaaacttttttctntattantatgaaaaagccattggccacattctgtaaggaccaattggggttgatgccactgaaactatgtcggcacttttaaaggcttattgaaacattcaacaatttctataggaaaaagtttttctattctattataaaaatgccctcctaaaatcgaaaaaagttgaatatttggcttttggaccaattatatgtaaaatggacgaatatttttaaaaacattttgatcaaaattgaggccaaattttctgtttttgttaacccataacactgctagattcaaagtctcaatcgcaaaaacaatgaacaatgaaggcctaagcttctccctgttaaaaaatggggacacatttttagcatttaccattaaaataaaaataatcggaaatgaaacttttttctttatttatatgaaaaagccattggccacattctgtaaggaccaattggggttgatgccactgaaactatgtcggcacttttaaaggcttattgaaacattcaacaatttctataggaaaaagtttttctattctattataaaaatgccctcctaaaatcgaaaaaagttgaatatttggcttttggaccaattatatgtaaaatggacgaatatttttaaaaacattttgatcaaaattgaggccaaattttctgtttttgttaacccataacactgctagattcaaagtctcaatcgcaaaaacaatgaacaatgaaggcctaagcttctccctgttaaaaaatggggacaaatttttagcatttaccattaaaataaaaataatcggaaatgaaacttttttctttatttatatgaaaaagccattgctcacattctgtaaggaccaattggggttgatgccactgaaactatgttatcgcttctacagagtaaccaggacaaacatatgcatttgcataaaatttaccggtcagggacgtattagtaccgccattttcgtaccgccgttttcgtacgggggacgttttcgtaccgccgttttcgtacgggggaccttttcgtacgagttcttgtacaagcgtcagattcaattagaaaaacttatgactaactaatcgaaccaaaattttatcattttttaatttcccattcataaatttaatgtaaaaaatgcataaatttaacaataacaaaatgggacaaactagggtcgcatcccatagtaggttcgggaaataccggcgagaaaattgttaatgtcttataaggtcacattgggattggcataattgtgatcattttggggg

SEQ ID NO: 27946 - DNA, 1525 bp, Heterodera glycines
tcgtccctcttcccaacaatggcttcatgcaaatcacccattagccttctttgcatgctgctgatcatgctgctgatcgatccatgcttcaacatcagtctctttaatcccgcttgttcgtttgtttttcaattaattaaatccctaatttatccattaattaattttgtacaatatttcagctgatgattgtgttgtggccattcgtaaccggactcagattccaccgggggtcagtcacagtctgttaaaaatcaatactattttggcgttttgcctaagatttactaacaaaaatgcaataaaaacggaaaatacacccctaataatcgattcgaaaattttcaaaaaatacactcccctatgaatcgactttatttggcataattaatcgtgccaaaaattaaaaaaaaaaattgtctccaaatacaatgtgccataattgttatttttgaaactagggttaagccccgacatgtttcggggaattacgaaagccgtaaattgcacttgaaataagatggaagtatctttaaatgagtttttaaacttttttattctggactttttctttttgtgtttttttagactttttatgaaaatttcctccccgacgaaggtgttgctccccgacattttttaaaatttctccagccatccccgacaaattctttcggggaatttcctccccgttccccgacattttgctccccgaggctcggggaggaaccctaatcttaatccataaatttttgagacaaaaaaaaaacgacaaattattttgaattcacaaaattttttttaaaaacttcatacattatgtttaaatgttaattgtgagataataaaaaattatttctcattaaataacaaatgcttagattttttctttttattaataatatctggccaattttaagaatgacttttttggtaaaaaaaatgcaacatctcactagaagtattgtggtcaagtgttgcaaactgtagtttgctgttgtgatgttcattaaggttctaacacataagcccgaattttattttatagaatttttacttaatttgctgctttaattattgttttttaaatatcccgcatgaaaacctggaaatcccggtcccgttttccgtctttttccctggcgggatttttactggaacgggaaaaaaatacggtagtcccattcgggaatatcgtcccgcacaaattcgttttcccattctcgaaatttttttaattgaaatttaattaattgtaaaatttaaaaattattttttctttatttttaaaatagccaaaaaatccaattaatcaatgattggtcatttttttagaaaatttgttaacaaatttcacccaagatttcattttttcccccggcgcggctttttggcaccgcctgaccctccctgtaacccagaatttttttgaaaaaaacgcgcaaagaaaaaaaaagctctttgaaaaactaaacaaaaaaaagtcgtcaattttgttttttgggggggttgttaagctactttt

SEQ ID NO: 27947 - DNA, 161 bp, Heterodera glycines
cgatcacttacttaatccctattgggtttcccccccccatcctcccgttcgttacaattgaaccaccccgatcagttatgctttatccccccactcccttcatcgcccgatcacttttgatccatcttcctattttaggtactttattccgtttaataata

SEQ ID NO: 27948 - DNA, 733 bp, Heterodera glycines
caaaatagggctcaagtacagtttatgcgtccaatcgacttttatgcgtccaatcgacttttatgcgtccaatcgatttttatgcgtccaatcaattttttatgcgtcccatcattttttatgcgtccaataaaatttttatgcgtccaatcaatttttcattaaaaacctttaaacatttaattgcactaaatccaactaccagctcaagaaaacacatttttctccattcaaaaacaggcaaagttagctttatttttatctcttttcgtagtcaaaaagccgtcatttatctctccatttgccggcaaaaagctgccagccgtcattttctctccgttcttcaaagtgctatggcaatgtttcgattggctctttttcttttggcctgcgctttaactcatgcaatggaatggcacggctttattattgacaaattcggataccgaagggaatatgccctgacaataacaacatctacgataaaggccgatgcgttaacgaatctagctatgaaacggaaaccgaccgttacattcgcaacacaacttacatttatatgactggtaattctgagaagaaatgtgtaattaaaaaaatccgtacaggaatagaaggttgttgctatttttgtgggaaaacgccctcaggaaatgctgctgacgatatttgtatcagtacatgttcagaagataacgcgcaaacgacaaaatttttcagcatattttgagga

SEQ ID NO: 27949 - DNA, 1783 bp, Heterodera glycines
  misc_feature (1752)..(1752): n is a, c, g, or t
tcaagttcatagcaatttgaaataagccaacctaccaaacccgcccccccccccccacccaatggtgctgaaatactttagttgccaaactctccgacccttccaaaaagactcgcaagtggataactttttatatattattatgctaattttcaaaactaagattgtaagttgaatcctgaggccgaattcaataccggagaaatgtcgtttttttggcgaaaagcggctacaaattccttctttttgttccccagcgctgaactatttaaaataacactggagaaaacaatggaatttttacccaattttttttttaatttcaaacttacaactttcaaaaattttattttgtttggaaaattttaataaaaccataaacattaaattgctaaaaaaatttcaattttttcaagaaattttcttataagtttctatgataaaaactctcattgttagctgttccatgtggtctcaccaattgcgatgcctcgccaaaggggttgtgagtggtcttcggtaaatgcgatgagtttactcagcaagaagggggcaacaaaattaagcaaatcataggcgattttgcaaaaagcagccccaaaggaaggccatttgaacgtgaggaaaagcggccaaatgattgacagcggagcatcgcctttcggccccttccctttcttgttggctcgtccaatcgatttggaatccatctaaaaattaaatttttgtgatattaaaaatgacgctcacgcgttgaacttatctgcaaaagttccttttctgccgctccatcggtgggaaaaagcttcactttggtaccgttttcctccgcatgtttctctccgtgtgctatgagaattgagggtggaaaaaggatgttcacccccaccggtaaaacaaaaaacaaacaaaaaagataaatttttaaaatttatatttcttacaactagatgttttttttttgtctagtgttcgcattaataagcacaacagagctaaaatttcgacagcaaaaactattttttactaaaataattttgctttttatatcaagttttagcaacgcagttttttcaacaaaaaatggctaacattaagggagaagaattacttatctaaaaatttggcagtatttttataagagactctcgccaaaaatgacaatttttgagtcaaatcttgaaatagaagaattggtttggcggtgccgataggaaaaactcaaatgaaataatttgtaactgaaaattcttaaaccaagcacaaacatagaaaaccattttacatttttgaaatattataaataaataaatttagttaaaaaagaggggaagggaggaaatgaggcgctacccaattagataaatgaccttaccttttaattgttttgctcgtattttttcgaatttctccagcaaatattctgattggtcttcttccaacaagtcccaaaggtcgtccatttccaaaggccgctggtggccaagtcgcgccattccgttgaaccaccaaaaagtgatttggttgaggaaagaaactcgtccctccggacatgcctttttctgtaattttacataatctgaagataaaactaaatatataattgcattatattacagtgtaaatcaaattagacggagtatcggcaaaacaagataagaaaagttccataagtacagcgaagtaatacaaaatggacaaaacgacgagagcgtaattcgcctgaaagtgaatatttcgaaaaattaagtnaataaattatttttgatttacgaacttcagc

SEQ ID NO: 27950 - DNA, 1416 bp, Heterodera glycines
  misc_feature (36)..(36): n is a, c, g, or t
  misc_feature (48)..(48): n is a, c, g, or t
atgaacgaaattacggatcgtgaacagaaaatcacngacctgcgaatncaattgtttgttataaaaaattggagaacccacaactgggatcccggtgctggaccggaatcaatcaaaaatgggaaaacccgggaaatccagctgcttaaaatccggaacctgggcgctcgtcccggtaaacaattggatctgtcccatgtcacgacatactcgagttacaaatttcaactaaaaaataattagatcaaagacaagtccgacatgcaaagggagcttgcattgtatgaacagcgcagcaacgaattgacagccaaggcggaccaattgcaggagactttgttggaccgggagcgcgaattggacacattgcgtgaccagttcaagaaggtttgtgcttttcttggtgctatcttttccccggatgtttcgatacttttttgcgcttatacctttattccttttgtgtcaattggcccgagaccgcaaatccctaatttttagggcactccgagtgcccgccccctgctggtgtctcggaataacttttttgttttgttttttagtccctaagtgaccagacgtcccggctgaacgagttggaggcggagttgcgtgctcgtgagcggttggccaacgtctacaaggccaacagtgaagcggcaaatgccgaaattgctgaactcaacgacaccgaagtgcgactccaagcgcagctcaaagaggccgaacaaagtaaatgatttgatcagttattttaaatttctaatttttattccgaatttcaagttgttcacagttacaccgctgaaatggagagggcggccgaggagcagaagaaaactatcacagaaaaaggtttgaattgcttttttatacaaaatttgtaaagattaaatttcagacgccgagatcaagcgtctcaacgatgaagtggtcaagtccactgagctgctgaatgccggattcagacgtaagtacgggcaatgccggaccccttacaagcacatagagttacactgatgtaattcccatcaaaaagtggaattttcttgcaactagccaaattccccattcctggtaccttcataaacatgctttttccctcaaaagtttgctcactccgtctgttttcagtgaaccgtgccgacgaagacctcatccaactgtcgccggctgccgctgtggcgagcagtttgttgaagagtggcatgtcgctgacatccatttacgcggaacattggtcgcgtggtggccgaattggacaagaaaaacgatgagttcaaacagttggagcgctacgtcacggaacttgatcgagtttcaatatatttttgtactttttctatgcaaagacccctgaactaaggaaattttttgtcaaaaaatgacaaatttacgattataaaaccatgaatt

SEQ ID NO: 27951 - DNA, 663 bp, Heterodera glycines
ttttctcgtacatttttctcctcccgaaacaccaaataggcgcgtgcgaaggcgcaacgcgcgcgccgcagcgtcgccgccacttcatctgcgtcgacctccaccgccgccgtcaccggtggggcggcggcgtccgttccgtccgcgctggtgttgccgcaggcgccaccgccagtcggggcgctgccgggcgcggcgcagaaccaaaaggcgtgcggctcgccggccggcaacgggtcgaactgcgcgtgcaaatcggcgggagtgatgccgggcggcaaacggcgtagcacaacctgaggagcaattggggggggggatgaaaaaatgccaaaaaccgaggggagggggggggggagtaaaaataaattaaagaagaataccgaagcgttacagagaaaaactcaagggtagcgggtgacaaaaaaacacataccatacccagggtctagaaacatttttcggggggggggggacccgacctgaagacctttttttttgctatttacccaattaaaaaaaccttttttccgctgttggtgaaaactgcacttttcactaaaaatgacccaattttggccgttttaggtaaaaaacttgtaaaaatagtggaaaatggaggtccggcggtgccgataggcgccgccgggaaacattttggaa

SEQ ID NO: 27952 - DNA, 785 bp, Heterodera glycines
  misc_feature (781)..(781): n is a, c, g, or t
ctgaggacgcgaagcggccgaattaaaccttccttcctagagggtgcggagcgccctttgaggccgcgaagcggccgaattaaaccttagaatacaaaagggcgcggagcaccctttgaggccgcgaagcggctgaaagtcctccacaaaattatcaatgcgtcctcgcgatgcctgtagaccaaatagaagcgcaaagcgcccgtctgaggccgcgaagcggccaaatgattccacaatatttagaagcgcaaagcgctcgtctgaggccgcgaagcggccgaatgagtccacaatatctagaagcgcaaagcgcccgtctgaggccgcgaagcggccgaatgcacttgctcatcacttaacaaacgcgcatgcactagcaacgaagtcctttgcgcgaagcgctcatgtaatgcatattcttttcatctctcacaagtatactgtctacaccgagcaattactgtgcaaagcatactgtctacaccgagcaattactgtgcaaagcatactgtctacaccgagcaattactgcgcgacacgctagtttatatactactaaagaaacaaggcaactcattgctaaaactaaaatctcgggaacggctggcgggaggggctcgggaatgtggcattgcttaagcaactttttgaggcgcatccaggaaaactataggcattttggtccaagggccaactgagcgccagcggcgctgaaatggctttttgggggaaaaagaaaggccagtttttgggcccataacttttttctgggaacccnggag

SEQ ID NO: 27953 - DNA, 1665 bp, Heterodera glycines
ttaaaaacaaaatgtggacattttataaaccatctgttaacaaagcacactcaaatgttcaaaaatttccccgagtccttccgcaaaagttataaagaaaaaacgcaccgcaaaatatggttttgaaaagcaaaaaagttcgtcaaattcgatgttggaagcccatcgaaaattctcgattcccgtgtctagaaatttttcggggtttttgggtctcggttctcgtatcgtttcccatggtcatttctctgttctcgtatcgtttcccatggtcattaaaaatgtcggggcggggtcggggttgcaaccctagtccaaactgtccgggtacacggtggttctcagttcgcgtgtaactgacaaatgagcgggaaaaaagaaataatgatgacacttttgtgaatgcaaagaattgaaaatgatcgtaagagataaaccaagattggaaaagttcgaacagctttttcagtacgaaaatttagaagcaagtgttttgccaaacgcacatccaaggaaggatgaaaaaaaaatcattttttttcattttttatagaagattttaaaaattttaatggaattaagggccggcggaggcaaataggctctgtttgaggaaaattttttgcaattttaattctataaataaattggaatacaacaaaggaatcaacctgcactaatttttttaataattaagttttaattgaaaattaaaacaaatgtttgtacgaattatctattgacgagttgtgtgactcagctacaattaggttgtttttttcctttacattttattggcatgtaaaaaagcaatttttcttgatggaaatgaatttttcggcatttactacatccaagaatagataaattctctctctctttttctctcctgtcttttttctctctctctcctccctccctccgtctctttctctttttttttctctctctctttctctctctgtttttccctctctctcttttctctccctctctctctctctttctctctctttttttctctcttttctctccctctctctttctctctctctctttctctctccctctctctctttctctctctttttttctctcttttctctccctctctctttctctctctctcttttctctccctctctctctctctttctctctctttttttctctcttttctctccctctctctttctctcttttctctccctctctctctttctctctctctcttttctctccccctctctctctctttctctctctctctttctctcttttctctccctctctctctctttcctctccctctctctttctctctctctcttttctctccctctctctctctctccatttttcgttttggtttatatgtagctttcgctttttgccggtctcctgcggatttttttcaactttcacacaaattttcaaataatttttggtacttctgggttttgggcctacaccacaaaatttggtacttatgcagtttacgccacataaaaaaaaattgtttttttttaattattaaaacgtgttcccaggagtattcggggccgctgatcacgaaaattacattcatttcgactagtttcgaactccggacccgaattcgaaccaaagacaaaaattcatttttcactaaaatccacctttatt

SEQ ID NO: 27954 - DNA, 1120 bp, Heterodera glycines
atcactggggactcaattatccatcattccaattcccgcgtttcaatcccaccagcattccagtcactgggactctgttctcctgcattccaatcaccgggactcagctctccgacattccagtcactgggactcaattctccagcattccaatcaccgggactcaactcaccatcattccaatcgctgggaccgaacctcacctgattcttcggtatcgcaaccaccgagactcaattctcctgcattccaatcactgggactcaattctcttgcatttcaatcacagggactcaactaaccagcattccaatcactgggactcaattctccatcattcctattcccgggactcaatcccaccagcataggagttcaatcactgggactttattctcctgcgtttcaatcactgggactcaaccctccagcatttcaatcactgggactcaaccctccagcatttcaatcactgggactcaaccctccagcattccagtcactgggactcaacacaccagcatttcaatcaccgggactcaattctccaggatttcaatcactgggactctattctcctgcgtttcaatcacccggactcagtttttatgcattccaatcaccgggactcattctcctgcatttcaatcactgggactcaaccctccagcatttcaatcactgggactcaattctcttgcatttcaatcactgggactcaaccctccagcatttcaatcactgggactcaattctcttgcattccaatcactgggacctaacctcacctggtccttcggcattccaatcactgggactcaattctcctgcatttcaatcactgggactcaaccctccagcatttcaatcactgggactcaattctcttgcatttcaatcactgggactcaacacaccagcatttcaatcaccgggactcaattctccaggacttcaatcactgggactcagtttttatgcatttcaatcacagggactcaattctcctgcatttcaatcactgggactcaaccctccagcatttcaatcactgggactcaattctcctgcatttcaatcactgggactcaaccctagagcatttcaatctctgggactc

SEQ ID NO: 27955 - DNA, 1088 bp, Heterodera glycines
cgcgcccctctgccatgctgggaacatttgtatggtccaaaatttctcgcaaaaaagagatagccatttttctggcatatataataaatttaaaaattccctgtagaatagaatggccattgctctccgcgcccctctgcccatgctgggaacatttgtatggtacaaaatttctcgcaaaaaagagatagcctttttctggcatagagaataaatttaaaaattccctgtagaatagaatggccattgctctccgcgcccctctgcccacgctgggaacatttgtatggtacaaaatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaaaaatttctcgcaaaaaagagatagccatttttctggcatagagaataaatttaaaaattccctgtagaaaaaaatggccattgctctccgcgcccctctgcccatgctgggaacatttgtatggtacaaaatttctcgcaaaaaagagatagccatttttctggcatagagaataaatttaaaaattccctgtagaaaaaatggccattgctctccgcgcccctctgcccatgctgggaacatttgtatgggaaaaaaattctcgcaaaaaagagatagccatttttctggcatagagaataaatttaaaaattccctgtagaatagaatggccattgctctccgcgcccctctgcccatgctgggaacatttgtatggtacaaaattctcgcaaaaaagagatagccatttttctggcataaaaaataaatttaaaaattccctgaaaaataaaatagcctttgctctccgccccctctgccatgctggaaacatttgattggaaaaaatttcccccaaaaaaaaaaacccttttttgggataaaaaaaaaatt

SEQ ID NO: 27956 - DNA, 914 bp, Heterodera glycines
acatatgtttggccatgagaaaatggttcttcactataatctaatccaattttttcaaatgtttgtgattggcttttgtttatcgtaaaggcaaatgctaatttaattgggaactgatgtcttcttaataaaaatgggaactttttttcttctattaatgttattcttggtattagtgtttgttcacctattctgtcgccacttttaataatacaactaactagccgctctgagggcatgcgtggggagcgtgcacttgcttgccctagcccgtcgagttgtagccagtaacgggtgcacagtccaggttgttagtgcagtagcagctcaggcgcagatgcgtgtctggatgttcgtgcagcagcagctaccggcacatgcgtgtggcacccgtgagcagttggaatgggcatgcgtggcacccgtgaacagttggaacccgaaggcttggcgaatgggcatgcgtggcacccgtgaacagttggaacccgagggcttggcgaatgggcatgcgtggcacccgtgaacagttggaacccgagggcttggggaatgggcatgcgtggcacccgtgagcagttggaacccgagggcttggcgaatgggcatgcgtggcacccgtgagcagttggaacccgagggcttggcgaatgggcatgcgtggcacccgtgagcagttggaacccgagggcttggcgaatgggcatgcgtggcacgcgtgagcagttggaacccgagggcttggcgaatgggcatgcgtggcacccgtgaacagttggaacccgagggtttggcgaatgggcatgcgtggcacccgtgagcagttggaaagggcatgcgtggcacgcgtgagcagttggaacccgagggcttggcgaatgagcatgcgtggcacccgtgagcagttggaaagg

SEQ ID NO: 27957 - DNA, 1906 bp, Heterodera glycines
  misc_feature (1589)..(1589): n is a, c, g, or t
  misc_feature (1634)..(1634): n is a, c, g, or t
  misc_feature (1653)..(1653): n is a, c, g, or t
  misc_feature (1661)..(1661): n is a, c, g, or t
ggaatacggaagacaagattcatttaaaataaaaaaaggctaattttgcgttcgcaaaattatcgactaattaataattatataatgaaatcaaaaaaacattaaaataaaatctaagtgaagaattttaatcacaataatactaaaaaatacaattacataataataaaaattttttaataattataccataagttcatttaaattgtgatcctttattaaataattggtcttgtctttatatttatttactttaatttaataaattttaatatcggtgattgttaaaaatgctataaaaacaaaacatatataaaattcctttggccagtaaagggaaatggagtggaattaatttaattttttccaaaatttttttaaaattattttttaaagcggaaaaatatttatgggattccctggaataaatttatactaaaaaattttaaaaaaaaaaaattttttttcctgggatttcaaaaaccccttttttaacccaaaaatttttttttttttttttttttaaaaaaaatttttttttttttttgggggaaaaaattttttttttaaaaaaaaaaaaaaaatttttttgtttttttaaaaaaaaaaaaaactttttttttttggggggggaaattttttttctaaaaaaaacccggggggccccccgggggggggggggggggggcccttttaaaaaaaaaaaaaaaggttttttttttttttttttcacaaaccccccgggggaaaaaaaaaaaaaggggccccccccccccccccccctttttttttttttttttttttttggggccccccccccccccccccaaaaaaaaaaaaaaaaaaaaaaaaaaaaaacccccccccccccccccccccccccccttttttttttttttcttttttttttttttttttttaaaatccggggcgcggggggggggggggggggaatatttttttttaaaaaaaaaaaaaaaaaccccgggggggggggggggggggggggggggccaccccccccccccccccccttttttttttttttttttttttcccccccccccaaaaaaaaggggcggggaaaaaaaaaaaaaaaaaaaactccccccgggggggggggggggtgtttttttttttaaaaaaaaaaaaaaaaaaaatattttaaaaaaaaaggggggcttcaaaaaaaaaaatttttttttttttaaaaaaaaattctccccccaccctttttttttttctccccaaaaaaagggggggtttttttctttttttgaaatttccggaaaaggggggggttttgcataaaaagggggggggggggaaaaaacaccaaacccccccgccctttttcaggttgggattttttttgggggggaaggggggaagggggggaaacccaaaaaaagggggggggggcggcgggcccggacatttccttcgggggggggggattcgaaacggggttgtcaccaatccccgattttaggatgccgaaatggctgcccccatttatgaggtaaataaatttttccttatttgacggaccaaatccaataaaaaaaaaagttgggtatcatttttcntttaagaaattcattttttggcgtcaaaggcatttttaaattaantggggagaataatcaatgnaactaacncaatatcgctggtattgcggtttcaatttttccaatcattttggcatcggtaccaaaaaacagtaaatttacacaatcgccaaaaaattttgcccttaaactctaatattttttttgattggactgactcttaacatattcagttgctccatttcgcactttctaagtccgttcgtccgtcttcaactcttcagcaacagtcccaaacgaccaccgccggtccttccgtcgatgtaaaatacgag

SEQ ID NO: 27958 - DNA, 1338 bp, Heterodera glycines
ttcgcctattatcactgtttaactataaaataaaaattctatataaataaattaccaaagatatgacaaataaggcttctctccaaatgatactaatcgctttgcgtcaacttaccttcactaagttcatttagggaatggtaaatttattaaatttcttattatttttttctttatttagacagttcaacccagaaatagtggtccacaaagtcggtccgcaaatgtcggctaaccctttttgggtggggggggggtaaattactacgttataacttctcccaaatgaagacgaaacgaatggaatgagccggaggagaaaatattccatttaaaagagggaggatgcagcaaaaaaccataaaaaatttaaagttcattgtcagcaatttccttattttccatttccagaaggaggaaaccaaactgagtcccgaggaggaattgcagaagcaacaggatttgaactcgaagaaagccgtcataaatgcttatgcggaaaagctgaagggtcttattcaaacggacaaagacagcacagcgaagtaagcaaattgataaatttggagtttaagacaaggaaattccagactgaataatgcgctgacggatatgaacattgcttctaaaaacagaaattatcgtcaaatttctttgagacaacggtcggcttcgacaagttcgaccagctcaacttcaagcactgtaagctccacttccaccacttcgtccgattcttcttcgaccacttcttcgtcctcatcctcctcctccacgtcgactgacagccaagaaaagaatgacaatacgcaacggacaacggggagaagcagtccgaagggagttgagcctccgaagcagccgatcatgttgaagcggatgattggagccaacagaacagtgaaaaatgggcagcacgtacccaccgtacaagtcgaaaaccgagtcccacagaaggtcacgaaaatattgcctttggagtctgcccaggcgaaaaagggccgttttgtggcagcctttaaaattgcaccgactgccgctcatttgcccattgccaactacggcacaaaaagcgcagcagtggccaaagcatttgtcaacagtgacggcggagaagacggagaggaagaaacactcccgaagaatgcgcacaacaaaatggaagaaaaccccaatcaaaaactgcaaaaacagttgacggatgacaaaatagaagagcattcatttccaacgacaatggcacacccttcaaaagtggaggaaatgaaaatgccaagcgaagactgtgagaaaagggcaaaacagacagagaccaaagaggagccgaaggaagaagaa

SEQ ID NO: 27959 - DNA, 1075 bp, Heterodera glycines
  misc_feature (1069)..(1069): n is a, c, g, or t
cttacgtccatttctgcttgaactttttgtttactctgtcgatgcttcctaaagtgccgttttgctatttaagtccctccggggtgtccccgccttcagtttgatgacgttggccatcgccagtgaggaggccgtttcgctctcgcccaagttgtagtcccacccgttgaccaccttccaggtgaacacgtactgctcctgcttcccgctgctcaatttgctctttcgcgcgttcgatgtcattcttcgacagagtcaatttcaaaattaccttccattaattattcattaattagttcgccgttcacttcttcaaaatgatgaaaatgctgaagaccaacaggaacaaattgacgcagaaataagcgaccggaacattatacggaatgacgacacccttcagcaccgtttcactgctgtagaacccgtaaaagaggtaggaatattgaaggtagccctgaaggggggggggatgactcatcaaaggcatttgccggagggtgcaccccaaagtcgaggacggtgttcagctcatcggcatgggccaacatttttggcggaatcactttgatgtgacgggtttgattgaatctcttggcgtcgttctgcgagtcggcaagccactgaaaagtcagaccctttgacaggtgagcagagagagagagagagatagagagaggaggagagagagagagaggaggagagagagagatcaagagaggggggagagagagagaaagagagggggagatagagagagagaaagagagagagagagagataaagagtgagagagagatagtgagtgcgagagagagagagggaagagagagatagagagagagaagcggagagaaagagagagagagagtgatcggctcacctcgggcaccacgacgaacaccatcatcatcagggaagtggtgatctgagcggaagaagcgcatagaccgatcggtaaacaaaacagaaaaaagtacattcattcccaacacccaacggaggaaaatgaagtaggaagagacgaccgagccgaaggggattcgatctgtttgattttggactcccnacggga

SEQ ID NO: 27960 - DNA, 1157 bp, Heterodera glycines
ttttccctttgactccaattttcttcactaatttttcactcagaccccattcttaccagtgcttgtttttcccggttcccggttgccctaccgggaccgggaccgggacctgagcttttcaaaaccagggaccgggaaccgggacctcggatgaccgggaattcccggcccggtcccggtcccgtggcactctagtattttggctacttcgtcactaaaataggtagttaaaaatcactattttggcgttttgtcactattttttcactatttcaagattttttggaaaattccttaacaaaaatgcaataaaatcaaaaaatacacccctaagaatcgaccaaaattttttttaaaaatacaccactaagaattggaaaattttttcaaaaattcttcccccaaatttttttacttgacaaaatttttgatttaaaaaatgtcaatatttgctaagagaattttataaaggaaatgtagctcatttgcaactgcaaccagtgaataaaaattattttttgctcaatttttggctaaaaattatgtcactattcgtcactatttcggactttttgtcactatttcggcatttttactcactattttagttaactatttcgagatttttggtcattaaaagtcgcagccctactgatcaatttgatattagttcgaagcttttcattatactgtacataatgacgtggctgatcacactgatcactcaaaaataattgaaattgaagcataaacgttattaattaactaattaatttttgttaatggatctttcgccctcctctctctgtccctctctctcttaatgacgttcccactttggatgtgttgtaagccttccccttcgaattccctttactaaattgccccaatctcactaaatatggcgcaacataaaacatttgaagcagctgtcaattcttcccaattctttgtcattagctgcctttgtattgcggcaaacgatttggttgagagaggaaggaaaggtgaactgatggagcgggggggagaagaggagcaggaattggagaagaggaagaacggtgaagcaacaaggagaggacagagaggggataaagaaaaagagtggagggacggtagaatgggaaggggggggaggaggggaaggggaaggg

SEQ ID NO: 27961 - DNA, 1057 bp, Heterodera glycines
aaaatacgggtttttctcttcggtggccaactgagtcccggcggctaatttctcacttttgcttgcgtttgaaggcccgtaactttttttaaaggacagggagcggaaaattcttgctggtaggattttaagttgaagtgttttctaattttcaaaaaaaattccaggcctctacctatacttggaagggctgcagaaattggcaacttttcagtaccaactttgcccagttcagtccccgttgaataaactcattaggctttgacctgagcgcagggtggccagcagacttattgtagagctcggtgagctcgattttctgaaatttaaaaatttcgaaaattttcaaaatttttcgagctaggcctaaaaaacggttttcgggtttttgaattttaggaatttttaacgaattttcccagaaaaacggagaccacttccaaaacatagtttttcgagctctatcgattggtatttttttcggaaaaatttcgattttttcccggaaatagaaaaattttttggcctcagcgggacatttgagtcccgggcccataactcgtcaggagttgattttagcgaaaaattgtcttagaacatttttgtagagctttcgaaactctatcgaatggtgtactataagtctggaaaatttcaaaaattttcgagctaggccccctagaaattttcgaaattttttttgtgggccaaaatgggggtgaaaattttttttctgggctattttgaggtgctgagtacgattatgatgtctattttaagtttcagaatttttggaattttttaaaattcgaaaattttttaaatttttttggtccttggaaatttggattaaaatttgaaaattcataactcggtgatggtttcatcgatttaactataataaagccttaaaaatagcaaaaaatcgggagaattttatgggatttatttggttttataatgttcaaaagaaaaaaagttattccagaatttctggaaatttttgatttttctagaaagaaattcataactcggttctgaaaagtcatactgtaaa

SEQ ID NO: 27962 - DNA, 1167 bp, Heterodera glycines
acccacttttatattatcgtagcatggtcttgctacgaaatagaggcattcctcaaatcggaaccacaattactttgggtgacaaataaaattttaatttaattttttaatattttatttttgaaaggtgttactccgaccgaaatcagttctgctagggccgaacggagtttcaataaaatgattatcacaggagatcgcatagaagaaattttccatgttcacttgctcgtgtgagttatgcgacaaagcagaaaagtcaaccgactgagcaaatatcttctgtctataattttcttgttcaccaaaaattcgtcaactaaatccatctatcttccttgctatatttaattttatttttgtaaatttaaataaaatttcttttgaaagttttaattttaaaatcaaaaaattgaggattggcaaattgaaaaaattctaaaatttatccccttcgacaatttcgtgttttcaatgaaatctcgctaaaatgccagaaaattttaaacaaatcaaccataaaagaaatttttttgttaatcgccccccccccccaaatttcataataacaaaaaaatttcatcgacatatggtggttgaaaatagttatttttttgccaaaaatgcagcgcctatcggcaccgcctgacccccattttaccatatttttgaaaaacggagaccaaaatcgcaaaaaatagtaattttttggcaaaaactgcgaaaaattttgtaaaatacaccctccaattcgggattttaaaaaacaaaaaatgcacccctaaaaattgactgaaaaaaaagcaaaaatttttaaagactaattagctaattaattttctgccttgagatccatcaaatcactctccctagttataagtgtaacttattatcaatgaattacacgctctcaccactaataactaggggatgatatagttttttaactattttttcctgagctccctatagcctgaaaagcactaaaaacatgttttaagggggttgttaagctagttttcgagttattagcaactattttatagttttttatttttagcaactaaaaaaaattaacgagaatttttgattttgaaaattatgtatttcattaacggtttggcataatatttttgctttttgaagaaaattttgtcattttacacc

SEQ ID NO: 27963 - DNA, 1141 bp, Heterodera glycines
ttctataaactctgggatttttatgactgatttttttttaattttaaatctgaccattttgtgatcggaagttgaaaagttttcaagtactgttaaattatggattaattcaaattcactggtttaaaattgctttttctctagttggttccttggcatgttgtttcaattgtttttggtctatgaaccaatcagcatatttgaaaccggatcatttctttgaattatcttattttcatcccctaaaatatttgggatattaaaatctccacaatatatgatattttttgaattactcagatcagaaataaattttgattattcgtccttttgaactgttattgtcggacattttttttgtttttcgggtggagatgaatttctttgcctgtgtccaatttgtcttccagtccacagtcctgcacaatgccctttataaagtcattgtcgtcgcttcaaccgcctcaggcaatttctccaacacagcagatttggatttgtcgaccatcatttgctggttggtgatgccgtagtttgtgtatttgactaagaaacacgggtccatagcaaaaggaggtgaacaaccccatagaagaggggtttgggcggcactggcaagcgaaggcgctgactgggatttgtattggatttgtgccaaatttctttgaccgttgttttgatgatcgattcaatggtgggttttagaatttctgccaccatttgagcaattttggccagttcctctggccccaacgaaccgatgatatcgttttcatcatcgacaaaggaacgtgaccttttttgtgccattttgcgttggaatagatcaggaagagggaatgaattttggggttttattgattggattttgatagatgaaaattgaaaggaatgaaaaatttttatttttataattattttttattttattttttttgtgctgatttacaatgtatttgtaaattcaaattctattacagcaataaaaaacaaaaaaatatttatgttatccttttattattattttaaaattctttattttgaatttcatatttttgaaaattttgatcttaacaccttcgaaacatgtaatgaacaatccaacaatgaaattgttttcatatttttatgttcattaata

SEQ ID NO: 27964 - DNA, 975 bp, Heterodera glycines
  misc_feature (835)..(835): n is a, c, g, or t
  misc_feature (840)..(840): n is a, c, g, or t
agaaataagtagttttaaaaatgaaaaatctggggaaaatattgaccatattgcccagagtaaaaaaaggtcatatactatcattttattcttctcgtattaaatcaagaatccggaagaattttttggggtttttaacatttttggtttaaagcaatttgaatctggtcaatcagattttttgttataattttaaaaattttataaatttttcatccttttttatttctataaatttaaaaaatgattttgaatccattattcagttttgtgtaataaattttttaaatttaggattttgaccaataatgcaggattttgccacatggacaagtactttgaattattttctaaaattaattttttttaatttaacataatttgattttttaacgtacgagccggagacgttttgtcggtgccatttgtgccatgccgtttcggcgaattttcgcagctgttttgttgccgggcacttttgtcagccaagcctaaaaaattgttgtttttttataatttctcaatgtttgaacggtaggttaatagttatgcataatttgggattaaattaatcattgagtatcaataaccaaaaccaatttgtgaaatatctcttaatttttcttcaattcctgagtttaattttatttatttattttgtataaattggccaaaattatccaaatattttcattatcctgatcaatttgagtaaattccttagcagataaatttttggcattctgcatcatccatttgactgcggcatatttaaatttaaaaaaatattcaaaaaatcacctagagactaaaattattcattaacaaaaggatnaatgncttcttcatctgaagattccgagtcaaaaacgacgggcataatttgaaatttgctaaaaaatgcaataaaacaaaaaaagaaaaatattaaattttaaattgattgattgattcaaaatatgaaataacaataat

SEQ ID NO: 27965 - DNA, 1004 bp, Heterodera glycines
atgcattttgactgtataatgcccacggaagtgtcgttccccccgactggaaatagaggtcaaactgtgagtcaatgacttattgagacagtttgcccatgcaaaaccaaacaaccaagtcaaaggacccttttcgaagggacagatagtgtgtagctgttccctattgccggttgactttcaactgtgagtcaaaaggatgattaattgtgacagttgtgcctatgcaaaacccaacatcagatattctgtggttgagacagctgctcattttggcaaggtgccaaatttaacccagccgaaaaataagccccgcctactcggtggagtataaatagcctgtcatttccaacaaaagtgcattttttccattcatttggaaattttgaaatttttctgcaaacgactaaagcgctctttcccttttgcttcctcgctctctgcgcactatttaaaccaatttaaccataaccttttgtttcctaccatccctttaaatttttgcattccctctttcttcactatttaaaccgaattcaccaaataaaaatataattccataatcttccaataaacctataacaatataatttaaataatattacaattaaataattaattacaaaaataaaagttcgtgctcatccctttaattttctacgtatccttacatcttttacctacttacccttttttgcttttgcttttcctctttgctcactatttaaacccatttcaccacttaattttaatataaatccctcaattttaaaaaaaaaaaaaaaaaaaaaaaactccaataaacttaattaaatcataaaatttttataaaaactttacttcataaaataaaaaaaaaaactttccttaattcatatatccatattttacccaatcaatcaataaaaactataaatatgaagggggcctccaaagcccaatcttcttctccctcccccaaaaaatctcaaaccaataaggcattcgaaaaattgataacctca

SEQ ID NO: 27966 - DNA, 227 bp, Heterodera glycines
ttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaattttgaagggcggggggggggggc

SEQ ID NO: 27967 - DNA, 1907 bp, Heterodera glycines
tgccaaaaaacctatagttttccaggtgcgccatcaaggtacgaatgggtggtgcaaattcaccccctagctattcccgggaggcaatgcaaattcaattaggttacataaaaaaatttacattttatatttcctcattaatatttccactttccaaattattctttttgcaaaaatatataaaaaatttttttgcaaaatttattcaacacatgttctttgtataatccataataataaattatgtaattatgtaaccatctcatcatcatcaccatttttgccagcttacaaaacaatcgaaataaatggaaataatttgtccattttatttttatttgataatttacattttatttctcataatcgctcgaattgtagttttaaatttggttagcttttgaattttttaataaatactcatgttttttcgaaatgcttaatgcttaagtgtaaattttacttctttatcaaaatcatgcctcgaattatacgcattacttttgtttgttttttgaataacatgtaatattttaattttttttttaattttggcattcatttttcattataaaaatgatgctgcttccgccaatgattttcttggccctctctttggcatttcttttgaacaacaatggcacatttggtggcagttgtacgtccaaagatggcgtcatggtcagcaatggacaaatgaagcaggaacaactgaagaaaaaacgtcagggcacaacgccaaaagcgcgtgatttatcgagaaggaattcaagtacctcaacatcaattggatcagaaatcgacattaatggtaaacaaaatatttgaataataaataaaaatgataaaaaagataattaaaatgcatttttatttgttagcattttattatactggggaatcgaaacattttttattgaattcataataatttcttgacatttttaatttacactttgttaggaccgagaatttaatcggcaagcgaaaaataatcttattattaattaaaattaaaattctaacatgattatcatcggcatcaattgagctttatacgagaaaaattttctgtaaaaattggttaactttgcgctgtaatttattactaatttacccatagaattcggaatagcgaaactaagttaattactgattttcaggaacatttctgaaaaaactacaatgtcgaaaaaacaaaaatattttttctaaaaataatagtttttttgggtaaaaaaagactgtcagaaattacaaaaatgctgctacttctgctacttactactaagattttattttaacgatgtttttggcccagtaaaaatcttttttaaatcaaagtgccaatgccatttgcagatacaatcaacttcatcaaagagaccactcgagatggctacacatcgccaatgcaaagttctcgtttttcggattcgcagatgccttttccaccactctcaccaaacgttactcattttgctgttgataaatcgagtcgagtaagtgatcagtgaatcctttgtaacataaaactttataaaatttaaactttcacgaaattttcaaatattccctaaatttctttaaatatttccaatttttcaaagtttttcaggaatttttccaagtgagggtgtaggacgacagttttaagaaaagcactagcacaagaaaaaaaaagaatttatgggaaaattggcactaatttttgattcaacttttgaaaaggaaataagaaaaaaagttttttttttgaaaatctattcctaaaaataccaaaaattagtttttaaaatgttaaaatgtgatgttcccatttaacgcgttaccaataattttttttctccagaaaaataaccattaatattgattatttggatttttaaacatatttcttacatatt

SEQ ID NO: 27968 - DNA, 1156 bp, Heterodera glycines
  misc_feature (1145)..(1145): n is a, c, g, or t
atgattttggcggtttttgtattttaaaatatatttccaaaatttttcagaattttgctaattttaagtatttaattaaataaaatgagcaattcatttaaaacacattatgtcttatattacactccattttttgtttggaaaattatccaaatttaaatcttgcggagattaaaattgtgattacctttatgttctttcttcaaacaacgcaaaactatgtagtacatccgggttatccaccctccgaaaattttttaaattttttacaaggagaattttttagtgatgcgacatttgaagattggcactcgagcataatagggagtcgaaaatcgagaacaaagaaatcttaatgaaattaattgaaatgtattttttttaaatcaaaaacatacatgaaaaaagggatgggggtcaaccgaaatttttggaggccggtggtgccgataaacgccgccgggaaaccgggaaaattttttgtgattttaaataaaattttaaaataaaatcatttacaaataaaattaaataattaatttataaataataagcaaaatattctgattttataagcatcatttcaatcctccaaaatttgttctccaaattgttttttccatcttagaatgaatgctattttttgtattttcaactttttagcaatttcctttctcatttttaatttttatttgccaatagatttcacttttttccattttttcttgctccattattcttttactgctaattcaattgtttcttctattttttaattattggaagggctaactccattaaaaacaattattctttgatgaaaaaagggaaattgttgaaaaatatttttaaaaaaatataaatttatgcaaaacgataaacattcacgaaaggaatggaatgaatttagagcaaaaattaaacaaataattgatatggattctgtgacgattgaaaaatgggcaaagaaaatacttcaaaaagtaaacttttaaagaatttggttttattatttaatttaaatatttttagggcggaatcattatgcaattgctgaaaaaatggaaacattgaaaaaaaaaatttaaaaaaaaatcccaccctcactgactgtgaaatgtcaaaaatattggatattccacganagttctttaca

SEQ ID NO: 27969 - DNA, 1817 bp, Heterodera glycines
  misc_feature (1786)..(1786): n is a, c, g, or t
agaaaataaagcgaccgaaattaaaagaaagaaaatggattaaggatttggatggaaaagacatttttaaatattatatgggataataaatgaaatggcattttaagggtttgtgatggagtgccgtcgcttacctttccatcggccgaatgtttcgcccctttcgcgcctggggcggtcgtctttcagtcgcctcagttgcgaagaacggaccgggcaattgcagtagagtcgctcagtccctttggtgaaaggtttcagcatgtcaaggacagtgccaaaccgaaccggcaattcccggtacgccaatcggaccgacggggcccttgccgcccggggggccggcttctccaggccatcctgacgagcaaaactttctaaaatggtttccggtgccatttctcacctgggtagcccacgtcacccgttgcgccggccgtgccgtccgcgcctctctcccccgcctctcccgcgtcgcccatttgtcctctgtcgccctttggccccggccgtccccttcaaaaaggcactaatgagtccctcaaagtcaacttgcttcaggtgttttgtgccaccttcgccgggtgtcccttaaatggcattttaattgttgcttttctcggcctttcctttcttttcccacccgcttttcctgccgtgccgtctctccccgctcgtcccacttccccaatttttcctgatgctcccgcgggcgctcttttcggaattcccggctgaactcatcagtccgttaattgccttaattgattttttgccaattgctttacctttccgttttctccgttctctccctttttgccctgcggcccattcgccccggggaatctgccaaactcgcataattagtctttttaatatttttttaatattattcttaatcaacccgcgtggcccttcaggacaaacaaagcattgtgacgcgtccttttcgaagtttcgttggatttcgtccccactttctccctttggacattatttaatcgttacactcatttcgtttccctttcaccttttttccatgaacacccggcacccccgggatgccgtcgtgccccgctttccctgcaaaccccggcggccccttcggacattcgatcggttccacgcgctgctcattgtcagtttgacttctttgggctgctttttccccataagtcggcactccctgtgcctttgccattgcctttcgctccgtcggtccctctatttctcccctctccgttagggctgtgccgtttcgctttgtccatgcttcggttgggtttggctttggcacttttttgctcttcgccatgccttcctcaagtggtattcttttgatgtacagctcccaattcggtggcttttccttccgtttgccctgccccttctgctgtttgctatgtttctcttttgtcggctcgccttcgcgttgcttcatcctttgtctgcctttgtacgattctgaatgccaatcggtcatttccttctgtattaccgtaacatcgactcacttcgctccaatcggtccaaaaagccgcggctttccccatgtgacatttgcaattcgcgccgttctctgtcgtgcatttgccatccgttggatgattttttgcgaagatgcgtcaaatcccgccaaatttcatctgccatgctctgctggtaaaatgccaaatcctttggtcgtttatctgccacttataaaactgactttgaattgtttgccctcccttgttgccatttcgttcagtgattccaattcgtcgatcagaatcggcaacatcanagtgcttgcgcagatggcaacagccgaaagt

SEQ ID NO: 27970 - DNA, 1401 bp, Heterodera glycines
tattaaagcaaaagctgttgcactcacccaatgcaattcacataaaacgtaaagctgacattgttcaaattgcccgaattttggtttagcgcggccgtagtctccccaatttgacatcgcttcattatccatcgctcatcccattcatcatcatcttcttcatccatactttcatcattgttttctgctttctccaatgtgagcttttcgttggtccgttcgttcaccaattgaaatggcacaatttccgttggcacatgaacagtaaattgaatttgatagctggcggaagaagtggtggcacggataaatttctaaaaaagggaaatgaaaatcaatgacagtcaatccaacgaaaatgtgtccacacaccttcttgaaattgttgactaaatcagcgatttctgacgaatcactccagcaaatcaatttcttcagttggccatcttttgccgggatgtgaagccattcagacagaatttggccagcagaatatgcaagtggctgatcagaatcaccacaaatctcatcgagcaattggtcaccagaatcaatggcatttgggaacagacgatcagcatcgattgaatgaatgttgagatcggagagcacttttggagaagtgaaacgaagcaaacagtacagatgatcagcacttggaaatttcaattggcgaatatttggcacaaaaattggcaaaatatggcggatcaaagcattccaaattggctggacaaaaaaggtttcgttccaagacacatagaagaactccaagtttgttcctttgtcgaacatttgctgattggcacggataaatgcgatgacagaatggtcgatgtagctgaaaataggaacattgtatccgttaatccatgtcggaatttgaattaccaaatccgaagatgcataaaacgaattttcttgggcagcgaatggtcgggcaccggaaagggcacataattggcattgtcaataaacacacgcaattctggcaccgctgtcactttgttcttgcgcaatacgatattcttccaaaattggcaattcgcttgtgccatcgaaatgtttgtcgaccaaaaattcgaaacgtgacgaaagaagtgccaattagagtccgagttgaagacggtcaaaatgagggaaaatgtccatccacacgtcgttgcaaatccaactgaaattgtggaaaatcaaatcagagtaaaggaaaattttgtctaaatattattttaccggcggttcattttgttggaaattagcacaattacgaaggacgtcacaaagggggcacaataataattatgttagaaatatttaaagtacaatgagaaaccaatcgaaaaaacaaacatccttagaaggacgaaaaacgcaaaatgaaaacgtagaagctaaatgctt

SEQ ID NO: 27971 - DNA, 1297 bp, Heterodera glycines
ttttttgtcccttttcggcgtgccattgttcgcctgctgttggttgtcccgcatgattggcactttcatcacaatgggctcggcagcgcagctggccttctcacgtaccttaaaaaatgaatatgccgccattttgaggcccttttaaagaaattttgcattaaaaaaaattaaatgaggtatatggaaggaattttttcgtactggaatatcgtttgattttttacgagaacgatctccgccggtatccagacccccagaccccgactttttggaaaaaaagggtctggatcgggaccccaacacaataaaaaaaaaaatttttttaggcctccagctaaaaatgaatgggagtacaaccctaaatggggtggggatggaaaaccttgtacactgtgccgaaaaagccttgggcaagcacttcgagcagttcaaaatcgtccattgctttcagtgtgccgctgaacgcgccacgcgaggcactgacgcgacgctttgacgccgttgtcgcaaaaagatgctttgacgaaatgggcaaatataaattgatgaatatacagacgaatgcaaatgagagcattttggttcgaagtgttccctttatatacttaagcgtgtcaacacggcgagtcaattttgggctccaagtacaattaagtaggatttttcgtcttagtggtctgtgagttagtcaccaaaaagggggtctcaggttcaaatcttctttgtgtttgtgtataaatttcattttttaaagcaactaaataaaataataataaaaacagaacgccaaaagaacaaatacaaacagtagacattttattttaccgattttatgaaattttttttagcttataactttttcaataatagacctagagtgccacgggaccgggaccgggaccgggccgggaattcccggtcatccgaggtcccggtcccgggttttgaaaagctcaggtcccggtcccggtagggcaaccgggaaccgggaaaaacaagcactggtaagaatggggtctgagtgaaaaattagtgaagaaaattggagtcaaagggaaaaataaaaaataataattaatatattctttaaaagtaacactgccaagtgtgcgaatggcctaatggctagtctccttgactttcccttcttctttcccctggttcaatccctctacagaaattaaattattttcaattttttttttgtatactcgtgggtttcctataaagaaaatatgattcctcatagttttttaaatggcacatattttatcattttttttaatgaaatcct

SEQ ID NO: 27972 - DNA, 1436 bp, Heterodera glycines
ctctttctccctcccctttctatctctccctcccttttctctcattctctctcactctccgcccctccccatttattccgttctctcaggtgaccaatattccccaatctgtcgacccggacggtcttttgctgacaatggcaagcgccgaacgtcagccgttcttttacagattcggcatcttttacccacaaggaatggagaaaagagaagctgaattttcggtatggcgttttatttacatttttggctgcttttctgctcgtatttttgtaaatctccgcataaaaatgcatttttatccgtcctttttcggggcccataccaaaagaatcgagtaactggtaagtttgccctgagtagctgcggtaagattcttaccctgggttggcccagggtaaacatgtgaccttgctttttaaaaaattaaaaaagatgatattaaaaaattcattttgctaatttgtaagttgtacttaaagtctgctctattcaatgataaaattttcgttaaacttttttgtttttcactgagctagggagcatcaaaaattttgaaaattcttaaatttttttgttgattttttgtctatattacttttaccggttcaaaataatgattattcgattttggacaattttattttcccttttttttaaatattcgacctttggaacatgaaatacccacaaaaatatactgcgttttgcgtttaataactttccttataagtaatataatttcttgatataattcgatagctctaaatgtcctctataatcctataaaatttcatagaattaatgaaataatgaaagagttatgatttagtaatgatactaaaagaaacgggtaaaccaggtaattcgctaattttgctacttttctttcagatttgcgaaaaccccgaggaccacaactgccgttcgttgccgctggcggtggatgcgaatgatcacctcaattattttggagtcaattcggaggagtatctgaaggcgggatgcccccgagacatgctcctctgatgggaatggcactccctttgctcttccgatgagattggcactccttttgccattgccaattgatcctttttttaatcatttttcggtcgttttttctctgatttgccctttaattctgtaaataaagtgacatgacgagaaagaattgaaaacacaaagagaaagtgcgacaaataaatctcatcagcagcagcggtgtttcctaatttattcgtattggcaaaacaacgaaagcataacgcaatttagccgacttaacgactcacttcagcagaagcaggccgaggggcggagtcaacttccgattggcttattacgcgcgatgattgaattgcagtcagtcacgcgaatgcttataaagtggcggggagggagagggaaggaagggtcccggagggggggggggg

SEQ ID NO: 27973 - DNA, 996 bp, Heterodera glycines
cttcccttttctcttccctttcatcctcctctttctctcctctttcatcttctcttttttcttcccttccatcctccgttttcttcacctccctccgtttctgctcgaccttctcccatttggattcctcacaaggcaatgcccgcatggttaacgtttcccccaaggccttctccccacaacgaattgctctcgcccgtgccataattaaagtgttatttccgactaattaaaaggacttttttttataaatgcccattaatttcagttccccccgggcgttctccccgcactcatcgcccattcgccaaagggcgatttcttctcagtttcccgggtcgctggcattttggccgccaaaaaaacgcaccatttaattccgctttgtcaccccattatcatttcgcatgtcaaagtctcatttcacactgatcaagtaccaaaacagcagtgttaagtgatcagcgttcttttacattaagacaaatgatcaaatttcggttttctgtcgagtgaatgcaacgaattcccaaacgggcgttgagatggaagcgatggtaagtcaaatggaccaaaacaaacacacattgattaccgatacatgaatttgtcaaaggttgggtgttcggtggcggcactttgcctctacgacatggccaaatcggcaagtttacacacacggctggaatcggtggaattagtgggaaagcgaggaggacgaagagactttggaagggtggacgaagaagaatggaaggaggagaaggaagagaaaggagaagatgaggaagaatagcagagaaaaagaaacagaggaaatggagtgacagagaaagagagacgagaaagacaacggaggaagaaggcagagaagaaaagtgataaggaaagaagaaaggggccatgatcattgcatgtcttatcactggatttgctgatcatttgttctgcaatgaaataaaggaagggcgggggcactgatcaaagggttcagcc

SEQ ID NO: 27974 - DNA, 620 bp, Heterodera glycines
  misc_feature (7)..(8): n is a, c, g, or t
  misc_feature (16)..(17): n is a, c, g, or t
  misc_feature (502)..(502): n is a, c, g, or t
  misc_feature (520)..(520): n is a, c, g, or t
  misc_feature (526)..(526): n is a, c, g, or t
  misc_feature (545)..(545): n is a, c, g, or t
  misc_feature (550)..(551): n is a, c, g, or t
  misc_feature (553)..(558): n is a, c, g, or t
  misc_feature (561)..(561): n is a, c, g, or t
  misc_feature (564)..(565): n is a, c, g, or t
cctgcannggtctgtnntggctgggaacgcataaaaccgaccagaaccttattttttgagcgtctggtaaaaaattatgttaaaatcctaagtaaaaaaaattgaaaaatagatagaatttaggacgaagtgcgaaaaaatcaattgtccatagaaattagccttttggggctgtgggaggagggacatctgcccaattaaacccttcatttctttaaatctcatcctaccacttctccctccgtaattgccaattgatgggcttccaaatgttcactgtcgttaagtgcaggtacaaagtcgaaaacacaaacggcaaaggaatggggagggaattgcgagggacacatgccgttgtgcgttggatttggcaagtgcggttgttgcgtttcaactggtgcagataccgcttggcgttgaggtgtggtgtcaagttgtcggctgctagtcactggtggtgttggaggaaatagaatcggctgtatggtcgcggtggtcgcgntctccgccagggaggagncgttgnaaatggcttctaagggggnccccnncnnnnnnaanccnncatcaggccctttatggttggtggcacggggggagacggagatgaaagtcgtcca

SEQ ID NO: 27975 - DNA, 1700 bp, Heterodera glycines
  misc_feature (1642)..(1642): n is a, c, g, or t
  misc_feature (1673)..(1673): n is a, c, g, or t
gcccattgagttcatttttagtttcggagaaagtttggcaaatcatttggattgggcaaatgttatatcatcaatggttaggtcaacaagttgtccattagcattttccttctgaattgaaactcggtgagcaaatagcacttggaaaggtcaatgtagttttggcttgagtggagtttgaagtggtatggtgtgtcggtcaaagggttgctaggcagcagctcaaacactttcaacgttggccggaggagttttgaaataaatttttggtggatcgagcgtgtgaatcaaacgcgacgggtcaatttgagctgctgacgtcggcgggggtggtgacaccgcagcagctggaaaacgaggtggagcgcctggaggcggagccaacggtttagttggctgttgaggaggtttgatgacttgagttgctgccggactttttagctgtgctggaggcgcagtaattgttggttttacaggcgatgttggctttacggttatgtctttttcttcatcatagtgtggtggagattcttccggaggagatggcggcgatttagatttagcggaaagcgaaactggaggtggcggtttaacagtagaaatgggtgctttcggagacagtgccgaactctttagttgcgctggcggtgccggaattgttggcttagcagatgggctctttacctcagttgttgtctttggtggtggagggaccggtgttgtggtcggggtagggacggttactggtgtctttgtcggttgaggggtggttgttggttgtacggctggtggagggaccggtgttgttgtttgtacggatggtggagggaccggtgttgttggttgtacggctggtggagggaccggtgttgttggttttgtggttgtaggaggggtggttactggtggctttgcaattgtgggaggcgctggtgttgtgacagatggaggaggagctgacggttttacagttgttggtttagcagggcttgagacaggcggtggtgtcgacacttttggcgtcgttttcagtttcttttggtgtttcttcataatggggcggtgactcctcaatcaccccttcatcatttccatcgtacaatgggggagagtcctcaatcaggacctcatcatttccatcgtacaatgggggagagtcttcgatttttccactctcgtctggtggtggaggtggtgtcggtgacgcatcccttttgtttctctttagtggtggcggagagtgaaggggtttagtccgatttcgatcctcttccacctcacgtgggagtggtaacagctttgctccgctacggttccgcaatgtgactgccaaaaagtctctgagctggtcaaccctgttaaccgatgccttgggcaccggcactcggattactcgctgtcggtcctcatcgatagtgcttcggtctgtgaaatgaatgtcaatccactgctcatccaatgtaccgatggtggaccacgaataggggtaactgatactgtgcagtccacacacccacgagccgttaaaatgcaaaggctttgggagtcggacacgaaatttgttgggctgattgtccgggtaatccgttacattgctgggcaaaacacaaagaaactgtttgacatgcttgtttattatcancacaaaatgaaaaatgcacatgcttttatancagctgagactcattaatccattcccg

SEQ ID NO: 27976 - DNA, 1099 bp, Heterodera glycines
aaactattacccaaaagccaatacaaaaaggcacacaaacgaaacaaaaattaccaaagtgacaattgtcaaattatggtgtataatggcacaggcacaaaggatttaatatttgatatttttaaatgttaattttaaaaaataattttttctcattaagaattttaataaatttttaacatgcaaaaaagtttttcaaaattgtgtatttttgaattttctttgaaaatttaagctaaaaatactattttcttgattcatattaggctggaataaaaaactatggaaattcatacaaatccggtctctactcatagacaactgaaagcacataaattccaaattatttaaaaattgaagcaaaattcactaaaacaattgttaaaaagccacaaaaaccaaataaaatgtgttgtgtacattcattacattattcactcattgacaatcaaaagttacttttaactttggcgaaatgttctcagccaaacggccgaattcgactgaatttaaaaattcaataattttaaattaaaaatttgccgatgggtcaaactcaaaattagagtgccacgggaccgggaattttgggcaaaaccgggaccgggacttgccgggacctgagaagccgggaccgggacctcgatttttcttcgggaccgggactaacagggaaattttaaaaattcaaaaaaatttttaaaatttttaaaaaattcaaattttaattattttttaaagtgaaaataatataaaattatttttttattttatttttattttataaaacccaaaagttaaagctaattaaattaatgaaaattttgaaatcaaattttcttcaattatttgaaacaattaatcatttttggactaaatgatcgaatattatatgaaattcagatttatttttcacatcactttttttcggcgcgctttttccaaaaaacttctttttgggaagaagggggtccggcggtgccgataggcgccgccgggggaaattttgaaaatttggatgtgatttgttaacagatttacaccaaaaaaggcaggtttttgggatttattaagctccatttgtatggattttcttcaa

SEQ ID NO: 27977 - DNA, 1340 bp, Heterodera glycines
  misc_feature (35)..(35): n is a, c, g, or t
  misc_feature (1272)..(1272): n is a, c, g, or t
  misc_feature (1300)..(1300): n is a, c, g, or t
  misc_feature (1330)..(1330): n is a, c, g, or t
taaaatggaaaatgaaggacagctcagtcccgcgngaatagcaaatgctaatcgaacatgcgcaaattgtgcaacgcaattcgcacagcccttacagcaaattcgccgtcggcgctgccattttgaacaacgacggacagattttcagaggaggcaaagcaaaagcggacggacgcttttcacttgaattgtcccttcccattcagcaaatgtggaaaatgcttcttacggggcgacaatttgtgccgaaaggagcggtaaaataaaaaaataaattttaaaaattgtttattttcaaatgccaactttttcagcaatttgttccgcaattgccgcaattgggcccaccaaattttgcccaaaagcaatttgtgtagtcagtgagtcacgagaaattgagaagataatgaaaaaataatgaaagtttagccgatttgactgaacccggcgcaccgtgcggcatttgtcgtcaaactttggtcgaattcggtgacatggcggtgggttaattttataaacattctcaaagtgttcatccattagcaatacatggagaaagaatattcattcatttcacactaaacacattgaccaatttaatttcttttccattttcttttcggcaacgaattatttggtcgtttgataacattttaattattattattctttgaaaatgataattacttttggttggcgaataaatttcaagtcattaaccaaatgggtcacatttatttatacgtttgaatttggtttatcagcagaaaagagaagagattgctgaaaattaattacccctattaattgtggttatttatttatttatctttgtcaatttgtcttccattattaaatcgtccttttgctcccccccccccctctaattaaggttcttttctcccaattaaggtccttctctattcgcgtcccagcaaaaaattgttaaaaacgcgcgtccaaaatctgatcccaatggcattcactcccaacgcattgaacactttcaaaagtgacgcatcgatgagcaattaaccgaatgaatggacgcgcatttgaacagtgattgatcaaaccaattagagagttaatgatttaattcaatttaatttaaaagcaccaatccaatccccgaaatgcactaaaagcaattgtttaaattagagcatgaaaatgtttgttaaaaattcactaatttttagccatttaatttttgggttttaaattgtatatttctttttccaataatatgcataaatatccttttgtttngtttgggtattatccctgctttaattgngctcaacttttacttctcatgatggcattntctatggcat

SEQ ID NO: 27978 - DNA, 830 bp, Heterodera glycines
tttcaggaggcatttgaatcgtttgagcgcgttaacatctttaagaatttgttcaaatcaatgcgtacgcccgccgtgctcttcgcttcgatgattgccctttactgctgttcgttttgcttttcctgagccgctgtttatgtccaaaattatttcccaccaattaatcagatatttaatatatatttttaaaggtgcgggtcggacccctcccccctcgctcgcaaagggggccagccagcgaggggggggccggtgtaaaagagggggaggaggggactcgcagcgagggggtgtcacaaattttaaatttttttaacaaattctttaaaaagtccaaaaaaattttccctctgtaccccaaaatcccattaaaaaatcggcggccgacaccctctttttaatgtatgattatatttctgaaaccgtataaccagaaaagatttcgaatgaggcaagtcgtcgcctttttttttgctcttcacctgtaaaaaattcagtgctattttaattttaggtttccccccccccatgattaagggcctgaattcggtgaaatgctcatttttcaggccaggaattttttcaactgcttggcctcgacaccatggcctccattttctccctcttcctcacactgattattgtcgcgcttggcatttggacatattcacgctacagcggccaattccgccatgcccaagtgttcatcgacgagcgggtgcacttgctgtggcacaatatattggtgccggcttttgtgaacaccgctggtggcgtggcactgaacatgacggtgattagccagatattttgatttgatggttttt

SEQ ID NO: 27979 - DNA, 1264 bp, Heterodera glycines
  misc_feature (1058)..(1058): n is a, c, g, or t
  misc_feature (1125)..(1125): n is a, c, g, or t
agagagaggaaacaaaacagaaatcacatttgttgagaaggagagaaatgagcggagatagcaaatgaattgtaaaagatatgcacgggcgaatgacgtcatcgcgagtggggcagagaaagttcagtcggtcgacacattgatcatcatgatcactttcgcctgccactgagcgcgacgggtttgggcaacgcttggagcaactgggggttcgacatcatcacctgagcgggggagggatcattaagtcgaagaggaggaattcatttacaactcggatttgggggctccaccgtgaaaatcttttcaaattacgaaccaattttttaacatatttcatctaaaactgcaaacttctgagtcaaatttctaatggagatttagatctgaaagcacacctgaaaaatttttgaatttaaagccgggggcgttgcggggaggcgggcagtggtctgaaagtcgaacaattttagaaaaatgaattttggatttgctaaatccactcacagcattgccttcttatggaggtttatactccacttccatggtgaggaggggacggggcgggggtggcccggttgttgtcgtcgctcttcacccccttctttcgcttcctttcctctttcttcgctgctgctgcgtcgttgcccttttccttcttctccaattgctcctccttcttctccaatttctcttccttcttctccaattgctcctccttcttctccaatttctcttccttcttctccaattgctcctcctttttctccaattcctccttcttgtccaatgccttccagcaatactaaaaggggacggagtttttatgaagtgtaattttaaaaagaaacccatttcttaggggttatttctgaaaatttgagtgcaatttgttaacagattttcactaaaaatgaccaaattttgtgattactagccgacttcacgaagtcactctctcttaccccttcgtctccaacttttccccacattttatcccaacaaatacgaagtccccccccctccccttttcgggccctcatacgaacaaattcagngggggggggcggggcgggggggggggggggtcggcccctccccctattgcataatatggggggtggngcttgaagtcaaaaaattgggattttagggttgtattttccttttttctatcgatcttacatccacattaataacatacgcatatccgacgaatccgcccgcgccctgctcagggtccatacgaatgacggacacctgc

SEQ ID NO: 27980 - DNA, 1276 bp, Heterodera glycines
ctagggttgagcggtaaccggtaattgtaaaaaaaccggtaccggtaattttcgggttgaaaaaccggtactttttggctgggaaaaccggtaaaaaaccggtactagtaccggtaccgctcaaccctagttgggcctttcttgatcttttttggttatgtgcctggttataattattattgtttattgcttgttgttgttgagcccattttgtgtgctaattgggtgtttaattatcaccggcatttatgtgtcagccgttcaaattacgcatttttaaagattttgtttacaaattcattttatttctatatacttattatttgttacatgcaaaaataaattttggggttcaatgccgacaaattcaatgtagataatgtcaatttgttgattcttttttaaagtgagctcacttatttccatttttaaaaatgttcgtcaactcacccaaaaaatgacatttcgccaactaatttcgtgcttatctgtgcgtattaagtagggttgagcggtaaccggtaattgtaaaaaaaccggtaccggtaattttcgggttgaaaaaccggtactttttggctgggaaaaccggtaaaaaaccggtactagtaccggtaccgctcaaaaccggtactcggttctcagttgtaccgtttttttcagtaccagtaccggtaccgctcaacccctaatttgaaggcccgggccttcgattgttcaacccctccaaaaaggggcctttaattggagaggggccttcttccagatgggtcttgtacatatatattattcaacccctcaaatttggaattttatgggacaaaaggtgttaaaaatatttttctttgcaattttatcaaactacttttcgagtgaaggatgtaaagcacttataataaacgagcctcatctacaaaaatatatgaaaacatatctctatatttttcacgtacagattgattctcttcaaaaagtttagctgtatatataataagatcattaaagtctagagcattattttttttagatactcttgatatttgttatatatttcctcatatttttttatattattaaaattttttatctttttatttttaatattattaataattcctactatttcttttatcttcttatttttattaaaatatttataattaggaaactcaaacattttattttcttcgtcattttcatcagaaaatactattttacttattataaaattttgatcttgttgatcatatactaaaaattttcctaaataataaaa

SEQ ID NO: 27981 - DNA, 1290 bp, Heterodera glycines
cgagggaaatgcctttacggacagcagcgaagtgatgttgacgatgaacaaacggaccgactgaaaattggaaaattcgaaatacaaagacaaagaatgttacaataaaattagacaaaaagcacctctgcattgtttaaggccgcataaactccgttgttcaataaaatcgctgacaccaaattggcctgcaaaaactcgtgccattgcgcctcgtcgcttagttcggatgattttttggccatttcaccgacagtcccggcgttgtggaagagcaaacagaggtcaaacggaacggtttctgaattggtaaaagcggaataagcgcatggaataacttttgtccaatgactacctctccacgcctttattcggctgttaatgctgcccaacgcaaagggttgtgttgccaagtccgcaaaaacgagttcaacaacagccgaggggtttctgcagaaaaactatattgaaaatataataggcggttgagcccaagcaatcttaagcctaaagcaaaggcttagtctaggcctttgtataagttgtaaatgacaccgaactccttgcgaatttgatccccaaccgcctcaagcgcttcttttccgcgagccaaaagaacgaaaaaacattcattcgtcgcaaaaaacttggccatttgaagggccaattctcgtccaatcccacggcttgctcccgtcacaacaataagcacttttttagcatccaatttagcaaatgaagacatccattaaaaaagaaaaaaacatttgcaatcaccaaatcacgaaatacaaaagcagcgtcaggacaaacttttgaataaaattaaaatgtttctttccaccatttatactttggcaattatgcaagacaaaacaaagagaacatgttttaaatgaaaggttaaagctgatagcaactggccacaaaatgacggtttatcgggaaagtatcacaggcacagataaagcattccaaatacttacctaaatagggttaaaaacaaaatgaactttatgaagaaactgccttgtattgcagtttaatgtccaatcgaattctacgagttcagactttttcttactttgccaaatcgtacatttttggtatcaatcgaaagtttgcaaccaaaacctgcgcttacaaaaacaaatcaaacatttatcttgaatatactcgaaaaaacagctaaatttcggattttctattgtaaatcttttcaatatttgcttttttcttttacgcataaattgctgagactttaaaccttcaactgatacaaaaagtgta

SEQ ID NO: 27982 - DNA, 1233 bp, Heterodera glycines
gggttaatcatttcagggaatcgcaaattgagccgaaaagaatgggatttgcaccgaatcaaacggactaatctttcgcaatttgtacataaattggcgagattaagaaagaaaaaaaatgtgtacaacaaagtcgctggcgctgttttgtgtgtacggcttgaagaagttggctcgttgtgttgcttgccgctaatgaggaggataaacaaaagtggttgggggtaattaggggattgatgtaattaatctgttgtgggaagaacaaaaagagtgatcagtaagaccgttgtaggaaaaaataattgatccatttatgactaatcaattgctagtaacggtttaattaccaaattccatttttgaaatttgtcggaaaaataaaacgaaaaaattatcattgttccgtcgtaaatctggcaaatccccatgttcgacggatggtcggcaccagaaaatgatgatgatgattatgatggtagtagtgttggtgggattagttgaaaacaaatttgtcgacttttaccaattcaaatgttaaaaacggcgattgtcaacagtactctgcgacctgtctttacttaatcgccataaaataacaacaaaaacataacaaaatatatcgagtctcttacaaaaagacaaaacgccaaagaaaaattataataacgaatccgtgtcatgtcgaacgtctcgccacaaacgccacatctccaccagacttcttccgctcgttgtcagcgcgtgaaccattcgccagcgactgtttccaggatcggcagcagttcattgtacagtgtgtgctgctctcggacgtacggtggtggcaaccatacaaaatggacatgtttgaattgagctcaataaaaaattgtccatttctcagtagaagctatattaaaatagaaatttccgtttcaaaaaatttcgttacataaaattttttttgaaactttgtctaaaattttgtaaaatttcaacgtaaaatttaaagaaaattatgacaattttttgtctctactttagaaaaaaacagcatcacagcaaaaaaaaaaaaactggggtctttggattttgatgcctaaaaaatttaagaaatcgggtcggatttccgggttttctctacatccacggctggaccgaaccatacgaggtcacagtccgtgttcggcacaatacgtccgaacgtgagcacattgggcacacattcttccgccaactgtacccaactca

SEQ ID NO: 27983 - DNA, 199 bp, Heterodera glycines
agacaaaatctgtgtaatttatgccaaaaggaattgaattgaggcgatacattgactaaaggaatgtggagccatcacatcattcataaaaaattaattttttgtaaaatttttggagttaattcaaatcaaacccccgcccccgcccccgcgggggcggaattatcgtgcccccgtccccgcccccgcgactctgacc

SEQ ID NO: 27984 - DNA, 1662 bp, Heterodera glycines
  misc_feature (1513)..(1513): n is a, c, g, or t
  misc_feature (1593)..(1593): n is a, c, g, or t
agtgattaaaagaggaagaacagtgattacaattaggtacaactgtgattagaagaggtacaactgtaattaaaagaggtacaatagtgattaaaagaggaagaacagtgattaaaagaggtacaatagtgattaaaagaggaagaacagtgattagaagaggtacaaaagtgatgagaacaggtacaacagtgatgagaagaggtacaacagtgtgagaagaggtacaacagtgattaaaagaggcacaacagtgattaaaagaggtacaatagtgattaaaagaggaagaacagtgattagaagaggtacaactgtgattaaaagaggtacaatagtgattaaaagaggaagaacagtgattagaagaggtacatctctgattaaaagaggtacaatagtgattaaaagaggaagaacagtgattagaagaggtacaactgtgattaaaagaggtacaatagtgattaaaagaggaagaacagtgattagaagaggtacatctgtgattaaaagaggtacaatagtgattaaaagaggaagaacagtgattagaagaggtacaactgtgattaaaagaggaagaacagtgattaaagaggtacaaaagtgatgagaagaggcacaacagtgattataagaggaagaacagtgattagaagaggtacaaatgtgatttgaagaggtacaatggtgataaaagatacaatagtgatgagaagaggtacaaatgtgatttaaagaggtacaacatggtttaaaattaaataaataatgaaaagtttttataaaaatcgattgcattttaatttaaaatttttttataataaaatactctttttattcattaaatataattttgaaaattaataattgaatatttattttgaaatgaaattcattttttataaattcaaaaaataaataatgaaattaaataaattaattaaataatttataaaaatcttgaaattaattaaaacattaaaaataacccaaaaatacaaagaaaaataatgtacaccgtccggactcgaacttcgccccccccccaaaaaaatgatgcctcagaatccccaatcacacagggattctgaggtcttgacgatgtcaaaagtaaaatctgatcacgtattcgtgatcagcggcccaaataacgcctaaagacatgtttttggaagatttttggtgaaaaaatttctcaactcaaaaatcatgtgctcccccctatggtcccgaaaccaaaaatcacttttatttttataacaattcgcaaaaaagagataaaaatgtaaaaaaaaatttatattatagagaaaaaaattgcggatttttgtagtattttatatttccagaatatctttttagaaccgagttatgaatttttttctgaaaaatcgaaaatttccagaaattctggaataactttttttcttttgaacattataaaaccaaataaacctcataaaattctcccgattttttgctatttttaaagctttaattcacttanatagagcagtccttcattgagttatgaattttcaaattttaaacccaatttccaaggaccaaaaaattgcaaaaaaatanagaatttttaaatattccaaaaatctgaaactttaaataacatcatatttgtgctcaggaccctaatta

SEQ ID NO: 27985 - DNA, 1755 bp, Heterodera glycines
  misc_feature (1670)..(1670): n is a, c, g, or t
ttgcaaaaccgaaatttgtgggattcaccgccggcgagtgacggattttacggacggatgagaaacggcgaaatggccaaggaaaagccgaaggaaatcgaacaaaacaagacgagaaacatagagaagagcataaaagaaagaccattagtaaggggcaaaccgatggaagggacagagaatggagaggaagggacaaaagagcacatggaagagagaaaaacggaggagagaatgtgagggaagacgaacagacgaaagactgcggaacgactgatccaatcttatatttccaattttgctttcttgattcaaagtatcaaatatgtattcagaccaattactaagaaattgtgtcgtgttgaatgaggaccgcagccgggggaatccccggtcaaaccgggggacgggaagccccgtacggggacaccgtgatgaaacaatttgaattatttactaaagaaagtaggaatttctctttgattgcacatttttaaatttatgttagggttattttccctttttcttctaattgtaagttcgataaatagatttatttattttattatataatataataacttttatttaaaagggtaaaaagaggcgataaaatgtttgtttagaaagaatgaaagggtgtgaatagacccgcgagacaaagcttattgttagagaagggtcgtaaatccaatcttaaaggcaaaaacaaattaaacaaaatcgaatggaaaattgttgttaatgatgagaaagaccccggtggaaaattaaaggaaaaattaacggaatacaaaaaaataatggaaagagtgagaaacacaaaagtaaatgttacatgtgatgaggacgagcaaaattagaatatgaaagattcaacgtgtgggacgaagacgccgctaacatcgtatgaaataaaatggcaaacgaaagatccaagggaaagggaacgaatgaaaccgaagcggacgaagaaacgatgaatgacgacggcgtcatccaaccgacgaaacaacgcccacctgttgctgcaattgaacgaccctttctttcttctgtccgttggcatccgtttcacgatcagagttaatggcggagctaagcgaaatggcggccaaattgctgcacaaattggaaacggaagacccctcgagattaagatcagagatgttgagcaaagaagtaaatggaggctgtcctaaagtcagccattgtaccaaagtagcaaagaaaagcccaccgtgttttctgagcacttccataaaattgtaattccgcggatcgacgcgttgagttagccaccaatggcgcttgatttcgctaatagtcgcgcgtaattttgggcccggctgaagcagccaacttaagacctgtggagggaaaagcggatgcaaaaacagtgttcagtcttcacttacctggtacaatccctcagaaatttcccagggaagttcgatttcggcatccacaatttcgtgagaggaacgaaagggattctcgaagaagacgagggtgtacagcaaaatgcctacggaccacatctcaacctcgggccccaagtatttgttcccactgagcactgaattcgaatactttgggtgagcagaagcatttcatcggattgggcaccttcgggtgagcagtattccatggtgccgtagaaatacganaagactattccttctccgaaaaaggcagccgaaaccaagtcaatgagtttgcacccgaaagtctggtcaatgattacattttcat

SEQ ID NO: 27986 - DNA, 1851 bp, Heterodera glycines
caaaatttgaatttttagcgaagaaaatgccgaaaaatactatttagatcggtgaaaaggcacggaaagatgaaattgttcgtacttaggaagaattacttttttatgcctattttaggtattgatgattatgtgatctaaatgttggactttgccatttacgtgtaacatatatttgatttttacacatgaattcataaaaaaagattggcatttagctgaactatgtacatatagtcaatcccccccccccccaaaaaaaaaagaaaaaatatcacaaattatacaccattgatttgtctcaaggagttaagcactaaaaaaagggtctccagtagcgggaatgggtttaaacagttttaagttggttaaaacttcgaaaatggaaagaatttggcacataactttttaattttaatttatcagaccaaatgcgaaaaatctgaagtttcgactttttgttcgagatcggttttccaagccattcccccatctgtttgtgcatcgctcaattaccacgaattaaatggcaatgcgacgaattgcgccgagaattaggccaattagagggatcatttgccctgcgggtacagtgtgatgggcacgggtatggtaaagtgatgtcaattgggctcaaagaggcgaatttcttcaattaattggatggaccgaatgaccaaaacggcaaattgagggccaaacgaaatggcttttcagctgtgaagcggacaaattcctccaaaagaagaaaaaaagtctcaaaaaaattttttggataatattcaatttttataaaataaaatatattatttctttttattcagcagatgaatccatcccttcggcattctttcagcatcgaaaacattttaacaaaaggcgtaaattttggggccttttctgagtaagtccgaaatgaaattgtttacaaaattttttcttaggcaagaatttgccaacaaatctctccaacgattttcgccatcttttccattctcgtgagatttgtttaaaaattattatgaaaattggctaaaatattaaggccattgcttccgcaccatttcctcggccgctgttttgacaaagtgccaacatttgtcttagaaccgccgccaaaagcatttccaactgaatttagcagcgcattttttgagcggaataatggagaacgaaaaggtgttagaagttagaacactcaaataccgtaacataaatgcaaaaatcccacggtaaacccgtaaaatacggtaaagcacagtaatcgtaaggaagaagctgactgctgggcgcttaaaatgctgaaagcgataagatccataaaaagaaagagcggatgtgcctcgatagctcaatggtagagctgcccatgagtgggtggacgagtgggttctattcccacccgatgcctaacattttgccattccttatttaatatatcacctaaagaaatgtaaaatattaatagaaaagtacatttaaattttaatcgatgcgtctctctttttgattcgtaattttagtcgaatttgaaataaaaatatttaattttttactttttttaggcatttcgttgtgctccttttttttggttttctttgtttttttagttgacaggctactttaaaattaattatttttcttgagaaaataatttttttattattatttttttaattatttttttaaattttttttaaaatttttttttaaaaatataaaaggaaaagaaaaaagaaaaaaaagataaactaaaaattaaaaaatcaagaaaaataattaattttaaagtaaaacactcctcggcaatttaatggaaaaactgaatgaattaattggtcatcttaacaa

SEQ ID NO: 27987 - DNA, 1003 bp, Heterodera glycines
ttaggcagtgagcttatctcacactcgaagaagcgcaaattgaggaggcgaattgaggatggccaaaatgagcaggcgcaaaattgaagcgcaaacagatgaagtgccaattgaggaggcgcgttgagaaggtgcaaaagaggtggcacaatttgaaaagacgcatgaggaggcgcaaaatgaagaggagcaaattgaaaaagccaaatttgaagaggcgcaaattgacgaagcacaatttgaagaagcacaatctggggcccattatgaagtcaaaggccaagggcgctggggcccattgtgaagtcaaaggccatgggcgctggggcccatcatgaagtcaaaggccaagggcgctggggcccatcatgaagtcaaaggccaagggcgctgggcccatcatgaagtcaaaggccaagggcgctggggcccattgtgaagtcaaaggccatgggcgctggggcccatcgtgaagtcaatggccaagggcgctggggcccatcatgaagtcaaaggccatgggcgcttgggcccatcgtgaagtcaaaggccaagggcgctgggcccatcatgaagtcaaaggccaagggcgctggggcccatcatgaagtcaaaggccaagggcgctggggcccatcgtgaagtcaatggccaagggcgctggggcccatcatgaagtcaaaggccatgggcgctggggcccatcgtgaagtcaacggccaagggcgctggggcccatcatgaagtcaaaggccatgggcgcttgggcccatcgtgaagtcaaaggccaagggcgctgggcccatcatgaagtcaatggccaagggcgctggggcccatcatgaagtcaaaggccaagggcgctggggcccattgtgaagtcaaaggccatgggcgctggggcccatcgtgaagtcaaaggccaagggcgctggggcccatcatgaagtcaaaggccaagggcgctggggcccatcatgaagtcaaaggccaagggcgctgg

SEQ ID NO: 27988 - DNA, 681 bp, Heterodera glycines
  misc_feature (598)..(598): n is a, c, g, or t
agcgaagtttggaaaggtcgcggctcccccaacaaaatgaagtggtcaatttgccattttcccctctcattttgcctttccacagaatccttccgttgggcggcactttggcatggctcggcgacttcaaacagccgcactttcaagcgggagtcaaagcgattaaaaagggtcggcaaaaatggggggaaaagccggataattggccacttaattattccctttcagtgtatggcgtagagccggactttaccaggtaaagcgagaaattgaagcggcaaaacaaacaaaatgatcatttctaagggagggcggctccatcccagtgactctgaccttccaaaacctaacgggaaagagtgtgatgcttttgccgatgggcgcttcggacgacatggcacattcgcaggtcaaaaaggaggaaggatgggagaaatcaaaggaaaatgaatatttagaacgagaaactgaacgtgaccaactacgtgaacggcatgaagatgttcgcggcctacattttcgagtgcgccaaaatatgaactggcagaaattatttatcactcatagacattccatttattttccattccatcgactntctaacttctaattacttttaaaaccctttgttaacttcgaaaatatatcactttctcacttaattcctttgtgtgtaactta

SEQ ID NO: 27989 - DNA, 1696 bp, Heterodera glycines
ggtcgataacatcaattcaaaaattggtcctgctttagtcggacaaaactttgccgtaatgcagcaaaaccaaattgacaaatttctcatcgacttggatggcactgacaacaaagggaaacttggtgcaaatgccattttgggaggtaccttttgttttatccgtgttgtgcttataattgaaaaaatgttatttggtcaaaatactaaatgtgcatgaaaaggatttgatgagattatccgtcagtgaattattaattgaacctaaattttgatggtcttgattagaacaaaaaccactcagaaatttgctttctttttaaaaaacatctattccatctataaaaatcctcatttctcttcattggttattgcttttccattaagtctcgttggcggtgtgcaaagctggcgctgtgcacaaaggccttcccttatacaaacacatcgctgagttggctggaacgcggaaggttagcgtaaacgaccggtacacaatgtgccttacaattaattatcactgcatctttaggtgattttgcctgtgccggctttcaacatgattaacggtggatcgcatgctggcaacaaattggccatgcaggagtttatggtgctgcccactggagcgaaaacattcaaagaggccatgcaaattgggtccgaaatttaccaccatttgaagaaggcatgcattttaatattgttgagtgactctaagacaatgtctattttaggtcatcaaagaacgctatggattggatgcaacttcagtcggagatgagggaggatttgcaccgaacatccaaaacaacagagagggattggatctgctcaaagaagcgttcgccgcatctggacaccaggacaaggttaatacactttttgaagtatacaatttatcctttaaggtcattattggtatggatgttgcggcaagcgaattctataaagagggaaaatatgacttggacttcaaaaagtggaactgtttttttttttgcgttgtaaaattcattttaagtccaaacaccgataaagcgcagtggttgaccggagaacagctcgccgatatgtacaagtccttcatcaacgactatcccgttgtgtccattgaagatgccttcgaccaagacgactgggaaaattggagcaagttgcaggctgccatagacattcaacttgtcggcgacgatttgacagtcaccaacccgaaacggattcagaaggcggtgcagaaaaaggcatgcaactgcttgttgcttaaggttagtctgaagtcatttaacttaatttgacaaaatattggttgaggtcaaccaaattggcacggtcactgagtcaatcgaagcttcaaaactggcacgaaaaagcggatggggagttatggtgagagggtggggatattacaccaatggaatgaaatatcactttaggtttctcaccgttctggcgaaacggaagacaccttcattgctgatttggttgttggactcgccactggacaagtgagtgaacacattcattaaaaataatggtgttttctagatcaagactggcgcgccgtgccgttctgagcgtttggccaaatacaatcgtattatgcgcattgaggaggaattgggcactgacgctgtctacaccgggaaaaggttccgaaaaccgcaaaactaagagcgtgagcaaacgaagaaaa

SEQ ID NO: 27990 - DNA, 683 bp, Heterodera glycines
  misc_feature (659)..(659): n is a, c, g, or t
atcatcatcattttctggtgccgaccatccgaacatggggatttgacagatttacgacggaacaatgatacaaaattctttttcttttttttttgtctgttcgtcggtcgacaaaaaaatgtgccgattgatggatgtgactcaactccttttttttataatcggtattaattttttaacatttacatatacattttgcacattcataaatcgcgacggatgaacaaaaaatgccgaaatttttggaaacaaatttgttgtcttgttgataataatccatattaacaactgtaattaataagcggatctaaggaaaatgtgacttcttttgcaacattaacataaatttagtttgtccacatataaatggtgcttaaacagatttgataaacttttttggcattttgttgttaaaagcattgtttttgcagttttgacgcaaaaatttcccataattgattaaaattttttcttttctcacattggattatataaattccgtgaatcccacctcttcacgccccactcatttagacttttttccaagtcaaaatatttttctaaatttatgataattaaaaaatgcaatttggtaattaaaccctatcactagcaattgatcagtcataactgatcactttttgtgcattctgcctcanttaatttatatttcacaaatctac

SEQ ID NO: 27991 - DNA, 1339 bp, Heterodera glycines
  misc_feature (1163)..(1163): n is a, c, g, or t
  misc_feature (1169)..(1169): n is a, c, g, or t
aacaaaatttaaaaaacgggcgcgaagcgcccgttcgaggccgcgaagcggcctaaagatcgctgataattttttaaaattcccaattttttcacaacccatagcttatctaggtagcgaagctcccaaagcgcgaagcgctttttcttaaattaatattttttattaaataaatgttttaaattaaaattagttattttttaattatacaatttcatgaattttttaaattgatttatcaaaaaattaataaatttaatttaaataaatattcaattattatacacttccaagttctttttaaattaataattatctaatcactgttgtacctcttttaatcacttttgtacctcttctaatcactgttgtacctctcataatcacttttatacctcttctaatcatttttgtacctcttctgataaccaaaatttaaaaacgggcgcgaagcgcccgtatgagtccaacaaaatttcaaaaacgggcccgaagcacccgtccattccaaaccatatttaaaaacgggcgcgtagcgcccgtccaagctcaacaaactttggaaaagggcgccaagcggccgaaaaggtccaacaaaattttaaaaacgggcgcgaagcgcccgtctgaggccgcgaagcggccgaaaatgcacatcaaaatttaaaaacgggcgagaagcgcccgtatgagctcaacaatttaaaaaacgggcgcgaagcgcccgtctgaggccgcgaagcggccttaaaaccccttaagattttaaaataaattccaaatctctaaaaaaactcaatgcttatctaggtagcgaagctcaagaagcgcgaagcgctttatcccagctaaatagccgacggttcacgcacccgctagttaattaatatatacgttatattggcaaggagtttcgttgctaaaaccattttctcccggccgaaggccgggagcgccctgaaagtggtggaagggtcttacaactttttgaggcgcatccgggaaaaatataggttttccggtccaagggccaactgagtaccagggactgaattctcacttttgtttgcatttgaaggcccctaactttttttgtaaaactcgaatcaaaaagtgcccgctgtgagggcactccgccaaagtgtcctctaaatgctggtatnttttanaattttttttgagcaaacccctgggctgcaaaaaatggcaactgaagcgtgctcaaaagtacacttcagtaccaggtgaataccgcgccaggggttgatctgagcggggggtggcagcgaacttattgtagagctttgaagctcgattttttgaattaaaaatttcgaaa

SEQ ID NO: 27992 - DNA, 1033 bp, Heterodera glycines
ctttcgtttttatttattttttgcaaattaattcttaactattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaatcgatttttttgttttcggggcagtccccccgaacgatgcgccagatttatggggagacgaatcctt

SEQ ID NO: 27993 - DNA, 335 bp, Heterodera glycines
ggggagggaggatggccattcatgggacgcataattccgactagaaccttctttattttaacttgcaaaataatggccacacctactcaaattgaattatattttaatgttgcgttgagtttggtcaagaaagctggtaatgtaagtaccatattagtaaaatgtacaaaccatttttaaacggttttagcttgcgaagaatgcatatgctcagcctttgggtgtggtcaagacaaaaagctcacccaccgattttgttactgaaacggaccaggctgtggagaaacttttaatttctggactttctgaacgttttcccgaccacaagtcattaa

SEQ ID NO: 27994 - DNA, 2337 bp, Heterodera glycines
  misc_feature (2317)..(2317): n is a, c, g, or t
ttcttgatggtccccaacaccgcaaagaaggacgttcttcttcgactgttccagctcgaattgcaaaccgcgaagaagcgtgaccgtaagtacaccaacagactgtcgatttataattgaccaccgaagtcaaacggactgatttattattcgcggattcgttcttttttccagccgtcaatgggaaaatacgcaatacgatggtatttgtgaacaccaagcgagacgctgatgttgtttccacctacttgaaccaattcgactttaacaccaccacaattaatgggtgagtagtccgttctctttaattcagtcttcttccctctccctttaaagaaatcgtccgcaagaaatgcgtgaaaaggcattatccgattttcgtgccggcgtgtaccaggtcactaaaaaagcccaaccatttttcaaaaattcatcagattgtcgtcacaacggatgtttgcgcccgtggacacgacctcaaggatttggaccatgtcatcaatatggaccttcccgcgtctggagaagggattgacgacagtttcacgacgtatgtgcaccgaattggtcgtaccggtcgtttgcagcagggctcggctaccactttctttgacattcaagccgatgcgaccatggcggagggatttgtccaggcaattttagaaaacaattttcatgctttaatataattttcagagtcttcaagaagcgactcagccggtgccagactggctcaacaaattggttgctcgagagcccatcgctggttctggccaagtcactgacgaggagctgcttggcattttgtgaaacaaccctttgatcgttgcaatctttttcttttatcattattgcgatcatttggatttttattattatatgcttaccaatgattttgatcttctctcttttttatgtttacaaaatgtgcttggcgcgagataaattggagttcatatgtgcctgttttcttatgtttatttatattgttatcattcgaaagcactgagtttgaagaagttaatactaagaaattaagcaatacctattttaacatttaaataaagttactaaacgatagtaattgcaatacattattaatcatattttttgtcaattacctaaacgctgagattttgtataggtattaacttttctctagtctgtaaaattctccaacaaaattgccgaaaatttgcacttccttcgaaatttctgcaattgtatttccgtcgaccaaataaaactgtaaatcggcattccgttcctttgctttatggcctcttcagcaacctcttcctatggcaactttgagctgtcaacaaatttggctgaacttccgtatggtttatttgctcaattgtccagccaatttgaaaatgagtgcctttggcgattggttttcaccgatgacgaccagaacagcccattctaccttgggttcgttcgttgaatgttgttgcttttgctgttcttatgcatttattccgtcgcacataattctctccaaaaaattccgtcagaatttgaaatctgataaattgaacatatttatgcttaatgtttggtttggttgtcttcacatgcttttatgcgcttgaccatttttcagcttcaatgaggctgaccgttgcgcgaggatggccaattgtggcgcccatttgctgcgactgctcggcaatcggggccaaactgtcaagggtttgcagcattgaccacatcactgtgaggcggaaatgtgccaaaatttgaggatttctctcccggctccattcattggccaaagtccatggcactaaaatggacgtgcctcagctgatccttcgacgccgtttttgtacttttttaaaaattaaaattatcaatgacaaaatgccgcaatttttgttggccacaaatcttgcaattaaatcccgaattggctaatcgttttttgttttcggcaccgttcccctcttttgcaggttccgtgatttggtctcggccggaacaagtgttggtcagcgtcgagggggaggcgtccgatcggcttcgtctgcagtgtaaggccagcgctttccccaccccgcgctaccaatggttggaggagggaaaagcgatggacggggccaaccaatccttgttgaccattgtcaggtgaatgcacaaaaatagccgtttcttaccaattttggtccaaaaaggtgactttttaaagatttttgagccaaattttcgaaaataattggtaattttgtggtgcaggcaggcgccaactaaaaaagttgaaaattggcgaaatttatcctttcagtggagatttcctgaaatcttccanaatgcatttttaatgaccca

SEQ ID NO: 27995 - DNA, 1638 bp, Heterodera glycines
  misc_feature (1505)..(1505): n is a, c, g, or t
  misc_feature (1589)..(1590): n is a, c, g, or t
  misc_feature (1593)..(1593): n is a, c, g, or t
gctgacgggaattgcttttataattctttatcagttttgcttactggatctgagttgaaagaaaatgctaggattatacgacgcgcgattacagagtatattgaatcagaggtttagcttaacgaaatgggaattccatggcacggatggtgggaaatgtttcatcccggacaaacattatatgattcaagtgggaatgaggtacagtatttttttaagtttgataacgaaatctttctatagataattagtatacgtacatatgtccagaatcataaggagccggcaaaatctgcctccgaaagacataagtggggcagcaatgttgattttctagcagctgcaaaattattccaaattaatgttatcgtatgtagtccaaaccctcagagaaaagaagattttggaatacaatatgtatggaatatttatactccggatatgctggatacggtatccatttaaatacgataaatcaaaatattaggcatatttagatgcttgttggccagtcgagagaatataagtcaatttttatattttttgaattgggacatttcaaagcaattatagatcctgcggagttaaagcaaaactagcttattataaaattaaaagcatttgcataattttctttaaataataacaaaaatttgctctttaaataatcaagtataattttattaaaatagtaaattgatttgctttttaattggttgattaatcatattcaaatataattagttaaaagattaaattaaaaaccaatataaaatatttagtttgcttaataaaatttattttgctttgcttgattgctgtggctttgtgtgtatacggtttagggccgaaacacaaataataattaatttaaataaattaacccaaagagacaccgtactgatgaggcccggtctctttcggttaaatttgcacgtttcgcgaagtgcccatttttgcactgtcgcgaaacgccccatttttacaccatttttgcactgtcgcgaagtgcccaatttttgcatttttcgcgaagtgcccaatttttgcactgtcgcgaagtgccctttttgcacttgtcgcgaaatgacgtagcaccaactataatgaatggaactgaaaatataatatacattaaaccccatgcaattattaattaatatcatttaatttttatcaatacaagaaaagtgtaattttatttaaaaagtatttaaccttaaatatttaaatacacactattctgatcaatcttaccaaaacgagccgatagatacgggcgacccaaaaaatgcattcttatcaaagggaacaatttgtaggatttcgatatccatgacgtttttttgcctgatgcggcatgtggaaaatgtgagaattaaatatatatgaattttggagttttaaactcttactcataatggtataaaagtaaaagctaataacctatgttcaaagatagaaaatacatatatactagcaaaaaaaatctagtgggaaacccnagcagttagattctccttattaaatacacccctaacaaagggagagtacacaagtgacggtgacttccgaatgaacttacaggnntangtagataccccccccctttggattacaaaatttttttatttttgc

SEQ ID NO: 27996 - DNA, 1285 bp, Heterodera glycines
ttttctatttttaaaaaattaattgacaattttacaatctttttttcctttcaaatcgtttttttcggcccaactcaaaaaatatttacctcacaacggagtcgggccgtgcttcggcatttataatcttgtttccatctggcccttttttcatcgccctaatcatgaaaaaaagaaatttaaaaaatcctcttatttgctttttttaacaaatttaaattaatttaattatcaaaactcacagtcgctgttgggtccatagcctttgtcaaaggttgaaggcagcaaatagaacaaataaaagctaaaatacaactaaatataaattttataggcttcactttactctcaactataacattgtgactaaaaatacaaaaaaatgggggggggggagggcgtgtaattgattgtcctttcaagtgcatagaaaacatttatccattagaattaatcaattccactaattaatgaggaaggaaaggtaaggagaagagaaatattatttgatatagaatttttttctgacatttaaaaaaatgtttatggatctctatctagagagtttggaatttatatgaattctaaaatataacctttcaaataccttacaagatttttggagtgaaagaattcgaatttaaaaaaccataacaaattctggaaaaaggattcttaaaaatttctgttgttttttttcgactttttatgaaaatttcctcccgaagagttatgtttcaacccgacatttttaaatttcttcattcattcgcgacaaaaatttgacagggatttcctccccattccccatcttttctctttcataatatggtttttcaaatacttcacagaggaatgggggcgggaggcaattcgaaggtttaaaaacgggccatgtttgggctgcactttttcactgccaactcacactccaccagcaaaattttacaaaaatccatttttcaaaaaataagtgaaattagaagaaaaaacaaaaataacatttaaatttaaaaccttttaaaacaatcttaatttacaaaattaaaatctggtaaattcaatcataaaataatttagtaatttttcaagataaaggctttttaaatcccaggaagaaatatcggtttttaattttttaaaaatttttagacttgagatggaatcgaaccctagacctttctgttcaacagctattggcttatcacccaaacccttccctttcgttctgtatgcctcttgttttaaagagtttaatcgtccgctggcccaatccttacaatat

SEQ ID NO: 27997 - DNA, 769 bp, Heterodera glycines
  misc_feature (14)..(14): n is a, c, g, or t
  misc_feature (25)..(26): n is a, c, g, or t
  misc_feature (43)..(44): n is a, c, g, or t
  misc_feature (48)..(49): n is a, c, g, or t
  misc_feature (58)..(58): n is a, c, g, or t
  misc_feature (67)..(67): n is a, c, g, or t
  misc_feature (75)..(75): n is a, c, g, or t
  misc_feature (82)..(82): n is a, c, g, or t
  misc_feature (85)..(86): n is a, c, g, or t
  misc_feature (94)..(94): n is a, c, g, or t
  misc_feature (224)..(224): n is a, c, g, or t
atattccaaatatnctatcatattnnctccatcaatattccannctcnnattttattnctttttatnatcccttnccaaatnaannctcaattnaaaaattttatttttttaccttttttgaaaattttcacaaattttttttcaaaaacaatacttttttgttttaaaattttttagaaaaactgggatttttcatcatctacgtcttaaacattttttttgnatttttacagcctaatcaaagcatggttcactgaatcgtacaagcacatgaaaggggttccgataacagtggaagagatggaatcgaaatgtgaaatttttttaaattttaatattttccataaaaaatatttggcgctaaaatttttatttgggtggtttggaatttttgctatttagatatttcctatttaattataattagttttttgaatttctaatttagggcaaaaaacttttattaaatttaaaaaagaaaaaacttagtttttcgatcaaaaacgggaattttttaagcattgcactaatagacgtaaatgcattaataattatccagggcattttctgtcggcatttttgccattgacggaatgtttggtggcattatggttggtactgttgcggacagattagggcgccgtaaatcacttctgtacaacaatatattggcgatcattgctgcggcactgataacactggcaaaatatgtgaatatttattatttgatcatcattggacaattcattattggatcgaatgttggta

SEQ ID NO: 27998 - DNA, 1503 bp, Heterodera glycines
  misc_feature (15)..(15): n is a, c, g, or t
  misc_feature (58)..(58): n is a, c, g, or t
ttttttcgacaaaanttttgctaaaaaatgtctttttctcatatttgtacggcctttnggggtcaaaacggctaacttagctgatgggggccgttataagaggggttttttgaaaaaatgcgaaaatatgtacataaaatatggacataatgccaaaatatggaaataaatcgcgaaatatggaaaaatatggataagaactccttcctagaggcttcaaacaaagctaaaaacatgtttttcatgcgtttcaggcctccaacagtccaggaaaaaaatatggatttcatataattacaaatctaattatcattgtcactttctaatggatcagtatcaagccaggcactaaaaataaaatttaaattattgattttttggcataaattatcgaagcttttttttataaatatgtccatttggtattttttttaaatgtttaatgttttttacctatacgatttttgccacatacaattgttttttcttgaccaaattctcaaataaacgcagaactcgggtcaattaaatatttatttttgaagtcagttgagacctaacagaaatattaaatttagcatctgaaaattttgtcgtgttctctttttcaaaattatacaaaaataatacatttttttccacaaactttaaattccaaccttatgcaaaattagatgatttttgaaactttgtgcctttataaatatttatttttcttataaagccctaatatgatgcgaacaaaaattgtgcagtaatttttgctcagtttttaacatattaaacaaaattaaaaatttataattcaatatatttcttaattttaataattcttatattctcgacagtgaaaagagtttgataataactgtacacattgtaagatgaaaaaacttcattattgaatacaattttgagatcattaccataaaatataagatatttatgaaatacattttaattaataatgtaagaaatgacaattcctaacttactaaaaaatgaaactttaaaaagaaattaaaaatgactgtcaattaactattacatatataaaaatagcttctattagttagtcttttttaattcatgttagtaagttattatatcatccgaaaattatttctaataaaaaacacatggaatttgttcataagcatttttcatgccagtcctcgcacacgaatggctaaggagcattttttagacaattgcaaaaatattgaatttccaaatttataaatttttattatatgctaaaacaaattccatttttatatacataaatttttttccaaaagttctgacaaaaatttaattttttttcgattttaagggtgtatttttaaaaaattccaaaaagtcgatccttagggtgtatttttcgcatttttcttatgaaaattttcaaacaataaccgaaatatgctctaaaaacgcaaaaatggccaaatatgcacttattctcaaaaaccccccaaaatatgcttttatatgcactaa

SEQ ID NO: 27999 - DNA, 1447 bp, Heterodera glycines
tataagtagtgtaaggtcaggtaactggggccatctgagcgccgggacatttcagtcccagcgctcagccggccatttgagcgccagttggcgctcaaatggcctacgccccccgagttgtcgaccatttgtcctagaccatttgtcctattgtcgaccatttgtcccaaccatattatattgtcttttaattcatcagcgatctaggggatccgaactttgacaagtcgtcccatcacactaaccattaggccatccagacaaacataatttattttattattttgtgctaaaattaattctagaaaaatcatcaatcaacaatgtgtgtgtgtgttcggtcacaaaaaaattagggactgaatattttaaacaccccaataagttcttcacggcaaaaggggcaacgcccatcaattgaaacagtttcggcgcatcggttgcagagggcacgatgaccacatggaatgcatgcataatttctctaaaatatccaaaattagttttgcattaaacgctgacgacttttctggtatagcaaacggcgcaaagtgggtcgtcgtcattggaaccatccatatctcgtaattccaatatttcttctctcaaatctttcatctcgttgaccaaagttgcctttgtctctctcaacacacttatttctcttattaattgttccttttgttgtagcaattcgatttttttgttatggatttgtgttttcctatttttaagatgataaacatctcgttgcagttggtccttgtcgatttctaacccaatgatcatcgcttcaagccgtacaatttcgaaattagcaaatggttggtgggacattgattatttttccgtgctaaaaaaaagaaaattatatgattaaatcggggagggataaaatgggtcaaatgtgtgcaacatctctatataaataaacaggaagttgcattaacatatgcataaaaatgtttattgcaccattcactctaattttgtctggagctactggtagtggcaaaacgcaatggttgatgaaattgttgagaaattacaaggaactaatagacccgccgcctgcaaaaattctgtattgttcagagatgaatgagtcggttcttgatctgatgaagcggggaattgagacgcacaacggtttgccggatcaagcgttgatccagagccagccgaaaccactgctcctcgtgctggatgatttaatgctgaacgtgggaagcgattttctggatctgctgttcacacgcggttcacataactggaatgtcagcgttatttttgtcacccaaagcctgtacgggcgtaacattagaacagcgcgagctaacagccattatttggtgctgacaaggaacccgtctggtcaactccaggtcagaacggttgggtcacaactatgccaaaacgactcaattactttatggaggcgtacaat

SEQ ID NO: 28000 - DNA, 1333 bp, Heterodera glycines
  misc_feature (1253)..(1253): n is a, c, g, or t
  misc_feature (1282)..(1282): n is a, c, g, or t
caattccctaccgccaattccctactaaggcatttgggccatctccgtaccaaaaaatttttcgaaaattttcggaaaaatttcatggattgcgtccttgaatggcaagaacgtcctggaaatcggttcagtcacttgaaagttgaaaatttccttgaattcaagatgtccttgaaaataagtattcaaaagaaaacattcaaaagtttaattttttgaactttatgtaaaatttttattaacatagcattttttggtacaaaacctagttaaattgaatagaaatctcaattttccccgggacgcctatcgtcaccgcatgacacctttgccccctggaaattttttggaaaaagcgcgctatgatattcaacttttttaataatttcaaaaataataggcaaattgtccaaaaaaattttttgtttttcgctgagaaaaaaatcaatcacaaattttttaagagggctgaggaaagagtcgaagtggagggcgaaggccaattgcaagacgaaactggaagtgaaagtggagatgaaaatgcagaggaaaatgaaggaggactgagcttcgattccgacattttgagacagctcaagaagggcatttccgaaaaattcacccttttcactgaacctttccgctggttaaaaacgcctaaattggtgtcgtatgcaaaagagcatccggacgaagtaagcatggaataaaccaatggaaaggattaacagagaaaagacccatggactagggatgtgcgagaagtgataaaattaaaaaatgtgaagccacagaaaatgtaaacaacatttttggctcatgtttcgcaattaacccgtgttaataagcatatgtgactgtttatattttgaattttcgaattattcggccctagttcggggttagaatggaacgaaatttttaattttctcattaacccaaggtctacccaaactttaggaagcccagaggatatgcactgataatcaataaccatgactttggcacacaccgaagagctggaacaaacttggaccgtgataacctgaccgccctcttcagccaaatgggttatgtcacccaaaatgctgacaatttaacagccgaaaggaaaagaatggacaaattccaagcgaatgaaatagaagtaatgatcgataagcgcgaagaaagggatacgcccacccatggtgccggacattccgtcatcaaatactattttaatgtacttttttggtgtttttaatatttangcattttgggtttttagggcatatttgangggatttgtagtgcatatttgacattttttagtgcatataaatttgcccta

SEQ ID NO: 28001 - DNA, 554 bp, Heterodera glycines
aattttcaaaaaattcacaaccccctagaattttttttcaaacttcccgattttgactgtgttttatgggtgtagattagagatcaacatgtacctggatccagccctgtatttttcctggatccaggtacaggcacaggccatttttcggcaacctggatttttcctgtacatttatattcctgtacttatgtacagacaaaaaataggtactggccattttttgaaacaggtagaacggttttttcaaaatgttgatctctagtgtagatcaacatgaaggagtgatatgatcaacttgctgtgaacattttgttggtcaacatgaaaaattgacttagcaagaattttttcaaatttttctcttcgctatgcttcaaaaaatgtcaaaacattttgaatatttttaaactcttaaattttttcagttgaaatttcaaaagttagtgatacatattttcatttattcaaacatagaaaaaatttaaaaacctgaccctggcgccaaaacgtcggcgccaaaacgtcggcgccaaatcgtcagcgccaaaacg

SEQ ID NO: 28002 - DNA, 891 bp, Heterodera glycines
ctttcactttctgttctatcgttacaaaaagggtttgggcaagggagaagagattccatccttttcaatggccttataaataaaatcattcaatttattcctctgcttttgcttctgagtctatgcgtcgtccaaatggtcgactgcccccagcaaaacggacaccgccagcaattgcctctgttcaatgcttccgagcattttttcgaaggggctgagaaactatttgaaatttggttcgataatgaccagcagaagcgagaaaatggccacaaaagcacactgagaaccattcccgagaacgaactgcggcaacttctgaacacggccgggtgccacattctccaggcaactaaaaagcagagaatggcaataaaaatgatagatatgtagccattgtttccggaagtttagtccgaaacgttttatatataggcttacgagaatcaccgtgcacaatacatatgacatcaatttgagcaaaataataaactaatttgtcaggtgcttagaacagctgaaatcgatgcgtatttgctaaggtaaacacaaggccttctaattgtaagtattccaatgttctttgtttctttgacccattagcgagagcagcatgttcatctcggatcgacgtctcattttgaagacgtgcggacagacgcggccgttgcttgtgatcgaaaagttgttggagttggcacggaaacattgccaaatggacacagtgaccaatgtgcgtgtggtgggaattggccttttgctctgagttttgtcctttcaatctctgtcgttattgctttgccaggtgtattattcgcgtaagaatttcttccggcctcatttacagccccaactccacgccactttcgacgaggaagtggattaccttga

SEQ ID NO: 28003 - DNA, 1476 bp, Heterodera glycines
  misc_feature (60)..(60): n is a, c, g, or t
  misc_feature (101)..(101): n is a, c, g, or t
  misc_feature (105)..(105): n is a, c, g, or t
aaccataatgagtccaacccattttatgagtctaatcaattaaccataatgagtccaacncattttatgagtctaatcaattaaccataatgagtccaacncatnttatgagtctaatcaattaaccataatgagtccaacccattttatgagtctaatcaattaaccataatgagtccaacccattttatgagtctaatcaattaaccataatgagtccaacccattttattagtctaatcaattaaccataatgagtccaacccattttatgagtctaatcaattaaccataatgagtccaacccattttattagtctaatcaattaaccataatgagtccaacccattttattagtctaatcaattaaccataatgagtccaacccattttatgagtctaatcaattaaccataatgagtccaacccattttatgagtctaatcaattaaccataatgagtccaacccattttattagtctaatcaattaaccataatgagtccaacccattttattagtctaatcaattaaccataatgagtccaacccattttatgagtctaatcaattaaccataatgagtccaacccattttattagtctaatcaattaaccataatgagtccaacccattttattagtctaatcaattaaccataatgagtccaacccattttatgagtctaatcaattaaccataatgagtccaacccattttatgagtctaatcaattaaccataatgagtccaacccattttatgagtctaatcaattaaccatacctttacaataattttgttcatgtcaaacaaaccctatattttttgttatcagccaaaagcactaataataagtctgaataaggtaataataccagaaaacataagcatgctaacctttaaaaaggtacaaacaaaaataatcaagaattgctaattaatcatatatcttttttgacaattgcctaaacacttagatttgtataattatctttttttagactttgtgcgttaaactgataccaaaaatcctatgatttgttcaatatgaaacaaaaagttctgattcaagaaactcaggattcagttgatttgactcgtaaagtgcaatagaacctaataaaatccttcgattgtaatttggcaataaattctcaatttgtcagttttaatacgtcggaattgggcgcaatgaccgcgcacattgtgcaaaaacatccgcaatatgcggccaaattgctggcaaaacagctcgaatttggtgaccaccacagcgaacaaccgggcaacacaatgccaaaagtggaggagggggtaaaagggccatttacaccaaatagaggggaagtggtcaaatgggggggggggcaccaaaaggtagaaataaattttgacgggttttaaaaatgagagcattgtcaccggatgtgaaaaatttgaaggatttgacgcaaactgttcactgattctaa

SEQ ID NO: 28004 - DNA, 717 bp, Heterodera glycines
ataaactggattagagccgtctttttatttatgaataaatttggcgaaaaaaaacaaacaaaacgaaatttcgatcacttttccccgatcataacattttcttatcactctgattcatcacttctcaagtgctgctgttgattaacgccgtcgtcatccaacagttcatccccgtcctcggcaccacttccggcttcaacatcgctgacgcatccgtcttcggcacattccccgtcggcattgtccatggcattccgtttccgatgcttgtcaaaaaaggcacagcgcgacggttggaagcaaaaggtggccaacaaagagacgaaaagcatctcgacacagagcaaaaagcaaatgtaaactgtgaggagaaatgaatgggaatttaaaagtgccaacaaataatttgtgccacttttcaccgctgctcacattgtgccaccgccgaagagggcaatttggcgggatcatgcgctatggtcggcaccatgtcgagaatgccgaagaagtcgccgacaaacttttgcacggatcaaaacagttggcagaagtcgacgatacggaagagcagcaaaaaactgaaaaaaaattcgtcgaattttttccatatttcatttgaaaaattgtgagacgtgccgatattcgtgcaacagcgaagcgccgaggggcacaattacgtaagagccgtaggagccaataaacatggaaatcatagca

SEQ ID NO: 28005 - DNA, 1784 bp, Heterodera glycines
  misc_feature (1752)..(1752): n is a, c, g, or t
tcctcttaaattctagtttaaaaatctaaatatttttttataatatcccatatgaaattgtgaaggatttaacccctaaacattttttggtataaactttgtaaataattgacctaaaatcacagaatttgatcattttttgaataaaatcagttaacaaatcacaagcaaattttcaaaaattttctaccggacccccccccctaccttgtcgccaatgtttattctaaaaaatgcgcctaaaaagtgatatgatagtaaaaaagggtcgtagaccggaggcggggtacccaccccgacttcaagccgaaatcctgggaccttccctgctcccctccacagcctcccaaaattccattaaaattttcaaaatttaatcaacaaactgaccataaaatattgtatatttaaaaagaatataattttaaaaaagtttatgaagattatgccgacgttactatatacgttatattgacaaggagtttcgtttgcaaaaacaaaatctcccggccgaaggccgggagcgccctgaaaatagtggaagggtcttacaactttttgaggcgcatctgggaaaactatagaaaaaaattcagcgcggacgactgagtcccggggaccgatttctcactttttcttgcgtttgaaggcccctaactttttttctaaaacccgaatcaaaaaatgtctgctgtgagggggctaagttgaagtgttttctaaaaaacaaaaaaaattccaagcctctatctgcaataggaaaggctgtaggttcgtggactttttcagtaccaactttgtccagttcagtccccgttgaataactcattagggtttgacctgagcgcagggtggccagcagacttattgtagagttttgaaagcccgatttttccaaatttaaaaatttcgaaaattttcaaaaattttcgagttaggcctaaaaaacggttttcgggtttttgaattttaggattttttaacgaaattttcccagagaaacggagaccacttccaaaacatagtttttcgagctctatcgactggtatttttttcggaaaaatttcgattttttcccggaaatagaaaaaatttttggcctgagcgggacatttgagtcccgggcccataactcgtcaggggttggttttatcaaaaaaacgccttagggcaaaattgtagagctttttaagctctatcgaatggtgtgccatatggccggaaattttcaaaatttttcgagctaggccccctagaaattttcggaaattttttttcggacgaaaatgggggtgaaaaatatttttctggggtaaaataaggtgctgagtacgaatatgatgtctattttaagtttcataatttttggaattttttaaaaattctttattttttggcaattttttggccctcgggattttggcctaatatttgaaaattcataacaaatcgaagggtggatcaattttcgtgcaattatattataaaaatagagaaaaatcaggagaattttatgggatttatttgggatttctatcttaaaaagaaaacaagttattccagaatttctgaaaattttcgatttttcagaaaaaaattcataacccccttctgaaaagaaatttttgaaaattaaaatactacaaaaatccgcaatttttttctttataatataaattttattttacatttttatcactttcttacgaattgttacaaaaataaaaccgattttgggattatggaccaanaggggtgagcataggatttttgagttgaaaaa

SEQ ID NO: 28006 - DNA, 1996 bp, Heterodera glycines
  misc_feature (1871)..(1871): n is a, c, g, or t
  misc_feature (1962)..(1963): n is a, c, g, or t
  misc_feature (1989)..(1989): n is a, c, g, or t
aggtcttttttactggggtaaaattacaattataatgttttttcaatttttttcatgaacggatcagattttaattaatatataaataatcttttttatttttattattatttgttctggaaggttattctttttatttagtgacattgaatgattgcccaaattcactgaaaaattattgggacggcaatttttgccattcggaactcaaaatcacaaattgtttgactgttcaaaagaatagcaaaaaaacgggtaaaaaatgatgttttatatattttaattatttattttcttcaaaaggcgatcgatctgtcttcgcaaaacatccgattttgctgaacaataataatgacccgtccaatcacattttttactatgaaatttcagtcaggaaaatgcaatagtaagtgaaccattttactgtatgttacacgtatcatattgtgttgcaatgaaaggagatttaaacttaattaattagtattttgcattaaaacaaacaaaacaaaaaataacgaaggaaaacatttctcttgacttttttgagctttatgaacaattttcttctctacattattatcattcatatgtattaaaatttcagttgcagttgcgtcttttttggattctcattaaaaagagaatcttttattaccgggccattgaccagaatcgcatatggttactcgagtaatggaaaattgtgggccaactcggcgaatcttgaaactgcacgctcctatggagaaaatgatgtggtcggatgcggcgttaatttggccactcgacagatctttttcaccaaaaatggaaaacgcatgggttggtaaaataataaaaatgagtgaaagaattttttgttgaaaaatattttcaatttgtacaaatttatcttagtgtgtttaaataattatgtagtggagtgccattgggccgagccgggaattccagtcctccaaggggatcccggaaaatgcgtcaatagaaaatgcgtcggtgattagaatttaaaaaaaaaattctatggcattaagtattgtcgtataaaggtcaaaatattataatctcattccgaatctcggacaccaactcgaacaaaaataaaagttcaaattttgcatttttcatctaaatggttagatgatctttttatagcagaattaaaggctttcagtttacttaagtgtataaactgattctgaaccaaaaatgctaatttcgaacattttgactttttgtttgaatttgagcccggggctcagaattcagaaggtatctcataaaattcttcttttatactacagtacgtaatgctacagaacattatttatttgtatcacttacgcattttccggtaacgtaaatttctttcgaataaaactcaagttcaagaaaaaaataacaactttttaaatttcaaaaaataattacaaaaatcgttgaagagttgaaaaattttcagaaatttttcctgaaattttcatagaaaaaactgccacttcggtccaccagaaatttaaaaaactttattttttagaatttaccattttataattatggaaaatgaataataaatgaattatgttttttttgttcagatgcgggcggcttgtacattttggcaaatgcttcatctctcagtgactacttcccattcgttatgctgttcaacaacgaagacatgatttatgcaaatttcgaacaggaattcatattcaatttggccactctttaaaaaacgattgcttttaattatttgcgaaaaactgaattatcaaattattatttttttgtcggcgaagagcgcgcgtgaatattttgctcataaataaaaaatttttgctatacctttgtataaaagcaactanaaatttaattcttaatatccattcgagaacccttatgtattttatgaatttttgcgggataaaacaaacacttagtgctatgaataatatnncagatataaaatttgattacttttgngcgtaat

SEQ ID NO: 28007 - DNA, 1369 bp, Heterodera glycines
tctttcaattttatttgtatcacttctcctttataagtaatgtgatattattcctctcagatgttacgcaaactatctgacgcgtaccaaaaggcacttttgacgcctatttggaacttagttcaacaaatacttgatgaaaattgtcgtgtgttttttggaacacttaacggagtttttcgtcaattggaagtattctttcaaacatatgattagaaatttcagttttctaaatgctgatgatattttaggacagagaaattgctgccaattgtttgatcagtggtcgcggcggcatcaaagggcaaattcggctcgcacaggcaattgatgaaattcccgtgataattcttattacagtttaaatattagttttttagggcgcggagaaagtactttctgtcagtgggcaaattcacagcccttccatcgagcctgacagaatggaagtacatggtaattcaagtctatattcacagataaacatcggagggcgtcagattaaaaattctttgagaaaattattcactttcaatagatttacagtgaaagcgatttcttcaatagcaaacaaagcttacagtaatatgtcacagtaacgtctttcgaaatttcatttagacctggggaacgtcaccgctggtagttcttctaccggtcggtctttacacacgttgtgtacttttgcctcggttggtgctgccaatgattacgttcccgctggtgttgtcacggctccgttggctctcagcggttcaaaaatcaattgcatcggtcgttctcttgtcgtttttcaagaaggttcgggttttgtttcgcttttcccttaccgtttcagtttttgcttgattatttccattccctatgtttcagggcgttccgcattgggaagtggcgtaatcggttacgcgaaggacacgcgcattttctcggacgagtttgacgaagtgattttccattattagcaaattgcagcctttttaaaatgttttttaatttttagatctttcgtaatttgattacacagtacagaaatgtgaacgtctcagattgttggcttgttctcagagacggcacaagttcaaatccagattgtcgcgcgttcttcgacatgttggatgagattttggcgacggaagaagtaagtatcttatcattggattattagttaaaattaacaacttttcagaaaccattgctttttctattacattttcaaattccaattaaatttactcattttacgctttttcaggttcaggaatacaccggacctcgaaaggcgatctgttcgttggtcaatgtggaaaaccaagctgtgaacgggtcaatcacgttacacaggcaaagaattttcaagcaaaatttg

SEQ ID NO: 28008 - DNA, 1433 bp, Heterodera glycines
ccccccttttcttttcctttccttcctttctcccacacatttctttcgtaaattatgtcgaattgtattgttttctgtgttttaatgattcaattaaaaaaagaattaattttgcccgtttatttttcgaaaatttgcattatttgtacgctttccatttttaattcgaattttaccaaattcctctccttatctgttgatttagctcatttcgacacctaacctaacaaacaaaagcatttttctcttcgtctttgggtccttttttctctgtctgtctgtctgtctcccatactcttctcctctctgacttcccttcccccattctctccccctctccctcccctcgtctttttaatgctcccaaaatatctttttttccccttctctcttttcctcccattctcttttcgctcttttcctctgctgccagtcactcactctttcttgctgacaaatgagagcgaaagaacccgcgaggaatggaacagctgatgatgagagaaggaagcagcagggaaagaattggaggagaaagtcggaggggaggaggaggaaggggaggagaggacgagttgtggaacaattttaagtgaggggaggggggagagagttgctgaggacagagggggggagggcaatttgcctatcattttccctctttctctgttttgaatgtcccattaaaaagtcacgatcacttccccactgatcaaatcatctgtccgaccatttgaccttctcttttccccagcatttccttttcctttgctattttttatgttgccttttttgtaacttttcccttttttcgccatttccatcccaatttttgtgtgtacgtatttataggggggttaatgggtagggaacggaaacaaaatccacatcacacaatctcatcgcataaagcgagcgttgggggacgaaataatgcaggcagagaagtgagagcaagaagaaaataacaaagggtcgacggatgggcagtttgagagataactaaagaggaggagagtggaagggcggagagcggactttcatttcttacattcattcggtcgtggtgggagacgttgggtgggaaagggagggggggggagcaaaaaggagggaggggtcggtcgtttgctgttttgttctgaaagaacgggctgggaaggatgaaagaggaaggtgcagcaggcaagcaggaggagacgacgagtggatgacgagaattccccggcccggcccctttccccctcgcccccaactcccccaatcagtcgcaatcgtgaagatttgctctctcatctccccgaggttcatcagcctttctcccattcccaccatcaaacttcatcactattatcagcatcattttcttaaatttgaccagttttgtgcttctcggaaaatggtacctcctaatccaacccgatcattaaaag

SEQ ID NO: 28009 - DNA, 1604 bp, Heterodera glycines
tcccctcccttcgccttatttttcgatcaaatttctcccgtattttcacacaaaaacactaactgaaaaagccactttccattacaattacaatcgatttgccaattcaaatttgaccagcttttcaatcattgaaaaagtcttttcttgcataaactgatgcttttaaatttctttgattatgaaatgcgccaaattttccctcactttctctttttttcttcttttgctttgacccaatgtttgtttgccttcgactgaactcgcgccgtgctcaaacatcggcagcagcagaatgaatgagcccatgtccaatcagtaaaacatggaccccccgggggatggggcgcaatgaccgaccatctgctgctccgctgctgtctcgtgcctaatgagcgcagttttgggcgctgcggttgctgctgaccgtcccgtccattacccccgctcccctccctcggctcttatcccctccccatcaactctctgagacaaaaatgggattattgcaaattgaaatcaaacgaatgaatatgcttatttgaataaaagcatttatccaattccattccgattcttcaatctctcctctttctcttcacacttatctccattccccccgggggggggcgatgatggcagatgggtgacagactcaccgaaacaacgattggggggttggagatggatggatattttggggtggaagaaatggcgcgatgagataggatgggatggatcatcccctccctctctccctctcccttcctcctccgttttcaatccaaggtctttttttcccttcctcttccctcctccgcctctcttttgcgctattttgccacttttctctccatttcttaggccatcgatcccaccgattcaaatgccccgggcgatttcgccttccatcggcgatccctcccctcccctctcttttttattctttgtttcttttttctttgagggacatttgggtggcgcagatgcgctaaatgagaaaggagcggacataaaaaagaaaaacagagagaaagaaaaagcaataactaatgaaagtgaattcaattggaaaatcaatcttttttttagatcactgatcagccgttacatcgaacttccgatcgtttgaaccctcttccgatcacttgtaccctcatccggttattttcactttcccccggtcgcttgctcttttgaaattaataattgcctttactttccgcttagtccattaaattccatcactaattttgcggaattcgttttcacatctgcgcaactgttttattcattgcaattctttgctctaaatgcatgcacaaattattcctctttccaaatcctcgcctctttttcttccgcttgcctctctttccttctttctcttcccttcatttccttcacttcttttccttctcttcttttctcttactctctctcttctttctcatcctttctcttcctctctcccttttcctcctcttcttctcttatcttttctcttcctctctccattttttcttcccttcttgacttctcttccttctattcctcctctttcactgccactcttttctctccattgtttcctttccttctca

SEQ ID NO: 28010 - DNA, 2057 bp, Heterodera glycines
  misc_feature (588)..(588): n is a, c, g, or t
  misc_feature (896)..(896): n is a, c, g, or t
  misc_feature (983)..(983): n is a, c, g, or t
  misc_feature (1018)..(1018): n is a, c, g, or t
  misc_feature (2041)..(2041): n is a, c, g, or t
tttcgcctcgcgtttatacgggagatttgtaccacttttgtgccctaattagcaaagaaaaaattgcgtgggatttttcacatgaaaattaataaaaaagtaattaaataaaccatggcgcaaaaaaacagagcaatgaaattgggtaatattctcttcccatcaaaattagcacaatttcaaccgatgcaaagagaacaaaacgatttttgatggtcattttgattaattgctgcaatgcaatgtcattaacacagattcattttgcaaattgtcattatcattagatcaaaaatgaccaaaaaaaataattaaaagaagcgagagaatgcgaaaaggtgaaaataaccactttttgggacccattgggcgaaattctggcgattcggcgcacttttcaggcacaacaaatttcaatgaattttgtgaaattttttgttgagactatgtgcccctcaaaatgctttgaaccaattttaaggggcgaaaattctaattccttcaaataaatacgcacaaaaaatccaatggacttaaatttttgaaacagttagtggatgcattttgcttgtttttgtttatttgggntgttggttttctgtgccattgacatttatttttgtaatttgtcgggtgccgcgcttctgctgcttcgctgcttcggcttgtcacgaaaaatgcgggtgatgaaggttaagcacttttaactcattcctaaattaattttggttttaaatttcgagcatatagcaattaatttcttatccacttttactacaaattctgcaaattgtttttttttttacttggttctttttttttggaaattgaccaaaataacagttatatgtactgttaaagcgaattatttttgttggtaattataatacataatntattgaatcagtcagtgtttattattctctaaaaaaataaaatcccatataacagtcatggtcatagtgtacggacactccactatnatacaatttaaaatgctgaaaaccaatcaaaaatngaaagtgaattaaaaaattttattttgtaattttgtagcgttttttatgggctatcaaatagcaccattcattattttgtagatgctctttatacatttagcaaattctcaaatatttttagattaatgatagtatttttttttgaaaatccattaaaataaaaaaatcctttcctaatttagcgttttttaatatataaatttaaatgcttttccttttcttactactgtgcataagttggacaaaatgcaaaattttcatttatttaacttaatttgaattaaataataattggaatttcaaatatttttttcgctatattattataaattaaattgagatataacactcaaaaaatcattgttttttaattaaaaatattttctttttagtcccttgaccctaattctgtgccggactctgctgaaactgtgataatgtccgacttcgccttcgctatttcagccattttcggtacgaaatttattaatttttaaatcccattaaattacgtccatttaaatctaataattattattcttttaatatgactgtgcattttctgactcattctgcgtaatgaagtgatatgaattcagatgaaaaagaaaaaaattttggtttggtcaaccaaaacgacaatatttatggtgataaaatgattataaaaaatgcaataataataatattgttttggggttctcttcttttggcgaattgagaacctgttaagtttacagcaataaacgacttttattttgtaaaataagcaaaaaatacatttgaaaataaaatttttttgcgaatttgagccaattttttaagaaacattggaagttttgggtaaagcgccgccgagaaacatttttgaaaatttgttaacttgatttgcctaaaataactttatttcgagcgaattttttaaataaaattcataagttttattatttttagatttaggagtgaatataaaaaaaggaatttttgggagcttggcatacttggaaaaggggggggggggngcgaccaagatttttt

SEQ ID NO: 28011 - DNA, 687 bp, Heterodera glycines
ataattagtggatggtcccaacttatttttgataatgccatttcccccgtcgaataaatgccgtgccatgtcaggccgattccgaagtgcacactgtgtacattgacgcgacgggccagcaaaaagtgaagcgcgaaccgcggcaaaacttttcatggctggtcatttgctcatccgacgttaacagaatagcgaaagcattggaacgagtggaggaattgttggaatttggcaacaaatcggagcattggacagtgccaatgggacggaggaacggcacgggaagcgaaggggcggaagagaacggcacgggacggacaatggccgtgcaaaaaatgcgcatcccagcagcggaactttttggcagggagcaaatgaggcgattcgagcaaatcagccactggggggtaattagagtgttaatagggttaattggacacgcctggggacattgggaggcataaaaactgaaggataccttttgcgatggactttttaaattcctagaaaaaatcccatggagtaagcatcgaattggacagcagcgaccccgggcaatcattccgtctggtgacactttccggcacagaaaatggcatttcatctgtcagaatggaattgaaaggactgatcgacgaagtaaaaggttcaatgccagcggaacatgaaaagaaggcaagacaaacg

SEQ ID NO: 28012 - DNA, 1069 bp, Heterodera glycines
  misc_feature (1039)..(1039): n is a, c, g, or t
cgtaggaggcctccacccgggcactggtactgttcagcgggggctgaaatgggcaaggagagtgctttgattgatcggatcgaactgggagtgaaaaatcgattagttagtgatctggaataacattgatcgaataattatgaggtagtgagaaagattgatcggttcatgcaaaaaatatcgattgatcggttgaactggggtactagtgaagaccgataaatgaattaattatctacatattaattgagtaatgaatattgatcagcagctcaatcaagaaacgaagagtgaaacagagaagaatcaaagattgccaattgatagaccaattaattgtttgttgatatcgtaatattgtaattaagggatatactgtgtcagtcgatcgattctatcaaaaaatactgagaataaaaacaatcaaatactatcatttaacagatcaattaaaaaatagtgatcagatatcgtcagcttagcttatatacaaagttgatcagaccggtaattaactaatcacatagtaccgtcttcccattacagtaaactgaccaacaactgtagcattgctgtcccatgggcgtccaactccaacaccttgacctccttgtcctcctgttgttgttgcagcggttgctgttgctgtgcctgcgcaccacggtagaaggtggtcagctggacacggcgcggcagcgacgacttggccggcgtgtcgtccatttgcttcagtgccaccacaacgctgtagggaaggccgggcttgaacgtgtcgctctgcttgtccacctccaacttgacgtcccgcgagtaggcggtgatctgtgatcagacagaatgtcaggcatgggaaaattgacaaatttacgagaaaatttacaaattttgaaaattctcgaacaggttgactgttggaaaagattttttgatttgccgaggggtccagagccatatataaatcgacgatttttttaaaatataaatcatttttttgcggcatgtttttttcaaaaatttttttcgatacgataaccaatanatactcttgcttgcacccagtgcttctgct

SEQ ID NO: 28013 - DNA, 1889 bp, Heterodera glycines
  misc_feature (1831)..(1831): n is a, c, g, or t
  misc_feature (1864)..(1864): n is a, c, g, or t
ttaaaaacgggaattttcaagttcactgtgcttgatctttattaagtccaatttcgaactccggacccgaaatttaaagccaaaattgtcgaaattctcattttttttccaaaatcacattttgataaaaatttggattttttacccgtgaaaaaatacaaaacgatcggaaaagcaattaaattttatgtgataccatcaacaaacagtatttatgtttattttaaatttaatttcaaataaattttaaaatgaaaattattaaaaataaaaccaaaattcatagaattaaaaaaaacaatgtttccaaggtgtttttctcttatgggcttggcgttggtgcacttgtggcattgggctcatacaacaaatatcacaacaatgtttacaagtgattaaaattagcatgcccggcggctaattcatttggattaattagcgttaattaattcattagcctaaaacaaacaacccccatttacagacaagcattgactgtttgctgtgtgaacagcgggacaagtgtttttgcgggtattacataatcccattaattaattgttggggtaacaaaaaaattgtttaattgattttttaattgtttcttgtgccttttgtatcaatttagctaatgatccctgattagggggatgacaaaaatctccgccgctcaaaaaatccgggaagaccaaaaataaattctttttatccctcatatgttttttttgccggccgaaatctcgccgcagaaatttcaaaaaaaaaatttcaaacttagaaatttttcaaggaaaaaattcttagaaaatttttttataagaaaatttaaagaaaaaaattgttgaaaaatttttcagcaatttttttttgaaattttatgaaaatttactgtttttttttttgaaaaattttcaaaaaaacttagcaaatagttttttttttggaattttcttataaaaaaaattttctaaaattttttcctgaaaaatttctaagtttgaatttttttttttgaaatttctgcggcgagatttcgtccccccccccccaggggatgacgaataaacaaacaaacaaattttataattacctaatacaatattgctaacttattgttagtttaggtgttgccgaagaaaagagaaacaagaaacaggaaaaattcctcggtaaatcccacaaaaaaacaattagcaaaaggcacacaattggaattggaggtgggaaacacacaaacaaacaatgaatgagttgaactgacaataaatgagacacggcacaataatcacacatcacattggatttaccgtttttgcggaaaacaaaaaattttttttgaaaattttaaacaaatttttcccctctccgtgtacagcaaagtcaggcggactcggacaatgatgatgcggcgccgaagggacgccgtggccctggaggcgggcccggaaagcgccaacgcgtcaccaaatcgccggccaaccccaaactgtacgccaagctgaacgcatgtttgaacacactgctcaactacaagacgaggtacgagggggagcggcgacggcgtgttttggttaccggtttcgagaaaatgggcaaattttctagaattatggacatacaattcagtatttcttacattaatgaccccggggttttcggtatccagacaattaattgcgatcggcttcaaatttatggatattttttcaattttaaatggcattaaataaatgccagaactgattacttattgccagagccatgaattttgaaaaagtattgatcccagatcgattttgccgtgatttagatcccgaacctggccattttncctaatcgatcctttgagttatccgaatatccnttcgatgttagcaatggcaaaaagt

SEQ ID NO: 28014 - DNA, 1260 bp, Heterodera glycines
ccgtgcccgtacgaggccgcgaagcggccgagcgagtgccttaagcgcggggacaaccgaatggcaccggctggccccggtgttgaaagcggccccggcgctttcacagggccccttggggccctggttctctatataagaggattctagcacttgaaatgactttttttgaataactctcttcaagttggtcggattggtttgaaaaaaaaacatatactttttttaaggattctctatcgaatggtgaaaaccgttttttgaaattttcacgtaaaaaaaagtttcttcagaaaatttatgaaaatttttggaaattttttgaacgggtcgcggttgtcggcctctagcgcgatggatgttaaagatagcgtcttgggcttggagaaagggcacaccttcacattttggcggttctaatgagctattaaattaaaaaattatattttataaaaatataattttttaatattaacttataaaaataacattactataaaataaaaagcatgcttttagcacaaatttaaattgagttatgctctggagtggaattcaaaaattttgaaaaattttttgcctgaagaattaggggtggtacgcagggattctgaggggttgttaagtatttctaacaatttttttgtgatagaaaggcttaaaataatgtgttaataagccctacgtgcattgcaacaataaaaatatatgttggaccaaactactactatgcacttttggcagaaccccggattctgggggtgaaaatttttttggattttttaacaaatttttcctgatagaaatgctttaaataaggtgttattacgccctacatgcattccggtattataagttcatccctgaccaaagcactgtgtgtcgaaaaaatgacatcaaaagctgaacaaatattacaactcttcaaacaactttacaactcctgcacaacttttgcatcaaatccctaacaactttggtacaaaattaaaaaaactattcagagcaatgataatttaattgagtacttttctatattctttttcgatagaaagtcttaaaataatgagttaagacgccctacgttcattccaataatataaatacatgttgaaccaaactactactatgcatttttgtcagaaccctggattctgggggtgaaaatttttttgaattttttaacaaatttttcctgatagaaatgcttaaaataaggtgttattacgctctacgtgcattccggcattataagttcat

SEQ ID NO: 28015 - DNA, 1671 bp, Heterodera glycines
gtgagccggtgccgaactctaggggtagccgcatagcttgttccgagtttatagtcgaaattattgtcccgagtgtagctaaaaattttaatttttggaaataaatgcataaatctaacaaacaatggttgcgggtgggtgaaaattgagtggattatctcaaaatgcgtcaacaccatccaacatctggcgctgtgtcaagccgatatatgttcgagagaagtaaaggaagaacattggcattccaggagaagatctcacccaaaattggtttttccgcgctcaaaggtcattgttgaaagttcagcctcgttcaaagtctgttgttcaacattgtcggaagttatcacggcatgcagttcgtcaatctccactccaaaatttacggcctcctcagttgggtttgaaatgctgacaaacaaagcttcttccgacttttttgtagactttcaagtttattacgaatcatttgttcaattaatgaatagcaaaatctgaagacaaaaaaagcacatatttttaatcaaatttggagatttttcttattcgggtgggtctagggttaggcaaggggctatataaatgtcgtattggtattcagcgaccccgaaaaccctaaaatagacccattttccggctttttatgagctttttagactttggacaattcgtgggtttttactcttttggacaattcgtggcttggacactttgtgggggcgcccctaaatcagaatctggtaaatcattttctcagatttggacccaccatattaaaacatttgataaaacaaaacagatataaggcctgatctaatatgttcaaaaattgtatttcatttaaatcgagtccgggcttcgcaattgtcaaaatgaatacaatattcgtgattagcgactcagaaaactgacgaatacatattttcatttattcaaacatagacaaaatttaaaaacctgaccctggcgccaaaacgtgggcgccaaaacgtcggcgccaaaacgaccttggcgccaaaacgtgggcgccaaaacgaccccgactcctaaaaaatccctatttttaagctcttgctgtatttaaaaatgtatctaatccgtccatattttcccgattttccggtggaacctgaacacattctttaccgcttatcttgttactatgccattccaaagattttagtcaatcatttgcagtctaactaattaacggaccactggcttgcgccagggacgtatccaaggggtaccgatccgaaaagtcaattcttaggggtgtattttttaaaatttttcgcccgattcttaggggtgtatttttgaaaattcttcgcccgattcttagggatgtatttttgaaaaactttcgcccgaacgaccttttttttttgctcataccagcgacgctgggaaaataggggtgtatttgaaacgataattagcatttttccatcgtttacacatggattttgaaaattagctattttgactgcttttgctccgcccctggcgaaaggaaatgaaaaattgaagacagaaaaaatgtttctttggatttggggttgaattaaaaataatatgttgctttcgttatgaaaatttggcggtaatttaaatttggctttcctttttctctctgggggggctggttgggcttgtgggggggggggg

SEQ ID NO: 28016 - DNA, 614 bp, Heterodera glycines
aggggggttggtaaaaattcagtgggggggttatattacaggaaatacggtacctatctcattaattttgttttcgaggattttggggtcctgatcagtgatcacgtaacatctattttgattaatttctaaaacctaacccgaaatatacaaaagtaaaattcaatttctcggtttttatttttttgttaaaatatttcattacaggattctcttctgtgcaatggctgattggaatgattttttcggatctttacgaaaatatttgaattattttcgcgcacaccattcacaaggactttcttataacgctttaacagcaagcagtaatactcagacaatttctgacgctgaacttgctggccttttgtcatggactcggtttgcttcagctgttgcaaaaaaagtaaagtgttaaaaaaaactaatttatgatgtaaaaaaataattgatgattaatagcctaaatgctgttttccgatttgccataaattgtgaccttgttactaatttcaaattaggatgccgagtcgcggagacaagtgtacgaagaaaggtcatggaattgcgttgaaacggcgactggtttattgacctgttcaattcccattgat

SEQ ID NO: 28017 - DNA, 1030 bp, Heterodera glycines
attttcttttgaatttaattgataaaacattttaatttcctacctaggatattttaaattatattaatcatttgatgatccttttgtctcattaggttgaaaaacggttctgaacatcccacagctcttctagtcacagacatcggtacgtaccagcctaagtcacgcgtaaggcgacaatgtgaagttcagcgccaaaatcgaggcttttccggcgcccgaagtgcaatggactttcaatggagagccaccgaaagcgacgtaattatttaattttcattgtttaattttcaactttcaatttttagtccattaattttaaagttctttgaaactcttttccggagatcgggtttccggaaagcttaagcaaacaaaaggtgcaagaaggagagtttggcgcgggcgcagcaaacggagagaaatcgatacaaaacaaaagattaaataataaataaaccatttaatggaaaaacatttcaaaagttatttcgaattcagcaacatcagaatcagcaacgaggggaacttgcacatgctggagatcaacaatgtacagctcgagcaggcaggcgagttggcatgcaccgtgaagaacagcgcggggtcaaagcgacagaacgctcatttgacggtcaaagaaagcggcggggcgccggcatttgagcgaagcattgaagtaaatggcacaaacgaagcaaatactgctcgaacttgttgctcgcaaatcggaattgtagacggaactgagaaacatttttgaaaataaggggggggggcggaattttcaaaattcaaaaaccgggactgaaaaacccaaaaaaattcggcaagtgtctttaggaccgtttggtggaggaaaatgagactttgataatggaggcgcaattggcacccggggcaaagccggcggcggaagtgcaatggctgaaggacgggcagcaattgcagaagacggacgaacacttcaagcagagtgaagaggcgaacagagtgcacaaactgaccattatacgggtggcacaggcgg

SEQ ID NO: 28018 - DNA, 876 bp, Heterodera glycines
agtcgacccattgcagtgaaggtgtgtgattgaatcccaaccaagattttggtcattccaaaaaaaatgggcattttcggtgaaaaatggctaaaaaaggcactcaaaatggagtaaaagaatttttggcctgaagagcagaaaaaaaagcttcttcggattccaccttcccaaattattttcttgctacgggcttgtccatgagaacaaaacaatttttcagcaagtttttgcaccgttacccaacatttgcgccccgacatttgcgcctttgtccaaaatagggttcaaacttacattttttcaatcccggagggcttaaacagctttaaataagcgattgaaagtgattgtatgggatactttgatcctcagcaaatttttgaaaaaacaattaatttttcaaacaacatttaattattgttcctaataaaccaaaaagaacaagttttcttaaatttaatgctgtttaagacctctaagattgaaaatgtatgtttgaacccaattttggacataggcgcaaatgtctggacacattttgcaaaatttggaacttttaaggatttgtgtggcaaatttgaaaaagaatcaatttcatgaataaacagttaattccctgctttgtttggctcgtttttgcgagaggagatttgcacaatttaccacaaaagtttttcacccttaatttctcaaatttttgggttacgcgttaaagaaaagcatttttacaattaacaaatttagggatcaatttttgagcaattaaaatgctttatcaattttattaaatattaaaaatcccttaaaactaattttaaaaatcctagggttgtcctccatttacaatattttcttagcaaaagaagcgcactg

SEQ ID NO: 28019 - DNA, 845 bp, Heterodera glycines
cctaattatatttaattaataataatctatttaccatttcgtaaaaaattgtttttggatttaaaataatagtaaaggattttttccattttgaaaggttttgaattcattacccaaaaaataccacagtatattgataatgaaaatttttttaacattaaaaacaaaatttcaagaaataaatttaagtaaaatttagtttaaaaataatataacttggatttggaagtagagaactttaactgccctctcaactgactccttatcaagagaattctcccgattaaatagttggacttaaggaacggaataaaaatggggaaagcggggataaatggtgtgggaaagagattgaacggataagtaaattgcgccttacagcacattatgaaaaaataataatgtaattcttttttttgatataattaatcattctattatcttggtcggtccaggtcaaatcgtggttttatgtttgcgttcataaagttgttcaaataaaattacataaaaaattaacaaatttaaaaataagtttttatttcggcataatgttgttctttaatattatcgaaaagtttacaaacaaattcttttataaaaaactattatttcgttcacgagtacaaaattttattttgtttatacatgaaaataatcgcggtgaataatttttatcttttcccataaaatataataaactttatcttgcatattttttatatttattaaatattgaagaagcaaaaagattttcgtttaaataattggtttcatcttatcttcttcttatttaattatgagtggagcattgtaaattttaatagaggcttgaataatgagca

SEQ ID NO: 28020 - DNA, 1459 bp, Heterodera glycines
  misc_feature (1450)..(1450): n is a, c, g, or t
ttctcaattttttaatttttcgtgcttttggcattttagttgcttttttgtgttgtttcgtcattttgaggaattttccaatatatttttcagcgatttcaaaaaatttgaaaatatgcctaaaacacctaaaaactttaaatcggtatggcttaaggaatggattaaaataatttccgtgccaaaaccgaccccgacacttcagtatatccctcctatgtgaccaatactataatttcgtttattagggaagctcctctcttaagtggatggacccgcgcatcttcacggccattgacctaactcttgctgttccattcggttatgccgcccatcttgtctatcaaaacggaggaggttatgattaaaaaaaaatatatatatatatatatatatatatatatatatatatatatatatatatatatatatatatatatatatatatatatatagaatctgctttggtgtaattctgtggccggccattgattgtttatctttattagcctcagaaattaaaaaaaaaatttaatattttaaaagctgtggccaaaaatacattaaaacagttcaaaagcaacccactatgattgatggttttttgattaatgcctttttgatgatttttgactaacaccattaggtgtaccgacttttgagccgcaaacacttgcgccgcccagtaaaaataaaaatttgagccgggcgcaaatttcgtggcgcaaatttcggttttgctgaacggccgcaactgtccgtttttgctgcgtggcgaaaatgtcgcggcgcaaaagatataatacgcgatttttcgtcactaaaaattgagacactaattataacactattctcccgcgctgctttaggcttcgaaaatacagacactgcctgggctcttggctatttcggattgaatatgttcacctgtctcgcgaccaccttcaactcgaaaaagattggaacgtttgaagtttcgatttcttttcagcataggtaggtaccgtattttctctaattaattcccgtgtacattaatgtacccttctccaattatatccccctttgtgaggaggttgaaaaataaaatagccgggcatataattagaaaaatacggtaattcgttctggtaataattcaatttttacatcgaaaattatctccccatttctgaggaggataaaaaataatatatcagggcatataattagagaaaaaacggtaatttgttttaatattgatatattttttacatcaatacaaaaaaaacttgattttacaattttaagtttatattactctttatacatatatatgtatacatatattccatttagattttggtctacacctacatatgcagctcagctttagctacagccctagctttctacaaaattgatgaagtggcctgaggaggtaccgttccttataacgtatggaccgganttatacttt

SEQ ID NO: 28021 - DNA, 916 bp, Heterodera glycines
catacgcaagcgctttgtgaggtataaatttctcaaaaaaagagatagccatttttctgggatagagtataaatataaaaattccctctaaaataaaatggcgattgtgcacagccctccgtctcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataaactataaatataaaaattccctcaaaaataaaagggcgattgcgcacagccctccctatcatacgcaagagcatttgtaagtgtataaaatttctcaaaaaaagagatagccatttttctgggatagagtataaatttaaaaattccctcaaaaataaaaggtctattgcgcaccgccctccctatcatgctcgagagcatttgtatgtgtataaaa

SEQ ID NO: 28022 - DNA, 1504 bp, Heterodera glycines
ttttcccctaatttttcctttttcagttctttggaatgttcccattgttctctcaaattgattccgtcgaccattgaaccgcacaaattcaacgaattgcgcggcgctttggccaaagttttgtatgacggggcaacgaaaatgaaccgcgcgacatcggagcgtaagggttttttaaacaaaacaaaaaaacatcgtattccatggcaattaatgagaagaaattggttgtttttatcaaccgaacaaaatgaaatttggttgaatttgccgtaactgattcgtccgtcgttcccttcagaggttcttgcgttgatgaaaacgataaaggagatgaagcggaaaatcagcgagcaaccgcagcaatcgacgaggtgaacagctcaaaaagagacgtcggggattatttgtcccccattttggacaccttccccttgggtggtcctttcttttgcgctttttgtcccccaatgtttcccattttgtcaagtcgtcgtccgttggtggtggacgcgctcaatttggtggacggcaagccggagcagcaccagcttggctacgtgcgttccttcttcaattccttggaacgcaacggtttttcgcccattttggtggtcactcgctgcacctttccgtccgaattcattcactgttttcgcgaaaagggacacattttcgacttgcgcagcaaatcgacaaagtgagagaaagcaaattaaaataattaagaaattggcattttaaatcggagggcggggaattcggatggattaacaaatttattcccttttctcagaatccacgacgaccttttcactctgaacgcagcgcttctgttgggtccggacgcccatctgatgagcaacgacgggttccgcgattacgcgccggcgttggccgtcgacccgtcccttttctcgcgttgggtgaagacacggctggtccgattttggacgccaaaaatgacgaagaaagagtccgaatatttggtaaacaatggggaagaatttcaacaaattgcttgaccaattaattattcgttcagttgccaaatgcgtggcacagtcaaggggacccttcgaatggctatcacattttggcagagaggcgacaacgttcgcgtcaatttgtctattgtattcgtacgaattgatgtttttttggtcaataaattgtttgtttttggacgaattttttgttttctctgtgattaataaattttcgacaataccgctgaagctgagttatgctgatcaaaataaacaatacaagaaattagcgctcgaaaaattccggttatgttatagtctaccacccacaaaaagaatgaataaaattgatgcattcgttctctcgtgatggggcacttctaaccttttaaaatggtcaaacccggacaaatttggtataaaaaacatttctcattttatagcttatacattatttcatgagttataaaaaaaacaaattttcgcatgctcgtatctatgtttagtcggggaat

SEQ ID NO: 28023 - DNA, 1146 bp, Heterodera glycines
caaaaacaatgaagccatccgaagtgcgctttgatgcaaaaaccaatgtgtcggagtattgcctgttgttaggctccgtcgcctcttccctcgtccgctcttcagaacgttcccttcaagtgtttttatcccacccttcgcattcgcaattcactcacaaaactgtttccgccatttgctcctcagtgttctcatcgtcagtaacaccaaaaggaggcaaatcagtagggtaaaaagaacagcaaatgaatgtgacaagcgaactaagaagcgccaaaagttccggcacaaacaatcgtaaagtgatgggatcataaacggaactgggcactctaaacagcaaaaaattatacgagtcaataaatcctgaagatagcgagatgatgcaataaaatttacctgataaacccagtttgtcgaagccaaaaatcaatttccgaactgcttgaattacacgcttcctttatgtaatcttggtcgtccggatacttcaagtgttgataaagttggtaaccaaattgcgcaagagttgtaattaatgaaaatgcaacacaaaaaaaggtaaagaaccgcgtaatttcttaagttgagaattatgtttggaaaaaagagttaaaaagctaacttggaaaaggcgaatttgcatgtataaaaggaagatatgtacacaaaaaagcaagaataatataagcaagtgaaatgaaactgggccttagaatagcacctaaatgttaattatgattaaatgcggcttttatggtaaaggcgaaaaatgcccacctgataaaaggaacaatggtaataaaattttaatcagaaaatttttgactgtaatggaaaccatttcaccttaaaaaaatgtattaaacttcgcagctgctgaaagctgtggtaaaattatggcggtgggagtcaacttgaatataccagcgggacaatgtggccaacagggcaatgatcaactggtgacaggacccaaatcatgaccagctccacctatagtattttgcactatcttcttagaatttagtggcattttagttagcatgaaaactgccatgccgaaaaacgactgtttccaaatgcccagttgtccctctccgaaattatggagccagaaaagattttgaataatacgggcttggc

SEQ ID NO: 28024 - DNA, 1724 bp, Heterodera glycines
tcggggggcaattctccaaatccaatagccatttttttttgtattcaaattccaatcggcgttcccagtcgagaattccttttttcgaaaaaagttcgcccaatccgcatcctaaacataatggataatttgaattaataacacaatgaaaaatattacgacctttgttaagctcagatcacgaagtccgtgggttacaataacgaccaacttgcccttgcgttcatatcgacgaaggtcaacgtgttcaccaatagggtccagcaaacgacagacgatatcataagcggattcttcaccacaaagatgaatctgaatattgtaaaacaagcattttcctatggaaacaacgatgggtatagtcttggagaaaaccgaaaatatataaacccggtttgactgatttttgagaggccggacccggaaactgctgttttcaaccagtctggatccggcttctccaagccagtcaaacgagtttttcaatggcgggcagtttccacacaaaaatcagtaaattttaattaatgtataatataactaaataattaaaaaaatcattttttagattaaaaaatgaaggatagtttttcttataaaataggcaaaaaataaataaaggaaatctcggtctctagaaataatactgtttctatgttttttctttaaaaagctatgcagaaaaggaaatcgtcttttttaagtctttgaactaaaatctcgaaaatttttgtttaaaaaagaaatttattcttactgtaaataactaaaaaaaattgattaaacccgataaatcgcaaaggaaaaatgtttttaaaaacgattacgtcccaatttcttacctcatccgcaggcgctcccatcagtgctcttgtccaagcagcacctctttgtgggtctctgagcatttggatctcgtcgatgacacaaagttcaattctatgctctggggacattatctcgatggttgctgaagtgtgggcggatgggttgtccgagtcaacggcaaagagacgattttcacccgtaatcatgtcacaaggaattcctataaaatataaacatcgtttttcaattccttttactacgtttgttttgcctgcttcgttcatcttcatatacacttcgtatgccaacaaacgcaatggcccacaatacaaagcggatttggcctttttaaaatgttccaatgcctcgtaagttttgccactatttgttggtcctttaaaaatcaaaaaaaataaaattaatgcataatttataaacacctgcatgaaaaatgatctttctgttgatttctcgagcaagagggtaccaattgtgcggctgagtaagatcagaaatgacttgaagctctttaagacattccaagtgggggaacacacaacgagcatgttttacgaagaaagggtacaacgaatcgacgctctgttctatgataaagaaaaaacaaaacaaaacttatttgatgggaaaaaaataaattaggcccaaattaccctggttttttatgtcgctgaaagtaattctcaaagtcggctccatactttgtgggctcgcattctctgaacagcaaagcaacctaaacaaaaacatttaattttttggctaatttacatttgaataaaggatcaattcaatttcgacctgaagctctgaaaagccttgtcgaaagagacgccccgtgatgttttgctcttcagcaagcctcctgatatgctttt

SEQ ID NO: 28025 - DNA, 1382 bp, Heterodera glycines
  misc_feature (1316)..(1316): n is a, c, g, or t
ttttcttttccccttttcttctctcctcccctccctccgtccaattcgtttggtttgccaatgtttgctatcacctcctccttcgcttgccgcctaaaagttgtccgccaatgtttggcacttttcgatgtgccaaagtccccttccctttcaatgtcttctcctctccccgccctcgtggccaatacgaaattcgatgccattcgaatagtgccctttgctgatgatgacaaagtctcccccctttcttattgctcatttccccctccgtttgtcccccaatttcaaatgcccccttttttccccaccgctcgtctcaactttcctttccgcttctttcccgcgtcaatttggcttgtccatgtcgaaatccctcctccatgaatgtccctggcccattttctcattctccccaaattcattggtccattccttgcgatgggatgcaatccaagtcggcacttccttccccggcatcccttccccccccctcactaagtgccattggtgaacagacaaacggagagttggcacttggcacacggcgaagagagttttttgaagatttttcataccgtaccaaacccgccgaaagaagggaatttgcaaattcatattataaagggtatgctttgccagttttgccgatggtttgactttctttttgcattttcccccttttttggccaactttcgtcggactttgccgtccaatggtccgtctctcaattggtgccttcggcggggattatcgccctccgggggtgccaggtgcgccccccccccaaattagcggtgccctccgctccttcgacaatatttccgatggacaaacagttgggcacatttcttccaaatttattttcgcactttttgcctcaaaaatggaaattcttttcggtttcccattttccaacctttccgttacggtattttccgaatttcgcccattttttgctgcttttccctttaattttctcttctcttccgtcgcgggggtcagccgccgcaatggaattacacatattaatatttataattcgcagatggcgaaggaattggccaaagggccgaaaaattggcctgcgcattattcacacaaattttaaaaggcaattcgagtgaaaagtgaggtaattttggcgagggaaagggaaatgatggggcaaaacgaaacgaaacgaaccctcgggggaaaagaaaggaattgggggggggggggagagggggggaaacattacacctttaaagcctaccaaacaaggcaaattactctctctattgtggtgacccattttggaagtttattccctatntgcggtcatcccatcgctcgtccatcaatcccctgggggggggggcagatgttgggttgggttggc

SEQ ID NO: 28026 - DNA, 918 bp, Heterodera glycines
tatgattttttgttcaatttaggttaagaaaataggaattggtcaaaatagttgacagattcgtgatcagggaccccaaaaacacccggggccaaattttcatgatcatagattaaaaaaattttgtaaaccaaaagggtcctccccccttttgtttttactttttgataaaattcaaaagagcgctctttgcaagtagcgccttgccgagctgacatttttggcgacatgttcaaaaaaaaattcaaaaatttttcactaaacaaatcagtcgaaatataatcccacagtctctattaatcacgcagtctctaattatcccctgtattctgaggaggttgaaaaataatcccccatgggctataattagagcatatacggtatttctgtgtttcaacaaaatttgaaagaattcaacatattgtgattataataaactaatgctggaataatcaatcaatcaatcaatcaatcatttatacgcaaaagtgtgacgccgaaaaataaagaaataatgaaacaatatcaaataaaacaaacaattggtcacttttggagctggggtggcaaagaaatcaataaataataatgttgcataaaattataaaatatgcaataataaagagtaaaaaaatgcgcacgaaaatgtcaaagtatgcattgcatatgcattatgtcagaaaagtggattatttttaaaggaaattaaggagtttttagggtccggcggcgcaataggcgaagccgggaaaatttgtgatttttagtccgcttttttaacaaatttttcaacaaatttgtgaatttttgagtccaatttaaaaattgaatgcaatttgttaacagattttgacccaaaaatattgataaaaagagaaaatatttcaaatttagcaaaaataagagagaatttttttt

SEQ ID NO: 28027 - DNA, 2016 bp, Heterodera glycines
agtacagtttaatttttccggcaaaagttgaacaggaccctcaaaattatttcaaatcttagaaaacacttaccagtttccgaacaaagtgccaaaatttccgtttatcgaaattttctgaaaatgggaattctgggctaagaattttgccggaaatcatcaattggaaatcggcattccttcacatccctggttagcaccacagacccatgaattttacaagcaattaagtaaaatcacgttcaaattttcagaaaatttactggcctgggtatttttctctcaaaagtctaagaataagtattaaatggctaacttatcaaatgaaaataaacgcaaaaataaatcaggcttttaataaattttttgtacgtggaatgaataagtgttttaacagacaaattaaataaaatggctagtcagcgattcatactttatggcaaatcctatttttattataatattgatgattatgataaggcagcacagatgattaatcaagtaagattctttaggaatcattaaaaattaaaatttaaaaataataataaagtaacttaaaaatacatgaaaattttataaaatattatttatttactattacagtttatgcgcgtgtcatgtgatgcgaaaaatcaatttcaataggtgaagctgatttatttgcaaatgcaaataaaaaagctatcaaaaaacggtcagaatttataaataaactcaacgactttgccagcatagaaatttggacgcagaaaaaaataaggtgatagataaatttttaaaaaattgctaattgattaattataattttatatgattaggttgccaatgaatgcaaaatggaattgcagaaagagcttgtttcaatttgtcgttccgcatgggtacgtttaatattttttacaaattttcggggtttttatttatacataattttattatagacctgcgaggcaaggggtcccgcgtgggattttgcgggtcccagtctgcaatcccgcatttttggaacatgcaagaaggaggggttaatccagcggagtcccggcagataaaatttttttagcttcattcccgcaacggacacgaaaatttgattttttgtacggtcccgcagggtcggagataaaacactaaatattttttgactaatttaataaagtcgaataatattgttaaactcatttttattgcaaatttcattcaaaacctgtttaccgcggagcataacggcaaaagttggacattttcctcattattaactctaaaaaaatagttcaacaaacgatatttagtctaacagatttgtccaaattatttttgatcaaattttgaaagtattaggggaatctatgtccgacaaagccaataaatcgagaaaaggaatttttagaaggtgaggagttcggatactccgtaaattgcggggtcagatttccctcgaaatcgccaaaatttttttggaccaaacttttttaatgtttgtaaattaagtccattatcgatgaaaaaatgttgccaaattgttcaacaaatgatgaacgaattttctatctcagtttaaaggttgatttgcttcgttacgcttgtaaacatgaaacattagagtcgtgtaagttaaaagatgaaaaatattactaataaacattttgcttaatacattatgttgcttcagaaaaacaaaatttacatattttcccgtttcagttaaaacccaagctgaagccgcatataatcttgccaaaactgaagctgtggccaaattgagacctgaaaatcccattcgcattgggattgccttaaattttggcattttttatgaaagcattctcaaaagcaatgcacttgcctacaaaattggaaaggaagtaagtttaaataaggtcgcgaagtttaacttttaatagaaaataacgttactttttttttattaaaggtaaaaaaagtttcttatccatttttacaatattttcaaacgaaattttgtaaaacccatttttttaaattaaaaattat

SEQ ID NO: 28028 - DNA, 1599 bp, Heterodera glycines
atatgtttagcacaaatttcacaccgactgtatcgataaatggtaaaataactaattttactgtgcatcatcagattatacattgttacagggttaaacaacacaataattgtccaatttgtcgcacacagacatttaaaatttcaattctcagaagaggtttttaagattacgtattattgtgaataaattgctttgttaagcaaagccaattgcgcaacaacaagaagagcaagacggacatcgtcaagttgaacaacaagcagatgagcaccaacaattagaacagcaagaagggcagcagcaagaacaaccgagacaagttgaacaccaagtagatgaaatccaagaagggcagcaagaacatcaagagggccagcaagaattaggacaacaactggaccaacagagacaagtcgaacaacaagaagggcataaaggggattggcaagaagaaaccgaacaagaagtagaacaacaaggggatcgccaagaagaacaaaacgtacagcaagaagaagaagggcatgttgaacaacgtaaagagcaaaacgaacagcaaggagaacaactgcaaggagaaagacagcaaatggagaaggaagaaatacaaacagaaaaacaggaaattgaagaaggagaggaggaagaaaagcaccaaatggaacaaaagagtggagacaatgaggaagaaggagaaggaggacagcaaaagaagagcagcaatgactatgaggacaacaacaacaaggagtaaaacatgaataatccaatcaaatgcaaaaattgcaatcgatgagaaagtcattgtgatacataatttattataataattaataatttttaaatagtgaagaggcttaacaatttcccatttctctcttccttgctccaaatatcgtactgtataatttttgtagtcattaaattgtgtaaacattaaaatgattattttcaaacattttgatatatccaacaaatgatacaattttcattaaatccccagacagcatttggaaatttattttcaaataaactaatgtgatgaaccatttttcgcttagatataaagattttttgcaactgtgaaaaacttagggtttgcacaaaacggagctcgcagatgaaatttttgaaaatcaacacaggctgacaaataagcaatattgggttcaaaacccaacattaaaaaaacttaattaattttgcaaaatattttcattatccatgatcgctttaatcgtttttgtaagaaataataatttcttaaattctaagcagtaaatatccggggcggagtgattatttaaaaaccgtctttataaataaaataatatccggaatccattatgtgaatattttcgcaacctacacattgacatatttttattatcatgatttcaattttgataaatttcatcaaatttttacaaaagaaaagaaattcataactacaggtcggacccctgttcttacatattatctcatttcacgataaactttctccaattattgtactctgcagtaccaatttcgcacctcttttttgcacttattttcataattttttataaaacaattttgagtaaatttttgatg

SEQ ID NO: 28029 - DNA, 1551 bp, Heterodera glycines
  misc_feature (133)..(133): n is a, c, g, or t
ttttaaaagcacaaaaaaaagaaaataaatttaaaatacttatactgaaaatccgaaaaagtttgaaactaaaaatgctcaaaacacgaaaatgaaaagttttgcatattttttatatcgagctttgagcttnttctcgcactttaaaaaatgctatttatttattaatgactaagtatttgtctttttgttgtcaattgaagtggaaaattccgaaaattgacatgatttaatgagtttttctcattttgtttgggttttcattggcatatgacgacacgcaattcccatttttttcattatggtcaatgtgccatttagtgcaaacactttgctaaatagtacagctaattagtaaaatcttaacttatctaaaaagtaaagctaactcattctaatgggttgagaatttttataaaaatcaatgtgtgacttgatgagttttttcattttgtttacgttttcttggcatacgacgacattcctttataaggcagataaaaacctcctttaattttttctactatatcttaaggatttaggaaaaccttttaatccactatttaatttttagaaaaaatcttagtacttaactttgctaaaaggaagtggtggcggtaagcggcagacttttttttgtgtgacggacggacggaggaccaaaattatggcgccaaaatgaggtggccaatgaatggaaagtcaaaatggaaaagcaattgaattcgctaatgaaattaatttatggacgatgaaaataggacattaaaagcgaaaaataagagttatgtaatgacattgaaagaaaaaaagcaatgaaattttataatttttatttataaatagtgaagacaaattgaactggtaaattagttttattgtgagtttgggacttccccaaaacggaacgaattccaaaatttgcttgtatgttttttcttttcgaaattcttaattttgcctaattatacattaaatttttaatccgtttgtgaattaaaagagggagcatttgttggaaattcttttgagtatttctttcaaaattatgtctattttttgttgccatttctttttttgttttttcgaaataaaattaaaaaatggaattttaatgctaaaatcctaaattttcggcaagtagcaggttatgaatgtgggtaatccggccttgtccgctgccccattttaagcggtttttgtgctgtccgaatgcccccccccctcccaccgccctttcggtgtgtcacatttgtttgtcacccaaaaaggcgaattgcaacattatcagcaatttgttggccccgggggagggacgaacggtggcagcacgtaacaggacgaaaaggaggagaaaaggggtggggagaggggaaaaaagggggggggaaagggagtctgaggggatgaaataggacggacgaggagcacagctgaggcgggaggaggaggaggtggtaaatggggggtgaaaggtgacagaaaaaagtgcaaaataagcaaaaaagcgccggatattttagtgatagcattgacacgtaaaaactgatc

SEQ ID NO: 28030 - DNA, 567 bp, Heterodera glycines
aaaaaaaaaaaaaaaaaaaaaaaaaaaaaaaaaaaatattttgttgtgggtgtgggttgggggggtgggggagagaaacaacaaaaaaaaaaaacaaaaaaaaaatttttttttttttttttttttttgctggggggggggggggggagaaaaacaacaaaaaaaaaaaaaaaaaaaccaacaacccccctccttttggggtggggggggggcggggaagaattttatttttttttttttcccccccccgcccccccccgcccgcgccccccacaaaaaaaaaaaaaaaaaaaaaaaaaagaaaagagggggggggggggccttctttttttcttttttttttttttttttttaaaaaaaaaaaaaaaaaagagggggggggggggggggggggggggggtttttttttttttttttaaaaaaaaaaaaaaaaaaaaaaaaaaataaattttcaaaaaaaaaaagagggggagggggggggggggggagggggttttttttttttttcccccccccccccccccccccgccggccggcgggtttgtttttttttttttttttttttt

SEQ ID NO: 28031 - DNA, 922 bp, Heterodera glycines
actttctcatatgctcgtttatacatttctttcagcttttcatcaaatggcttcttgtctaaggtaatttttacgttttcctctgctgatttaaaaatttgctcaaaattaaaaagcgaataaaaagcatttttcaattcgtattttttttctttcgcgaaatttgaatcaaaataaaacttcgaaattttgttcaaatatttcacaacatcaattatggatccaagcttctcaatttttcggataaaaagtaagggatttgggttcatttcgaataaatcctcactcttaatggtgccctcagctaaaaaagtcaaaatatactactctattttaaataatatgccaaaaaaccttcggcgttcactgtgaataaatattcatagaaaatttcgaaatatttgcgaaatatttcacaatctgcacgattttgtcctgcattttcatcaacaattttggcacaatgccaattctctctcattaaatacaaaacgccaagatgggcctcatatttctgcgtcaaatattcttttctttgagcatcagtggattcttttggcaatttatcgcaaatttcatgcaatctctccttattttccatgcaaaatttgtcaaaattggacttgcccctcacaaatacaattaatgcttcattttccggctaaaattataattatatgaaatttttaaagaattaaatttgctgtcatggctaaaaaccatactgaacgagaaaattttttcttttctaatcaaaattttaagagatttgaaacaaatgaaataataaatgcttattttcaatgatttttattttatttttttcattattattttgttttcaccttaagaacgttgtcataaaagggataatcataaatggagaagtgctcaaataatttaaaatgaataacttttttct

SEQ ID NO: 28032 - DNA, 1780 bp, Heterodera glycines
tgatattttggggacgaagagaaaaggaagaaaaaaaatttgttgattaaaaatacaaaatttccaaaaacactgagcctaacaatgtttaacaattttcatttagtcgaacaaagaattctgaaaagcctcggcacgatcaattgatggaggacaaatgaaattggggagcaaatgacgaacagaattgagcagatgaagcgcaagttggacaaaaaggcggcacaaagcgcaaacgacgaggaggaggacgaagaagaggtgacggacccccagggggaggcctggattctgtcaaattattctagaattttttgtgccattttggggtaacgtctaacggcatccactcttgtacagcccggcatagaatctcattcaaaatttattacgattcaaaaaaaaaacgctgagggcgggggtgcagggacggtcccaggattttggcttggggggggggtacctcccccggcgacgacctttttttgcttttcacacccgttttttttgtggcgcggtttttccaaaaacattttttgggggacagggggtccgggccgggaaattttttgcggttttaaatgcggtttgttaacagattttgtccaaaaaatgaccaaattttgtgatttcgagccatttttagcatattttcatcaaaaatttgtgggttttttgaaaaatttagcgaaatttcttggaaaatttgggtgaggctaggtctgggggggggtaccagcaaggaaaattctcaatggatgggatgttcgggttccaaattttgcaaatacaatttaagacaaacgttggtaataatgtctagcttgtacccccttcctccttttttgtttaaagaaccaccaaaaacattttccggcgctttttaagggtcgatattgacctgactctgactatacgaattaccaaatttttgaaatttaagtagaatttttacagcaacaatcaaaaatgctcatcattttgaggtcaggcatgggattttaaaacaaattaggacgtaattcagaaattaaatattgcaaaaacgcacgtcaaagtattggtatttgtagatgatgccgccggtggtggtcaccgccggcgcaatgtttgccacgtccacaaaagcgttggggaacagaaacaagtcgacggcacagccccacttcacgcactcctcgcccagcttggcgtagaagtcgatggacggcgtcagcatggtctgtgcgtaaaatagaatataaattttgaattttcaatggtaaaactgttaatagtccaaaaattttgtcctgcaacttttcggctggcatttttcaccgatttttttgaaatttttgctaaattagtgttttttcaaaaacaaatttttcaaaaaacacaccttctccttgtccgtgcccaacagcttgcgctcctcccggttcttcagctggcccggcgcaccgtccagcacgggcaacgacgtgtggaaaatgaacagtttgccggcccggtccgcgctgcgcaacgcgtccagccccgcctggatggtcgggcccagcgcagtttcggtgatgcgtgtgtgcgcaaaattgttcacaatctcgcgcaagcaactgaaaattcaaattttgaataaatattttttggaatttttctttttcaaaaaaaaaactttggtgaggtccgtaaccagaaaaaattcggaggaggtttttcttgaaaaacaacattttttgcttttcggcccctaacattttcggacattttttcaaaagtctaattgtaagcaatatcg

SEQ ID NO: 28033 - DNA, 1352 bp, Heterodera glycines
  misc_feature (358)..(358): n is a, c, g, or t
  misc_feature (1268)..(1268): n is a, c, g, or t
taattcatttaattgcttccatcattatttattattaccctcccctgtccgggtgtatgcatttaactttaattgtttgtcttttcgaacagttccttccgtctgttcttcgaggacatgaacaactcgagttcccccgcgctttccgtgctttacgttgcgcccagcgtgaccacttttgccgggctgaaccccgcctaccgcgtgtacgtcgccagcccaagcgacggacgcattctcgacattgaggcgagaatcgttcttttttaacatttaaaatacctcgcaaaatgaggacattttgaggaatattttgtacgagagtcaaagtcaaattttcgagaaattcgaattctanactttgtcccgcagaattgcttaatattaacgagtggttggaaaacaaaaactgctcaattggtcccaatttcagaactattttctgaatttgactggccctgatggggccgaaaaagaggaaaagccccgctggcagttgctgtacacggccaaaaccgagtacggcatggagcagctgaatgccgaggcatggaacgcggtggcacaacgcattgagcgggagccggcgatggcgcggaaattcaatcggtgggagctaatgaagccattacagggattaatattaactaattgttctttcttaattgatcatcagaaattacgcgcgaagggctgacgcggaatgcgacgcgcattgtgtcgcggaacgcgtgtgtgacattcgcgcggcgcacagtaacaaaacggcactgtgcgggggcggcagcaaaacgcgacgcaaattgaaagtgccgtcgtcgtcggcagaaaaaagaaaggcactttggaaatggatggcacacgcaattagacagcagagaaagagagcaatttgcaatcagccgaaatgagttgaaattgtgaaatgaacagcagaagaataaaatttgaaaaaatgttgaagaagttttattagttttaattgtttttggattttaaaaatgttggaaagcattcagtacagtagcaatcgagttaaagacatcaaaatatgtttgaatctttggcgtttcattttacgccacattttttttcatattcattttttttctttcactccatcaccaaataacacagatgggccatcgtgatcttatggtttgaatttgaaattaatccaaatgcatgtaaaacttgacaattgtttgaggctgaatattagtggcacggaaggcgttctctgatcactcggctgaatttgtgtgtcncaaagcaaagttttcccaatttgcgcaaaataaaattaaatggatgacacaaaagaaagctttttctccaattttttgctgatg

SEQ ID NO: 28034 - DNA, 1341 bp, Heterodera glycines
tgcaaataatgttggcaaataattcacatttttccccaccatcatgatagcatttgttttcaaagactaaattctcgtatttcaaagggattaacatcgtatttttgtaggtatttaaaaatggaatttcttccctttgaaatagcctttttctcaatttgcgagtgaaatttatttgtttgtatttttatgtgtaaactaatgctatcataaagcgctttttttgttgggtcagttttacattgcctatacagtctggctttctctttgatggaggccaataaatgcgttgggtatttaggggtcaaatcttttttggtaatttttttcattggaatacactcgtttaaggtttctagcaatgtattattaaaggatttgtatttatcgtggtaatgtgacattggcgccgcagacacttgcgccgcgacagctgcgccgcagacacttgcgtggaccagactatgagtgacatgagccatgaatatatgcgacgcgacattagaaccgacaatgcatgactgtgactctcatgggcaaaaaataaaatggtaattttaacaatttgggtgagttggcgaaacgtccaattggcttagttggcgaaatgtcatttggtgatatccagttggcattgtccgtacaccgtcgtagagacatacggtttttgtatttttgtaataaattttgtgctctctgtccgtgtatcattttccgtaaaaaaattttccagcctccctatggtttttttccgaaaatttcccgatttcaagccattttgagagagaggaagagagagggggaagaattggttgaaggagacagaaaagagatgcattcacatttctggaaagctctgcaattgaagtgctgctcactccgtcatactacccttacagtgtctcccctgctctgtttcttttccctctttcgtttctcttcctttccccaatgtctcccctgctctgtttctttgcctcttttctctctgttctattccttcgggtactttctgtcatctgtcgtgggcatggcttcgttcgctcatccctttggtcgtccgtctccctcccttttcccctcccccattctccacttcccatttctttccttccctctaaattaatgtgtatctttttgctccaaatgcattttctgctactttttcgtttttgagtcagcaaaagttaggaaagtccgattagaaattttccgtacttttcccgtgtccaattttcataatatcctcaccccagggttgcgactttgaaattcaaaatttttttttattattttcggttagacgtttccctgttttagacgccacgcccggtttttgtc

SEQ ID NO: 28035 - DNA, 1545 bp, Heterodera glycines
aatgaaagtaccaatagcaaccaaatagttgggccatcgctttggtggatccatgccttgctaaaagaggaccaagtcaaaaaacgacttcaaaaatctttgccttccataaatggcctccgagttaacattcatccattcgccaaattcgcgaagtctctgctcaaaaatgggcacaatgcgaccggtgtggtcggggccaacattaagcagcatattccctccacacgaaattgtacgcactaattgattgatcaattcggccaatgaaagaacatcggagggcttaatcagatttaaaccaaaaattaaaaacggaattgagtgccttcaaataacgacgatagccccacgaacgtttgtccaactgaaattgtcaaatacagtaacatattgcgaaggcttaaggtgaaatcaaacagtcaggcaattttcccatttccgtgctagcaaatggcctgggtctgcaattgtttttttttcattttctcgattctctgtccaaatcctaccgtaatgatcctggtaagtcaaaaaaccgccatgctttccggctattccactgccccaacggtcattgaccaccactttttccttcaccggactgaagcatttgaatattcctttattatggaaaaatcaaatccgaaagtgacctttcgttataaagccacgcaaggaattctttagagcgccaataagtgtcgggctgttcccaatccttcgcaaaaataggaagaaattccccaattaaaaaatggctcaatcaagcgaaccccgtcgctccaaatgacttcggggtgatatccgttaacaatttcaagtaattgaggataagaaaccgtctaaaaaaagaacgaagtcccaaattaattattttacaaattgcctgaacgaagtccgttctgtgccttaaacactttaataattaaccccccttaataattcaaaagcgttactttttaacatcgttcagaaagagaggatggaaccaatcgaaaagtgaaaaataaagtccgaaacgaatattttgggcacgaatcgaatcggagagtgccttcacaaggtcccgatgggggccgatcttgcaaaaatggcattaaggaaagaaaggaaaagtggaaacatcgacggcattccaattccacgaagtcgcgcttggccaaagcttcgaatcaacgaaaaaattgcaaaagatcgaccaaacagaaaacataccgtaaacccttcgtgatgctttgaagtcaaaacaaaatatctgaaaattggcattttatgccttatgacttcggtgacacgaaagggcaacgaatcagaacaaatcgcttttcctttctcaccgtgcgcccgaggactttacgatttcggcgaaattatttgcatcgaagtcaacggcggtgaacaaaaaaggtgtttttcaattcatgtgatttttatgcgtttggcttacggatttggcaaagtctgcataggtcgtgccatttgggtagtgtttttgaacaaatctttcgattttgcgtcacgttgtcccttccaataccacca

SEQ ID NO: 28036 - DNA, 548 bp, Heterodera glycines
ataacaaatggtcagcggaatgaataaacaattattttgggagattaaggagccaaataagaaaactattaattatatttatgtattgccaaaaaatcgcgaaaatagctaattttgcgttaagccatttttagtatttggcatcaaaaaatgggaaaaatagaaattgaagtcaaaattatagtaaaggcctaattgatgcggaatttcttcacctgcgttcatttgtcacttccaaaacttgttgaacgcctccattatctaaatttaatggcaatttgttactttttattggatagcttcttgataaaaatcatttctccttaagctaacaataagcacatatcgtttataaaaacagtaaactcaccgaatcataaatcatgaaggtaatggcaacgtcaagacacctaaaacgtttcgaaagcatgcttaaaagtacaaaaacaaatcaaatggcacttacactcggctgaggcgagggacagtgcccttgtaaaagctaaaaattgaaatcgttgaagggatttgtgggggggggggggggg

SEQ ID NO: 28037 - DNA, 1454 bp, Heterodera glycines
  misc_feature (26)..(26): n is a, c, g, or t
tcactgttgaacctcttctaatcacntgttgcattacacttgatcacttagataccccttctaatcactgttgtactacttttaatcacttttgtacctcttctaatcactgttgcacctcttttaatcacttttgtacctcttctaatcacttttgtacgttttttaataacttttgtacctcttttaatcactgttgtaccacttttaatcactgatgtacctctttgaatcacttttgtatcactttttcactgttgtacctcttctaatcacttttctatcactttttcactgttgtacccctgctaatcactgtgtaacaatatttttctgtgcatttttgggttattttgactgtttttaattaatttgaagatttcttttaaattatttaaatttatttttttttaaattaaagaatttcattatttttttttgaatttgtaaaaaaaataatttaatttcaaattaaataattattcaattaataatttccaacgttgtttttaattaataactaccatttttttcgtgttttcgttgttttattcatttaaaatattttttattttattaataataaattacatttttttatttgaattaaatttttataaaaactttacattatttatttttttcgtcattttcaaagcttttacttaatttgaacctttttgttttattaaaaattaataaataattttaaatttaaattaaattatttttgatgaataaattttttgtttcaaattaattaattttattgtccataatttgtatttttttatatgccatctgtttattacattctcatgtttgagatggtgtgcgttattgatttactcaacttttacgtctattgaaaattgttcctcttctaatcacagtttgcacctcttctgatcactgttgtacctcttttaacaattttgtacctcttctaatgactgttgtacctcttctaatcacagttgtacctcttctaatcacttttgtacctcttctaatcacagttgtacctcttctaatcacttttgtacctcttctaacaattttgtacctcttctaatgactgttgtacctcttctaatcacagttgtacctcttctaatcacttttgtacctcttctaatcacagttgtacctcttctaatcacagttgtacctcttctaatcactgttgtacctcttctaatcacttttgtacctcttctaacaattttgtacctcttctaatgactgttgtacctcttctaatcacttttgtacctcttctaatcacagttgtacctcttctaatcactgttgtacctcttctaatcacttttgtacctcttctaacaattttgtacctcttctaatgactgttgtacctcttctaatcactgttgtacctcttctaacaatttgtacctcttctaatgactggtgtaccacttctaatcact

SEQ ID NO: 28038 - DNA, 1739 bp, Heterodera glycines
ttaattttttatctttttttttgtatttatagtaaaaccattaacattttaaaccgcgccaaaaattgtttgcgacgcaattctttgggctaatggtttaattaatcgcatttattggccactccccccccccccccccccggtaaagctcctcattttcgagcaatcgttgttttccgtcatcatcggctgtttacacaataattcttgtccctcccctcccaaatcgatcatttttctctctccaaaagtgccaactttttcctcgcttttccaaatttgcctatttccattgattatttatttggcttttcccgagggcattttccatttgttttgcttctcggttcattaatagcagttctcgaaaagaccaaaagcctaaaagcataggaaattggcgaggaatttgcaggacaagaaataaattaagtcgggtcagaagggggaaacaaatgtttatgaaatttattggtgcttcccctccccccgagggatgtgacagttttaggacgaaaattgggacaaattccaactcaaagtagcgctaacattgactaattgactcaaatcatttgtcagacacatttttcattgtccacgattctctctctcccgcctttccttttgggttaattaccaacaaattcctttctgatgaatgagagtcctaattactataattaacagctgaaggatagttgtggagatctcgagactggacactttcattttgactactaaatgaaaaataaaattcattttttaggttttgcaactgtttggggtgcatccccacacacattcactgcacatttcccaatttacgcgccgatctcatcgcctccctccctccgcccgctgcctttctcctgccaccatcccaattagtcattttttgttggatgttaacgagctcttccccctcctcttcctcctcctcctcccccgcttcttcctcagtccctccccctccgcttcctccgcccacgacttcctcctctccctccgcttcttcttcatttccttctgcagctcttccgccgtttgatcgttcccctcccgcttcttcttcctcttccgctgaagtcgtcgttgtgccgatttggcacgacggtgttggcacatcaatgaagcagcagccgacgacgatggagccaattccggaggatgaagaagaaaacggtaaataatataataaatagggtttaatataatggctatcatccaacaaaaattcaaaaattttcaatcgtgtatattttttttaccaaatactgcatgtttgtaaaacttgaaaatttcaagacgttgatatgatttttcagttttttaacatgcggatacaaaaaaagaatagtttggaagcctaacggagcaaaagaatatgaaaaaggctatccacttaaaaatgtcaagtttaattcagttatctctccaagcacctcctccttcatggatcattcggctgttaatgagtgccgaaatgcaacagcggcggcaacagctgatcagccgcccctttcggcacggtctccgtccccgccggtgtctccgccattcgaagatggtgctcatctcccacattccccttctcacactgctcatgatggcactgatggcggcatggacacggaaagcggcgtggccaaacgaataacggaatcgaaacggagactgagggaagtgtacacgacggaagagatcgacactttggtcaggtgagtgggggggggggg

SEQ ID NO: 28039 - DNA, 1347 bp, Heterodera glycines
  misc_feature (1217)..(1217): n is a, c, g, or t
  misc_feature (1313)..(1313): n is a, c, g, or t
caggaaagtggccaatgccattgtcgaccacgtgtcggaggacgtcgctgtgataagccaattcaaaatcacttcttcccaacactttggcaccatcgggtgggtcatgaaaaaatattttcactatctttacggtacaaaagattacggtagcttatactgtataaagaaagcaaaaaatttattcggaatgtttcgggtaaaattgagaaaaatatatgaaaaaatgaaaattaaagagacaaattgcacacttttgtttatcacattatcgaatatatcagtcttttgttggcaaattcgctgatcactttgcaatgctggacctagggtttcaaaaatattttaaaaattaaaaaattttcaaaacaaaaaattcctcaactgaaaatcgaacgttgcctttctgttcaccttccgcttcacaatcaccacaacaaaaagcaccgcaaaactgatcagcagcacagcggcgatcactgagatgcaaaatgccactgccatggcgtgcagacagttttgtgccagccgaccctccgggtcgtcttgctcagtcagctgggtgatcatttcgcccttgagcaagtggcaaaatggtgtgccaaattttggtggcattttggaacgccgactttggcatttcgaatttgctttttgaatttctgaatgctcattggctcatggcacatccaaatgctaatcttatggtattcaaaattctgtttgctaattgtcatggtactcaacgctcactctctcttgctgtagctcaagtgccttctcaatggcactgtccatcattcgtcggtcaacacttccgccctcgtaaattgcatccatcatctccaagctggtcaccaaatccatctcaaaaaatatatttacaaaaacaggggatactgtacaaaatgctcttgtacactatgcaaccaatattcatcattcattttatcgcccaatgtcattcacaccatgtattaatctaatgttgtattgtaccaatatatacagtacgcctttgcctactatacttcttgataaaaatgatttccttcttaccgaattaatcgtaatattcttaaaccaacagccttcctgctattctagcaggtccttcctataaatttctcaccccctgtttctctcatttctatgactttgaataccatcttaccgtgtatacattgctaccgtattatcgcctcttatccatttanattttcaaaatttttagaaattcagggcctgcatcttctacttttttttttttgtatttttcaattttcccaccctgtcccctcctgttgctgctngtggtccccctgctttgttggtcccatttctctt

SEQ ID NO: 28040 - DNA, 1056 bp, Heterodera glycines
  misc_feature (91)..(92): n is a, c, g, or t
catccattttacctaatgagatgtacgtaaactgtggcatgcatgcatgtacacacaacggcacattcattcaaaattgtgagcccccccnncaccatctaaaagctctctgcttctgttgatgggcgttcaatgacccgcttaacccctaccaaatccgtttccccctgggggaggaggcgattaatccgattaatccctctcccacccaaatcgccccaagccaaccaaaaatgggattagcggatcagcatacacacttccccaccttaatgcaaaacagaagtaggggggggggggctcatcacatcgacaaaattttgacgagcgtgaaatgagtggttcaaactgaggggggggggcgtacttgatctcgcataatcaatttaatgtcaaaaattttttaattttgaattagtcactgtaatttgttacataagttggatcaatatcaatgttcttccttttgaaactttattctgatcatctgtttcactgttctttgctttatgcaatcaatgtgtttgtctgctgttgatcagtctaattaggtacaaatcaaaatttgttttggattcgaatgatcagaaatgcctagataaaaaaattttttaaatttcttttcatttattcgaatcgccaaaaatagttgtttttttacggcattttccattatcgatgactaacattcatcagtcaattagtaatgtcaactcactggccgcccctctgctatcattaaacaatcaatgattatgattactaataaatgcacccaccgtacactttttcgccccttacccacggtttgcaaccccgagaatacggtagtttcagttatatatgtatatgtgatttaaaattcgctcccctccccccaagggatgatgatggtgggatgcttgcggggcggtcggctggtatgaagatgatgaataattcattagcgccagccgctgccccccttttggcttgcccaatctcgaagcacagcagcagcagctaactcacgcaaattattccttactttttgcgctccaatgcgaagactccccc

SEQ ID NO: 28041 - DNA, 323 bp, Heterodera glycines
aaataaatagttgttaaataaattggaagcttttaccccagaaaaatacatccttggaaaaaatcttatgtttttgttcgagttcgggtccggggttcggaattgggcaaatcgagttcagattcgtaatagcatattcaccctcgaggcacaaaaatcgcgaaataggcacttaaaaagggaaaaaatgcacaaaaataggcaaataaaattttttattaacactttttagcacaccatcccaaaaaacgagatgtgtaccaataaatagagagtgccagagaaaaacattatcttttttctcatattttttgtctcctttg

SEQ ID NO: 28042 - DNA, 964 bp, Heterodera glycines
aaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttgggggactgcccgaaaacaaaaaaatcgattttttcaagtgtccgtttggggtactcaaacaattatggggagcaaaaatccaacgcagaattaaagtacaggctatagggaagctattcccgaaggattcggtctcccataaatctgggcgcatcggtttggggggactgcccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggtttggggggactgcccgaaaacaaaaaaatcgattttttcaagtgtccgtttggggtactcaaacaattatggggagcaaaaatccaacgcagaaattaaagtacaggctatagggaagctattcccgaagaattcggtctccccataaatctgagcgcatcggtaggggggac

SEQ ID NO: 28043 - DNA, 1078 bp, Heterodera glycines
tgggcacattactgaactgaaaatggggggaaaaattaaccccccggcccattttacatgaaaaacactcacagcatacgaattgccgctcgtttcgttgagtaaaatcgatttgtcaccgccgcggccgaccaaaaaataattgttggactgagaatcaacagcaaaagaatggttattttgttcagcgtcaatgtcaataatactcattttgtaccacttaaaatgagcaaaatgtcagttggaaaagcaaatggacgataattttggatgataaatcaatggcaataaaagagacaaaagtgtgggtattccgagagtcaaattgtgtgtcccaagtctcaaaatgaagacaacagatcgtttacccttcagtcagcagatttatgggtacttttcgcttttgtgcctacacctcaaaattcaaaggggcgcgctgaagggactttctactatttccatagcataaagcgataaagctccttttttaatcaattttgcttcataaaataccgtaattaccgtaatcattgtgactgtttcgagcattcggcgcgtttgggaacatcgcccgtccgtttggcgtttgttcgttggcattttttgtggccaaattagtgacggatgagcagagcaaaaaggcaaagtttaggaagaaaaaatgtgcgaagttaaaagccattttataaatcataaatttttatgaatcgtaaaagtaaatatattttttcgattatgctaaatgacaaaatcatatgctaataaagcatcgattgccaaacgatggcattggcattggcatcatgggaaggccatttccaagcaaagtgccttattgacggaagctattcattttttagaaacacatgtaaaatgatgaattaataatgaaatgttggtgattttaatatcaaatggcattggaatgatgtcattgaattagccaaatttaaaaaatattattcacacaaatttatgcgtagaaaaatggactgaaaaatcgttattttataattaataagcaactaaaaaggtaagtgggttttatcccaaagtcaattaaattcccaaaaaaaaa

SEQ ID NO: 28044 - DNA, 1006 bp, Heterodera glycines
aaagaaagacggaaataatgacaaattatgcgattgaccttttggcacgcgaaaaaaaggcatttgccattggggagagggaagagaatggcacgcctattaaaacacaacaaatcattggtggaggttaatgagtgtccccattaattatcagaagtgaaaacggagacaaaataaaacaatcaatggagagagatgaaaggaaacgccgacaaaaattaatcccattttgggccaaaaattattactttatttaaatccaacaaaaaaaagaaagcatttatttgcccagccgttcattcgtactttctgtgcactttatttaggaatgcttcagcgaaccaaaataaaacggggaaagacaaaacaatgtcaaaaaacatttacaaatcgaagccaaacgaattaaatttaaataatttttattttattaattcgtattttcctttttattttattctttgagagaaattcgcattcttagaaaaagaaaatttaaaaaaaccaagaaaatatctaattaaaatatttgaatgacccaaaggtaaaaaaaacattcaaaaataaaataaaataaaatggggtgagaataataacacttttgaacatttaaatgtttattcaattgcgtttcttttctttttttgctgtttttcacgtttttcttctgtgttctgtacattttcccacaccgctcactttgctcagtgtctgtctgtggccaacgcggccacaaaatggccattttttgttagcatgccctttataaataatatcctttttttctcttccattatttttattgtccgagtatctcaacttttaaatccctcaataaacttttttcttttggatatagcgttgacacagggaaaagttttcaaacaattcaaaacctaatacactaatgttgtttaattggaaattaggtaatggtgaataattcatagataaattacgaatttatgtggcctaaaaataggcataatttcacagaaacggttca

SEQ ID NO: 28045 - DNA, 639 bp, Heterodera glycines
tcagctgaacgattgggtaaattactaggatctaagagatcaatctcatccataagcgttccgaaaggaaaatactgtttgatttccgcaacaatattattaatcaatttttcccgaagggctttattgaattcaggaataggaggggaaattccaacaactagattctcttcggcagtcgatcgtgtatgtgcttgttgtcttaacatatattgagcatgttcatatcttttgccatcagttgcacacagaaaatcagcctcatagtctgagttttaattgccagtcataaacattcttatgacatgactgaaaaacgatgagcaaagcaatggattcccgtgagttttttatcatgatttatgaacttttctaaatgagcaaataaaccacctcgtgttccacgcattacagaagctccatcactgataaacccatataatttatgtttgattatttccgttaaaccgtcttcatcaaattctttttcgagctgttcaaacatatatactgccttttcagaacgaatatttattagtttgtatagcaaaacatgaggataatcgtcaaaaatgaagcggaaaagcacagttaaatacatattctgattattatcggatgcagtgtctaccaataaag

SEQ ID NO: 28046 - DNA, 1502 bp, Heterodera glycines
caaaaaatgttttattacggctaaaatggtcaatgcacattcatcactactgttgtgactgctgtttcttgtccgccgaaaaatttgaagaagtcagtgaagaagtggcactttgttgacgtgccaactgtcgacgacgttttgaccacatttcatgctaaatttagggcaaattgtcggctccaaaaaaatttgataaatcaatagcatcaaaagaagacaccaagaataatggcatgtaaaatgctttaaatgagaatgctttccaattaatttttggccaattccccaccccgtcaaattcaaaagcgtaatgcaatgtaataaatgtgtaaaatgtaatgcattgttgggttcgtacacagtcctgatcctgcggcagttccagcgtcggcaccaggcttggttccaccttgcttagccaactgtggttcaacgcctgtgacgcggttggtcgtttgccagggtccaactgcagcaacaggtcgagcaagtcgagcaccggatccggcatactgtaataaagaggaagttggtggaattgaaaaataaagcgttagtaaaaaaataatcatttggtcgaacaatgagaatttttcgcgcagcttccgcgggtaaattgtccgttgtcgcattgtcgaataattgggcaatttcaacactcctggccaaacctcgggcgaataggagccacaaaattgagaaattaattccagctgttggtgttcagattgtccttgaaagacgggctttttggtgaaaaattcggccaaaatgcatctaattgtaagtaaaaaaagaaaaatttaattaaaaaacaaataaaaatttacccggcactccaaatatccacgcctggtccataacttaaaaatactttgtttaacaataagatgaatggagctttcaaatgccgactgctgtcactgtaactcatcattcattcacctttcttcgcccagcaaaagttcaggtggtcggtaccaaagtgtgatcactcggtttgtgtaaagccgtttgttgttctcctgatacagtcgtgcaagcccaaaatcggccagtttcagttggccactaaattgtaaaataactaatttaagtcattaaagcgtcatttttacattcgactgatcaaaatgtttgaacatttgaggtcgcgatgtaaaaacccgcgcatatggcaataactgagagccaagagaagctgcttcatcagtgaggcaatttgcaactccgacggattgaccgattgggagtcgagcaggcccatcaggtcgtggtcaacatattcaaacaccaggaaaaaggaggaggcaactgaagggagaaaaacagatagaacgatgacagcggaaagcgacgacgaattaattttacaatagtaaaaagaataaacctacaatttagcaaggtaaattcatatttctgacaattagccggtactttcactcatttaagccggcactgtcataaattccatataattttaaaaaatcagtctc

SEQ ID NO: 28047 - DNA, 1448 bp, Heterodera glycines
  misc_feature (7)..(7): n is a, c, g, or t
  misc_feature (1377)..(1377): n is a, c, g, or t
attcctntttggaccgcaaatatcacaatttttattttcattgtcacaatcgctgcacgtgaatcgagcagataaaaagacaactttatgctcgaattttccctcggaaaaagaattatccgtctaaattcaatttaaaaatttgtaaattagcttttttcgatgcttactgaacattcaatatcatagctaacaatacgatatcttggtaaattcttgggaatattaattttcttgatgtaacaactctctgatttggcgtgttttactttgcaaacgttacagaattttattcctaaacatgtgaaaaaaaacatttttaaaagaaacattttaccgcaaatatgtttgttacgagtgttgtattcgctatcacataatgtacaccttctgtataatttgcaagctaattttagatgattttgaaaacagaaatcgctaaagaaaagtcgattacattttaaacattcaatgggctcacgcccttctttttcacatggaaaatttaaacctaaaaatttttataaattattattacccgtccctaaaataataccccatccgccacaacgctgacatttaattacacagttgaccgtgtgtctaattttttctcggaatgtctgttcacaatatatacaataataatgttttatgttgaaaaattgttttacgctttttaatcctaaattttttttgtaataatctaattgaaaaacacgcttaccatcccagtgatcattctcatgaaaaacgcaaacaatgtatttttttggtccgtctcccttgtatattggttttatcccccattcctaaatatatttagggaaaaaataatcttaaaaatttacctttgtaaaagccgcaattaaaaattttccgggaaattcttggttcaaatactcttgaatttgtctcaactcgtcaattccatagtttttcttattcggttcaattttagcatttcggatcaaatcatccacataaattcgttgtcgtttagcgttactgagaattcttcgaaacattgagtacgaaatttcagtgcctattgtttgatatagttgactcaaaacaacactataaaaaagacagtatttgtctgaatttttgaccacaattcttccattttcttttacatcgaaaaatgttgatgtattgatttttgacccttaaaatgttaaaatttgttaatttaaaactgcctctatgcctgatcccattggaacggagtaagttgtaattatcattgttatttcctcattcaaaagatctatctcattaaaactctgctggatatggtaaaaggcctcaagaacaacatacgggctaaacttctaggtgggataataagagggtcagaaatagcctcacaanataaatcatatgaaattttttctatttcccatccattttcatttttttcattgctttttcccgtcagtaat

SEQ ID NO: 28048 - DNA, 1123 bp, Heterodera glycines
catgattttttcatgttttgcaggtgcccgacacaaattatttgtttcttggcgattttgtcgacagaggcttttactcggtggaaacatttctgctgttgttggcactaaaagttcggtatccggacaggtaaaaacaaatgttaggcattttgcatggtttccatctctgtagatgtgtcagccctacgcctaaaaaaacacggaaatcagggtttcaaccgagttcttaccccaaatttccaactttttttttgatcctaccttagaaaatttcggtccattacagtcccgacaattacactctcgaaacgcattatcgagtcaccctaatttcatttgcagaatgatgttgatccgaggcaaccacgagtcacgccaaatcacccaagtttatggtttgttggttgatttctgttttaattggaattgaaagaatttgtcccaaattttccaggcttttacgacgaatgctttcgcaaatatggctcagcggttgtttggtaaaaaaaaaaattttttttcgaaaaatactccccaaattaggcgttgctgtacggaggtgttcgactgtctgtcactgtccgcggtgatcaatggtcgcattttttgtgtgcacggcggtctctcaccgtccattgaaaccatcgatcagatcaggaccatagatcggaagcaggaagtgccgcacgatggtacggggaaaaaattacaattttttttgtgattcaaccaatttttctactatcgcataatcagagcaattctcgggagggactataaattgtttcagcctcggaaacgactcattgtcaatattcgtccgtttagcatatatttttttaaaaccttggccaaacaaatgattttagcgattaaaaaaacatttcggttgctcacataagtcaattttttaaaatatttttcaattttaaggcccaatgtgcgatttgttgtggtcggacccggaggtaatgtacataaaaaaaatgaatgtttgaattttatgtgccattgtttttaggagtcggttggctacggagtgagcccccggggcgccggctaattgttcggttcggacgttgtgaaaacgttttgtgaaaagaacggcattgacatgatt

SEQ ID NO: 28049 - DNA, 1270 bp, Heterodera glycines
aaatattaaaacaaggaatataaaagtaccttaatcctagcatataaaagttatataagaccccagctcaaatacgcatccgaagtatgggatatcgccgtaaaagaatcgagtaaaagaatagaaaagttcaaaaatatttcacaaaagcgcattagggcataactcatttagacacaaaaatatttcgaattttcatcaatatcacaacgaaaaacatttaatcttaaaaataatgatgcaataataattttctgcgataagtgcaattgttgccttgcgctatgctcaataaataaataaaagttaatttaaattcacatttaattaattaatttagcttattaaatacaaaagtttacctccaatgatgattattttgcaatttcgtaaaataagcgggatttacattttttttttattgttcagagaaaagaccgggaatgttggccaaaactgttgtttatttgttagttttggctttcctgagttggttttacgtgttgggatggcatatttcactaactcactaattggatgactgtttgtctccccctccgcagcaaatggtcattaattaattaattaaaggcaccactccctcttcagcagcagtcattccgccaaccccttaggacttcactatctttcgtttaattattcgtcggcttgccgaaatccaaactcaccagcagggaataatattttcacaatgggaaaaatacgggaatttaattttaaaataatgacttttcatttaattacattaattaattaattattgttttggccaatgggtctttttggcggcaaagtctcaatgtgctgacacaaaattattatcaaaatgattaatttacgaaattttctcccgcttctcttttgctctgctttgtgcttttctgcgacttttcgctgccgaaagtgacaaatgccttggcaaagtgtgccattcgtcgactggcaatttgctgactggcagaaattgcatttaaatttaacacttaattattttattccataattctaaagacataagctccacgcttcgtccacttgcggtacaaatggatttttgaagttttcgttcagtggtcaaatttatgtaatttttaaaggaattcacaaaccgcagcaatattgcattgcttcatcagaaaatgtacacaaaaagcacaaaaaacttttttaaatgtttgttttttaggtgaaatgcctttggtgtgattcgcgtcattctccggcggaaggcaaaaaattgcaaattatg

SEQ ID NO: 28050 - DNA, 2018 bp, Heterodera glycines
agaaagagcaagagagagactgtgcgagagaaagaaacatagagaagagagcgggagaaagaggagcgagaagagaaagagagagagcgagggcgagagagagagagagggcgagatgagaaattccccctcattatatatttttgaatttataaattctgtaaattttcagtttgaattcggtgaatttttaaaatttaattcgttatatttttcataaattccaatcacctgtgttcgatagttggccttgtattgcataatgtctccatcaacaaatggcgaaaatgccaacatttgtgaggcgccaatttggaacatttccagggaaaagggtcaaaaattaaaataaactatatttaaatagaattttcaaaaattttttggccaaccgatgcgcggccgatgaagcatcgccaagcaacagccaatgccggcctcggatgattagcccattgccgtcctcgcccggctcgtccaaagcttcttccacgccgaatccgtcatcccaaaaagcgcggcgatgaagctaatggaaaaaacaaaaaaattctgaatctttgggcctaattttgtcatttcaccccccccccccctctgattttcacgatccaaggacataacgcgaaaatttcattaaattcaaggacacttaaaatttatcatatgcaataaaaatagtatttttcgccagaatgaatttatccaatatttttttttgttcatttttcaaggacatctcgaattcaggaatatttttaaattttcaagtaagagtgtcctatttcaaggacgtccttgtcattcacggacgaatggcaacgccctgaacaaacccttttaaaaattgtttgttagtgcgctgcaactgttacagtttacggcatgtccaagaaaggcaaacagataaatgctctgccgaaaaagcatttaccgtatccccgcttcaaccatttccactaccgcccgcccctaccgtaccatcaattcgatttgtccgtccgccagtgaagcgccaccctgggaccggtctgtcaaaatgaccatccgcgttttgtcgtcatgtacataaattcggctaaattttggggaaagttttaaaaaaaaaattaattaggtaattaaattttgcctgttcactgggtaataattggctgccaccggttcggtgccctcaaagaatgacgaatcattgcggctgaaattcaaattttactagtacatttcataaaagtgccattccccacaaattttcaaaaatcatgaaaatttttaaaattaaaaaaataaagaatatttaattaatggaatactttaaaacgaaaagactcagatttagattttgaagaaatatatcaagcaaaattcccaaatattaaaaaattaaaaaaaaaatccttcgattcaaagtcttaggattccttttttgtcaaaaatttttccattaaaattctttgaaaaaattaaattttttcgaattaattaaagttttacatttctttaaatattttttagatttaaaaatttataatggcaaatttaagaaacacgtcaaaactaaaatttctctacttcattaaatactcaaataataaatttatttgtttatttaattaattcaaattatttcaagaaacgataaaatcatttaattaatgagctaattgttttctcaccgtcttttcatcatttgccgtccgtttgaatcagtccaaaaaattccttcagagtttagttcgctcattgtgtaacgtgtgatcacttcaattgttttaaggtcactaaattaagaccaaaataacataaatttgcccaatttaatatcaaattcattaattcattaattagtccacctcaaattttttggaagaggtcctactgtaaaatcgaattcaatgtacggttttccggcaacaagtcgaacaacttggcttatccatggcgaaacaatttgtcggacttcttggaccaacaaaatgtgtatttaattataaaatttaaaaaaaaaattcttaaat

SEQ ID NO: 28051 - DNA, 1488 bp, Heterodera glycines
tagagtcagttcgaatttctagttaaaaatcaatcaattttcattgaattcgaagcgatccaccgaaaatcggcttaattaattgagaaagacttcgtctgtgctgctgaccacatttgcccctccaaaacaaaatatatttttaacttttttggctttttgcatgaactaataaatcataaaacacatggccaagggaaaaatggagggggaaggggaagattaagcatgggacggtgaaatttgatcagccaaagtttggaggaggcgaagaaaaccgggggaaggcgaaaaagacagcagaaaataaagcaaaaaataaaaataaaaagataaagataattaaaattagaatttgaaaaaaaactttaaaataaacaaaaataaaaacactaaaaattactaaaaattcaaaatcataaaattatactgttgaaaagcattgtttttaatgtttttcattaattaacttatcattacttagtattttggacgaaactattcacagcgctggaagatttttttaaatatacgatttattaacagattttatactaaaataagcgattttaaaatttttcgggcctaaaaattacaatttttgtactaaaatcaacgaataagcacaaaataatatttcatgtcaaaataagtacagttggcagctattgtttatatatatatatatatattttttttaaatattaagtcacaaatcaaaaacgtacagaaatgcgtgcagaatgtcgtacagctcctcgtccagcgtcaatttggacgcggtccgatcgcccaattcgccggactccgtcttgcgcattggcatccgcttgttcagaatgatgctcgagcggcgacgacggtccgtcagcgggtgaaggtctttgctgaaaaggcaaaaaacgggcatcaaagtgagccaaattaagcaaagcaataaaattttgaagcaattagtgccacaattgcctggagtgtgccgagtcaaatggcgccgccaaagtgccgccaacgctcggactggaccgaattggccatacatcggcactcttttgcagcacgacagccgaaaggacagtgcaggcagaaggcgggttgccgtccagtcttaagccggttgaaaatcgccaattaaattattattaaatttgtacttttcatcggttgaggctgatgtttgccgctgtccgtctttgtcccgctgcttttcatctacgacgccgttttcggtaaaaacggcactttttgcccgaggcaatgaacgtgccgaagctgaagcggaactgttcgtataatccttcgtgttgcaacattcagacaaattcaacggctcaatcccttcacgttttccgggcgatgaatgaaatcgctgctgaagacggctcatttatttatttgtttatttattatcaattttctgaaattgtttttttttattaaaatataaatatttatttaaaaaatataaaatatattttttaaatttaa

SEQ ID NO: 28052 - DNA, 924 bp, Heterodera glycines
ctccccataaatctggacgcatcggttcggcgggacttgcccgaaaacaacaaaatcgatttttacaagtgtccgtttggggtactcaaacaattatggggagcaaaaatccatcgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatat

SEQ ID NO: 28053 - DNA, 1255 bp, Heterodera glycines
ttatatcatattttcaattcattaatttttttgtttatattatatttcgctctctcaccgcataaaaaactattgggtgggtatttgttccattcaaatcgaaaaattgtcgtctatactttatttttgattagggcatttataagttcaactacgtcatcattatcactgtgtattaattttattaattgatttagtttatcgttttaattaatatcagtaatttatttttacgtcgtgttccaatatttgcgttaatataaattgattttaattcagttttataagccaactgaataagcataaaatatacgttccattatccaaagtatcatagctattccagatgcaattttgttttggaatctgatcaaataatctattttgatttctttttattgttataaatttaaatggaaaaggtcagttttggcactaatcaaatcgggcaattctcatttgcttttttattttaaaatatctttttggtttcgcgcattctcccttgatttcttgtttgagctatttactaactctagtgcaagcggactggctaccaaaatttgctaagcggcaggtaaggcactcaattaaaaaaatgattttataaaattatagccgtgccaacatcttgctatgagctttttttaaaatttaattggaaataatgaattatttaagtattataatgcggctcgcggcatgacttacgaagtgaagttgcgagatttggtctaagtcaagagggcctacctaccccgtgaggtgcactgcgatgcgcataaattttagtaatttaataaatcttaaatatcagaataaaaactaaattgaaagttcacattttttattttaaataaaaattaatatataaatatataaaaaattaccgtgacaaatgtgattatattggtaaaatatattaaaaacaaaattaatcaaaaaattaatttcttttctttaaaatgatttaaaatttcaaaattgcattgtttttcaaaaagcttttaatacaaaacccgagcattgagtagactcttcagaaattctaatttaaaaaataaaagtcaaaaaacattttaatcaataagataagtttatgtgtattaaaaaaaagagctaaaagatgtttcgaaataaggactcataaaaattaatggtaaagtaaaaataataaaaaatttgcattaaaccagcgacgaatacaattaaaaaaagaagttacattaaaaatgtaattaaataaaatttttgt

SEQ ID NO: 28054 - DNA, 1655 bp, Heterodera glycines
  misc_feature (117)..(117): n is a, c, g, or t
ttaaaatttttgaccgatttcattaaataaggcaatgaaagccgcgccctcgtaacactgggccaaaaggggtgcctgatttgtgctccaatttcttcaatagaagctccaaatacntgcattcaagttgtttttctaaataaaacatcattaatttaattaattgggtaattaataagtcacttttttaataattggtattggattacaatgaatgtcttattagtagggctgggaatttaagtcacgaaataacaccaaaaagtcataaaaacgccaaaaagtcacaaaaatccaaaaaaaaggatggaaattagctgatatccataaaaccaagagaccagaatttttaaactaccgggaccgaggctcaggcttagacaattgaccgggcccaagtcgaccggttcaaaaaaagcctttaaccgtgaggtacgtggcttttttcaaaatttgttgaatattgttttaaaataaatcttttattttagctaggaattcattaatttaaaagagttagaatatatacccatatttttaagctttacctcaagctaattattaggaacaatccttttttgattaacattaaggtttccattttttgtatgaaagatttttttaagaattcggtacaattagagttcgtaagttatttttcgaaattcaaggcaaacataaaattagattttcttaaaagtcaaaagtttggctttttttcttctttgatattcaaaacatttttaggcattttttaaatttttcttctcaataattgcggaaatttctgtcggattttaattgctttttcaccggtcagaccgtttatttcttcgcttaaattcaaattttgcctcaaaaagtaaaaaaaaagacatgaaatagtcgtaaaagtgccatgtttgaagcttttaaaagtgaaaatatttttaagtcattttaaggccattttgagtcagcagaaaaaaagtcattggacttaaattgaaagtcctaattattaggggagaaaatggtttttattatttcgtactgaaaattcgccaacttttttcccttctcaaccgacggacctaacttttgtaaaggattttgtcattaataatttttgcttcaaatgagccttttgggcaattaatagggctttaaaaaatttttcgtaaaccctaaaaaataactcatttttcatatttactttttattcattctttgattttccccaatttttcttaccaaaatgcaaaatttcgggaaatgttcgttcaatggcgtgtaaaacatttgtctgcacaattacgttgagtttggcctttatgtgaaagaaatcagcagtgggcgttccgtagcaaaaaatgccttgaaaatacgcaaattttgggattaattttgaaagtgcgtcgaaatgaactcggtcagcccaatttggaatttttctgatgctttccataaatttggctgccaattttgggtcggcgcagtcggcactggcccaattgatgccatcttcatgattcaacaacagaattaatttcttaattttaattaatttaaaattgcatagatacatttcaaaatgccaatatgtattcatatgtaaaacgaaaacatataagaatttttttaaatacttaaatgatttttgaatttctattttt

SEQ ID NO: 28055 - DNA, 1053 bp, Heterodera glycines
  misc_feature (977)..(977): n is a, c, g, or t
  misc_feature (1030)..(1031): n is a, c, g, or t
taaaatagataaaaaaaaataaaacaaaaagcgttcaatattaatagacttattttgaagcataaaagcaacaatttccgccaaaatttactcaaatgcatcgacgttacgtcgctaactcgcttcagcagccaagcaccataacgtgacactttctccaatgtcagtttgtctttgatccgttcattcaccaattcaaatggatcggttgatccttgcagtataaattgaataatgtaactggcagaagaagcagtggcacagagaaatgcctaaacaaaagaaaaggaaaagctcaatcaattagtagattaacggaatgtggtcacaccttcttcaaattgttgacccattccaaatttgttggagaacaataacaaaaacaacgcaatcgcttcggctgtccgtcgttggtcggagaatgcaaccatttggtccaaaaaatcctcttcgaccctctaaaagaccacaaaatgaggaaaaatcctcagatatcgaagccatgcatttatcgaattagaagaaattttaagaaattataccctcaattttgagaaattatagcctcaattttgaaaaatttatgtccatcgatttttggtccatattttatggccatatttcgcaattaatccatatttttggaagccttgttataaaagtgccaaaaattcataaaatcccaaaaagtagaaaaaaaaagtcaaagaaaatgcatgttagaagcttcaaacaaagtgtagaacactttgttatttaaaggtcatttaaagtcagcaaaaaaagatttaaagtcagcaaaaaaagatcattcgacttaattcccatcccgattaataaagaaacgtatttaatttgttttcatagaaaaaacgctttgcgcaccaaacttataaatgttgttttcttttgacataaataatataaattaaagcgtaattctatgcgtattaccttcgttttgtttctcatgctanatcttatttacaatttcgagtaaaccaaatcagatttttttaggactaacatnntaagaaatgattgatgaactgc

SEQ ID NO: 28056 - DNA, 1183 bp, Heterodera glycines
  misc_feature (40)..(40): n is a, c, g, or t
  misc_feature (1164)..(1164): n is a, c, g, or t
ttgggaaaaatttgaaaaatggctattcttttttgctcancagtataggattccaaccgcatctcagaatattacgccgatactatcgttctggaattgtttctctgcgcgtttgttgggaaaaatttggaaaattggctatctcttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgttttggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaatttggaaaattggctatctctttttctgctcacagtaatangaattccaaccgcattctc

SEQ ID NO: 28057 - DNA, 999 bp, Heterodera glycines
tttatatagttattcaaaataaatcactcctaagtagaaatgtgtgtgcttattagtgaaattactcaagaaatggacaaaattaaagcatattttatttcgttctgtatgcacttaaaaatgaaaaaagaaaaaacaacctacaattttatggagaggaattgctagtttttattattatcgacgcttaatgtaaatattatctccatgcggatatcatgttttataattccaatccatttgctaaatttgaaaaagttgttaagcatttgaaagcttctgggccaataattaaaacaagccgatatttatatagttattcaaaataaatcactcctaaatagaaatgtgtgtgcttattagtgaaattactcaagaaatggacaaaattaaagcatattttatttcgttctgtatgcacttaaaaatgaaaaaagaaaaaacaacctacaattttatggagaggaattgctagtttttattattatcgacgcttaatgtaaatattattccatgcggatatcatgttttataactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacatcatggccctcctccctcccttagtccaggcgttggcacgttattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatcaa

SEQ ID NO: 28058 - DNA, 1016 bp, Heterodera glycines
  misc_feature (983)..(984): n is a, c, g, or t
ataaggcatcggttctgctgcaaaaggcatctttttcgcgtttctgcatctgtcactttgttgcactccgaggcgcaatgctggccagggcagaacaggcaggaaggaactcgcttgtcatcagaatttctgactgactgagcaacggaaaaaactcgcgcattttcatgccgttctggtcgctgaggtcgatttggccttgcttcgtgccgaaatcgtgtttgtctgtcggcatttgttccgcgcagacaccgttcaacctcttctctgactccgagaactttggcgagtccagctctgagctgaggagtaccccatgggatgcctgccgcacgttccattttgacgagttccagtggacggcagtttgctgcggatgatttggtacatgaatgggctgtcatccggcatgttgaggttcgaaagttggcggcacacacgttccaaagtctcgaggaagtgttgcagtgatccaacgctatcgtccaccgaccgaagattgatcagttcggactgaagtgcctcggcaattttccgtggatccccgaagagtcgcctcagtgcggcgatggcatggacgtaattttcccctccacggtaggctgtaacggcgcgagcagcctcaccacgtaagcacccgtggaggtaattaagtttgtcgacgggctcgagggtggcacgatcgacagcactctcaaaactttgccaaaaggaaggccattccatcggttcgcccgaaaaaatgggaagactaagctgcggaagccgagcagtggcatgaggagcagctgccggcggcattggcatattaagagcattggcgaccggtactggaggtggctgataagcatgattcgcagcagccggctgctgaatattggcaccagcagcagcattgatcgccacaggtatggctggcacttgtgcaatggcttgggtcacagcagctgctggctgctgtcctcccgctggcatgacttggnntaggtggatttgcgagctctgctgctatgtga

SEQ ID NO: 28059 - DNA, 1076 bp, Heterodera glycines
aatttagtatttctatcaacatttcttttcaattcaatataaatttagattagttttaattctttttcttcaaatatcatttttaataatttttaatttaatcgatgcattgaacgcgttaagacgagctatacaaattagtagttgaacctttaatttctcaaataattaagaaaaacttttaattataaaggggcattgtaatacattattttgactttaattattggattaaaaattatctaattactcctccttaaattaatactttttttgttttgttttaagagtagtatttattttttgtaaattttaaatttacaacttattttcttattttagaataaattgcatttattaatatttatttatttatttttaatggctaagtataaaaaaaaccctcaagaatttggccagcaaataatttgggttaaaaaaaaattcttgacactaatgaagattgtgaatttaaaaattttaaagatcaaaatatttttatttttttttgtttttgttcttttgtccttccagaaaatttttatttttattttaattccttttaatttcttgtttggttttttcttttgtttgatttttttaataatattttgtgtaaatttaaaaaattgttcaaatgttctataaaatagcctaattttgaagacattgtccaaataattttctaaaaatcaataaaaaacgtaaagaaaattttattcattatgcatttataatatttaaatgaagcattcaaattttttaaaataagattataataaaataaaattaaattattaattatatattattatttttatttatttttttaatattgtcataagagctctacgaacctcagagttatcttgctggaaaatattaatgttgttagttttttaaattttcttgtttacttcaaagtttcttttttagtgaggatgaattagtttttctcaggccaaaataatacaacattttatggttattccattatacaaaacttttaaatacatttttagcctattattttaatgaaaaattatactcgaatttaattattttatttttattat

SEQ ID NO: 28060 - DNA, 818 bp, Heterodera glycines
ttttgtccttgccattttcctcctcctttttgtccttgccattttcctcctcctcctttttgtccttgccattttcctcctcctcctttttgtccttgccattttcctcattcttctttttgtccttgagcgatgggaatttaagtcatgaaaaatcgccaatgtcacgaaaaagtcatacagtgatggaaaaaagtcttgactcaaagtgataaatttgtaaaatttaaaattttgcttgtttaagtcgacttattatttttctttttgtataattattaccctcaactacacacaacaagaaaatttatttgactcattcattcccgagattgattcacttgatcagacttgactcaaaaaaagggcagaaaaaagtcttgattcaaacatgaaaaaccaccttatagttcacttaaaaccctgaaataattcaggctagcttaccttttgatactgatcaaaaaaggcttttacatcaacttgatcagatcactccttcatggtgatctggaaagttaaaaatggcttgaaatcgggaacattttagaaaaaaaattcctaattggctgggaaaatttttctggaattttttgattgagctgacagaaagagcacaaaattctctaccgaattgccttttgaatggtagggctacgtcttgtataccagggttaccctttgtccttatttgtaagatttgtccttatttaagcactttgtccttattttagtctttttttggattcagagagcaatttagattttaaatgataatttttgaaagaaatattttttgaagcgaattaatatgcaaa

SEQ ID NO: 28061 - DNA, 1011 bp, Heterodera glycines
aatcgtcctcttggatgatgacattcatgtccactggatgattaatgccattaactgtgccattctgtgaatattgccaaaattcggcctttttgttggcccacggacgcggcatttttggctccgcgtgtttcgtattgggcacgtagtgggccacccaaagtgggaattgcccgaaaaagtcgtcatatttggtgtcgaccaaattgttccaaccgtccctatttgtgtagatgtacaattttgctggcactttttccttcagtagtttgaccaattcgaccaatttttcactgaattcgcttttcacagctcctttgttacagtctaaataaattttgaaattataaattgtcaaattcgaatttccaaaatccattgttaattattgctcgcctttctcgacatcaatcacgatgaagtccttgcccgggtcaaatcccgccttatcaagcgttctaatgaagtgctccgcttgctctttggcgcttgcactatttggcccccctctgagtaattaaaaaataaattaattttaaattccaaagttttgttacgaagtgcgtcaatgattattgaaatgtttgctaattactcaaaataatgataagcgagacgcgttagaatgttcgcctctttcatccctttgaaattttctacaaatcgagaatcggcaagtttgttcccttgagtggccttcgcagcgtccatcctcaatcgatccgcattttgtatcatcgctttgttacaaataaaagaaccgcgataaccaagaacatcaatgaaaattttattagattctgtgcgaaaaaataagaaatgaatcttaattacaaaatcaaaattttttcccccagaaatctacaccccccccccccccccgtaccttctcagtcggtgggctgaatcccccgagggaggggggggggcatttctccggtcgtttacgcctcgtttccggaattgatgaatgccttcccaatcttccgttctctgctctgggcagatggg

SEQ ID NO: 28062 - DNA, 1508 bp, Heterodera glycines
  misc_feature (178)..(178): n is a, c, g, or t
agggatatcggtacgatcagaaaatgctttgattttgatcccttttatgggtgggacttcttcgttcgccacttctgatttcaattgctcactggtgggcgagaacttgcgcgggtcactcgtttcactgaagtattttggaatttttttttttgtttattggtttgcttgtttggtntaattgggcttggtgacccgtgtgttttttttttgattgatttggtttatttttgtttgattttgtcaactgtttcagctcactcgtgttttgttgttaggttgaatgtttgacggacgtttggtcaggttttgatgagcaaatggacgaatttctgttggtcccggcggtcgtggcaccacttttgtcgttctgatgacggcaaaaaagtttgaatgggctgggcggacgtattcagagcgagttgacaaaatttaaagacccaaggcgccaaaaattcactttattttgtaccctcaaacttgggtaattaaaccataattaattaatgaacaaatataatccgacatgataaaatgggcacaaaggggaatggtaaggggaaggcgcagggcacggcacagggaagacgcagggcacggcacgggaaatgagcagggcacggggcaggcgcacgggcacggcacgggaaaggcgcacgggcacggcacagggaagacgcagggcacggcacgagaaaggagcagggcacggggcaggcgcagggcacggcacagggaaggaatggaaacttcggagggaaccaatgagcgatctgaaatcactgaaaacccagctccttttatacggcttttttgaaaccatagtacgctccaatttataatttttaattaaaatctgtttttgttatatccgtttgggttttgccattttcccattaattgtttgttttccactttttcctttacaattccaattcctttaatatattcaattaattattaataatttgtttacgaacgcaatccttaacagaattcgccatttaatattaattaattttcgttcctttcattcctgaggaaatgcacttttccttttcaaacaattttccgttattcatttcaaaaggtttttccatttttatgtaattatattttcgatagttttttataatattatttttccaaaataaatgtaaaaatattttttattatttatgttttatttttccccattttattttctattgttttttatttttccccttttttattttgggttttatcttaggatttcgcgttgtcgcgacactcccgcgcgttagaggaaggcaacgacacataattctatatagaataggtagtagacatggaattaggaaaatcataatgagtatgaatatgataataataaatatattgaaaaaattggctttaataagggaatagacaaaatttaatatatcagttacttggtcaaatgaaattccaatagtggggttggcgatgagtattgttagtgggaataatttttgtatcttgttggt

SEQ ID NO: 28063 - DNA, 1327 bp, Heterodera glycines
agataaaggccatcaaattcgcgtttgtatcgtttctccctttttggcaatttcatcatcagtgccgtacccatcatcagcagaggacaacaaatgctgagaatgtaaatcattgctaattctggtgaataattattttctattaattgggaggaggtttcagccaaatggacgacttaagttatatccaaaaattgtaattaataaaaatctaaatagaatttaaaacaatttaaaggtttgctcagggagatgagctagttgggtattcaaataaatgatgggtatgacattggaaaaatgaaatgtccttttttcaattacgtcctttgaagggacatactgagctagggattgggtttggtaactatgactggccctagtttcttgttgtttaaataatttgaaaaaaagttcgtcgtagaatttttagaaggttttcaagcttttgttaattattattcggggttttattttctaataagaatttcttgtattagttggtaaaatagtacctataaaaagcattgtttaaaaaggtgtaaaaaactgaatattatttttttcttttattttttatttttttctaatggaacgaattatttgtaatatttccttaaatattcatggaaaattcggtataattgacacataatacccaacttttgaaactcctcaccaaaactgtcttaaaaattaatcatttgtcctgaattgtgttatttgtggtaatacccttttattaggtgtttctggtgcgacacattttgtgttttcagaacagaaacttttggacggagccaaaaagccgaaaattatcagtagcaaatcaaccatactctgctctacatgaccaaagcaatttttttaatgtgattgggcagcggacattgttcatcagttagaattcgaagagaataatcacgaaaataaaaaatatattaaaagcattttaacaacacttagaatataatacaataaagcattctctttttatcatctctcaaaaagttcgttcagctttgttctcgaccgaagatcactctggattttacaattttaactgatcaattattgatcgatcacccaccaatctgatcggattttgatcaatgcattccagcgcaatatttgcggccagatcgaactcaattgcccacccggaagaaacaaacaatggcacatgggaagtgctcgaacgcagaatggccaaatcgggaagttgttgttggtcagcattttgcatgacaaacattgccgccccgtccactgttttgcattgctcttccgccgatttcaatgcctaaggcaattttcatttttaaac

SEQ ID NO: 28064 - DNA, 1101 bp, Heterodera glycines
ttgacttaatacattttcgaggtcactgacttttgcttgtacggatgggtttctacctgagaagaggcgacggtcaatcgcaacaatatcttcgtaaggcaaattctctaagggattgaccatgataggggaagtgggatgtatcagagagggtactggacttgcgcaccgtaaagggaaagaaataaagtaaaagttaattgtgtataatcactggatatcgcacaataaccaggatttaacttgctttgctgtatttaattggggtgattccggggcagatataaatggttcaatgcaccaaatatattaaacgagatttgaatgttagaaccaaaagaaacaaatatttaattgtcttaaatcactggatactgtacttcgtaaccagaggtttacttggtttactgatttaattggggtgggacctgagctgggaggtaattggttcaatgcgcaaaatgtgttaggtgttaaaatgtgcgtagatgtgatcaaaacgtaaatgtgatcaaaaggtatgttgtgacatttgtgaattgttaaatgtcagttttttttttgtgttattttccgccacacctttcggcttggaggggtgagttgaggctgagttggtgtgaaatggcaccacgggagaaggactgagtgtttggtgagggagagcaagttgagccaaatgaacaaagggctggtagagatgtcgaggacgaggacgtgttctgaatttgctttgagttttaacccaaatcaacgcaaccgtactccgagaatttacaaaatttaaaagaatttgcgatttttgaaaattgtgcgaacctaggaaggagataagtagggatcgtgtacgactagctacatgatgatatccgtacttaaaatgtgattatgtataaaatatattttatttgtacctcggcacatacgagactggacgattggaggcgtgactgagcataacagtctaaagggcgactaagattgaaattgtccatcgatttgattgggtcctcatgaaacaaatttggtactatgaacatatagtaagcggaacatatgtaatatcccgagacattgatcataatgatgataaacaacgac

SEQ ID NO: 28065 - DNA, 1638 bp, Heterodera glycines
accagtcattacatgaagaactacgacctccatgaggagcacattcctctcaggtgaagtgttaatccaatgcgtaaaaaaagggtttttatttgtataagctaaatcgtttcagactcacgcgtagcaaaaaacttcttgccacaatcaacaagaacttcgggactttggcattttgtcgccggtggttggaccgactgggcgaaaccaaatatttgatgtcactcagagacctttgcggtttgtaatagcttctattgcacactttggcaacaaaaacttttcagagaaggacattgttgcgccttatcctccgctctgtgatcaggtccaaagcccatggcaaattaacgcctttttcacatgtttcacttttctacagaaaggctgttacacggctcaatgggagcacaccattctcttacggccgacatgtaaagaagtggtgagccgtggcgaagattattgatggatgagttggtgaattggcggatggaggcaaagaattggccaaaatggcgtaaaaagatgatgttggcatcgttactataatgctaatttttattgtttgctctagtatttttatggttggaattaaagaagagaaacagtgtgtttttacattttatatcggttgtttgaatggaaattctgggcgaatgcattttcatattccttaagttggttcccatttttagattttattctcagagtccttttaaaacaacaataacagatcctgtaaatgtcttctttttttgtcacctttgacacagcgtttcaatttttgctttcaagttccaaaaaaagatttgcatgtgtgcggaattctttttgtaagatagtagtaaagggacaaagagcggccgttgcgcaatattaattttttttttttgtccaaaacattaaaaaagtgtacgccaaaataagaaatgtatttttctcctctgcactctcttacaattagtgctttttagaaaccaaaaatttagggttgttgaaataaacaaattagcacacaataaataaggtttgtcagttgattgaattcataaaatgcaacagaaacactcgtgttgttagtttctttccacactcaatctttaagcttctggaactgctttatacgtatttatattcgacattgcgatttgcagactccaaatgccgagcctcgaatctgtgcctgaacgcattaactttgacgaggaggaggaaaagaccttgcagaaatggcgagacgaaaacacttttcagacatcgcttgagtaagtttcgaatttgattttttcgacaaattgagagccctttcggctatgttttggtcattgaccgtttcgttaagcatgagtcgtggtcgacctcattacactttctacgatgggccaccatttgccaccggacttcctcattacggacatattttggccggtccttagttttttccaatgtgaaaaattggcgcatattcgttacattttagggaccatcaaagacattgtcacgcgctgggctcatcagagcggcttttatgtcgaacggcgttttggttgggacacccacggacttcccgtggagtacgaagtggacaaaattgagggcatcaaaggacctgacgacgtgctgaagatgggaatt

SEQ ID NO: 28066 - DNA, 1059 bp, Heterodera glycines
tgctctgaggctgcgttggcattggtgcgcatggactttggcaacaccattcgctttctgttggtcggctcggaaaagagtggggacaaagcaagcggcgctgttgctgaaggcgcggatgcgccacgccaaagcttttcgggcacaaaactgaacgtggatttgatgctgcgaccaccgcaacagttgcgcgagatcatcagccttgtggggtaagaacagcgaagagggacaaaacagagcaaaatggataaaagataaccaaaatcaataacacaatccgaccattgaattgggctcgaggacccccccccccaaatgaaattcgtttaatcaaaaatgtgaaaatttattaaaattgtttttttttctcttttaagaatatgaaaatctgttaaaaatcggccaaaaatttcaaatttttcatacgatgcataaaatcattaaaacatttatttatttttccccttttcaagccaaattgtgcaaaagttgccgtgcgacagtgtcgaggttgtgtcactgctccatctctttccgctgttcgtcgaaattggcaccaattcaacgtgtgcccagctgcggcacgagtcgctgaatgtgatgatgaaaatgtgctgtgcggtggacagcgctgaacaactcgagcccgttatccgtaacattttttaaaaatttctttgattactgttaaattgcttaccaacaaaaaccattaattagatttgtctaaaaattggaaatcgctgtcagattaaatcttgaacatttttagtgaaagtttagaaattaaactataagaatgtctcgggttggtaaatttcgagttgttttaattgcgctttttctaattgaatttgcacacttttttgttttgtttttcaggtgacattccgcttgccgtttacattgccgcaatgctcagttcaaatcgcaatttgggtgtgctgttgtccgcacttcaattggccaaagtgttgctggagaaactgccgatgctctacattccattgtttgagattgaaggtactctctttacaattatttgttttaactttc

SEQ ID NO: 28067 - DNA, 1147 bp, Heterodera glycines
cgacttttccgctgtttcgtcagtagtatgttgagctttcttctcctctctgtccggtgccgttttcactgccttttcgccgcgtttttcccccgcgggctccgccgctttgtccccaaatttggcccttctcgccgccactcccgactcgacgcccgtctcgcgcagtctctgcgacagaagtaccttttccgccgtgttcgtctccttcggcttcatcgcctccctttccatgtcgcgcgctttctctcgcagcatcggctaaatttggccaaatcgctttgtcgtccaattggcatgcttttctcgccttttctgccgatgatgagcccgcctttggctgttccgttgcgcccgccaccgccaatttcgaagcgttcgctttccgtgccaattcgctgatcttctaaactggcacaatgtccgctccgttcgtcggtctgttcgtttgttcattaattacccttttcgcctccgcttccttcggtggccgcgtcgtcagcggtcccttcgctttttccgcggccgccgcttgcgccgccgcttcttgccttcgcaatattctccctttttgagcataattacattcattttcttaatgagtccactcactgatctcctggttcctaatcgttgctttttcgattttaaatcgcccctcgggcaatctcaaattgatgctcacctgaaaagcagtgagtgtcctttttcatgtgctcatttgtctgctgatcagcagtgcccaccccttcccactttggtcagccctctgttctgagtgatcgcctcgattatttcgcgctccgaagttgtggagaatgcgacgccctaaaaaataagtgcacgcttactttctgatctatgatcagtaattcttcctttttatctccccgccccttctccctctctccttttacctcactctcattccctctctccctcttttccttctctctctacttactttctttcacctccccctttctctctccccccgcttttcctctctttctcacctcctttccctctcatcccttctctctctttttcacttcctctcttttccctctttcccttctctctgctgatcacctgattgactgctttgacctcctccaatgtctgattggtcagcgccgctttgaaa

SEQ ID NO: 28068 - DNA, 457 bp, Heterodera glycines
tttttcatcccttccccttctcattcttcaaacacttttatcttttcccctcttcctcttttcacttccatttctttctttctctctcttcttctttgtcaccctctcttttttatcctcatctctttctctcttctttttcctcccctcttccatctcgtccccatcttccttatcttctttccactattattttatcttctcttccatccaacccattttctccccccccctcgggcgcctcagtgtccctaattaaaagagtgtccgcccgccgctaattcgcttagttttggcccgttggggttgccaaaacatgtgaaattggacctggcgacctcttatgtattggatgagagtgaaaagcatggaagaagcgcggaagaggaagggaggaaaaaagatgagttttggtgggttgtctgtgtgccaacgtttcccctcccccccaaccctt

SEQ ID NO: 28069 - DNA, 1422 bp, Heterodera glycines
  misc_feature (1298)..(1298): n is a, c, g, or t
  misc_feature (1309)..(1309): n is a, c, g, or t
gttttttcaagatttttatattaaattttgcaatgaatggttttttttcattgttaaatttacttttatatgaattttttgaaagaaaaactttctaaactacctaaaagaagcggatcactaacgcaggatcgatctcgattttttaaaacagaagtataccataacttttaaatcaaaaaacagatttatatttacgttccgaaatatttaaatataaatatttacaaaaaaatgaaatatgccttgtaataaatccaaaatattttcaattatattttatttatgaaggtcaaaaaaaaaattttttttttaatctttagtacatacccataaaaaattaattataagattatttggaaaaagtaagtaaatcaaatgtttaccctttcaatcaataaatcaagtttaaaaaaccatatcaagaattgtacggatagttccaagtccaacatggaatccttggtccaggcttttttcaaaatgccaatttttggaatatacaaaagaaacaaagttattcaaattaataatatgtatttaaaatgtcatttttcatctcctttcacgtaagttcaaccacttttggataagatgcgaaagagcgacaatgttaacagaattcgcgtccgtgttgggtgaatatccgttgacaaggatatacggcacttcaacgatcggattttccttggcggtcattgttctttgtgccgcttgtcgttgcaatagaaatccacgctctcccatatagcaaagcctgaaaccatcaaaaattggaataaatcacaaattgcacgtctcccactttatgcgtttgtagctgttgcggacaaagctggaacactgaagcagtgactgttcaacaccggaaccaacggacagtgaacgctcgaagcaaatgacgaaatggacggcctgatcagcggacacttcgtcaagtacgcaggacatcagccgattggcatcgcattccttaggcccgtggttacaactgaaatgtgcaaaatgtacagagaaaggagcaaaaaataattacgaaatttggccattccgcagcaaaatgctgttgccccaagggaccaagtccaatttgatgcgacttccgaaacgattgagcaaagcgcccaaattattggcaataaaacgctgacaataaggacacaacgcctcataccttaaatagaaaccaatcaatgacagcaaaggtgtggccagatcagcagcagctgatcgagcaattcatttaatttaaaatatttaaatttaattattatttaattttatcttagaaaaattanataataattanattaaatatttctaacattgataattttgtaacttcgtcacacacttaatttaatacccaaagggtcaaacggagcgaatgccgtttaaatttggagagacttactatataca

SEQ ID NO: 28070 - DNA, 850 bp, Heterodera glycines
gtatttttcattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaaccaaaaattgttcggagaaaatgctatttttgggcttctctcgccataactaagccgcaaaaaaaatatgttaaaacataaaaatcctagccctaataatttgtgatattcactttgttcgaaaaatgagtggataaattttttactattattaaataaagagaataaaatggacttgagtgtaacggagaacctgggaacaaaaaaacacagattatcacacttttggcaaatgcagaaacacaaaaataattaaacataattttaccagcttctatggaaacagtttcgaaaattttgatttttaaaaatcgtgaaaacatatttaaggggttttctaattaaattcttttttttcgaccgaataaaatgttaccttcaatgtcaaaaaagcaaagaaagccagaacagaataaccggcaactacgcataattgaagtccaattgttcactccaactgcccgacggtacccacactttgattacgaagaaatgtgcaaggaattgggagtgaattggaagaaatgattccctcataaacatttttcaattttagctcgaaatttcgaagcaaaaggaaactgcggagagcaattcttttcacgaccaagacgcagaagaaattgtgcgaagattggaggcgaaatatgtgtgtttgagaaattgtaaaatcagataattaagaaaatacttaat

SEQ ID NO: 28071 - DNA, 707 bp, Heterodera glycines
aaagcgaaatgcgaaaagcgaaatttgcgaaactgaaaaatgcgaaatgaaaaaaaagcgaaatgcgaaaagccaaaatatgcgaaaatgcgaaaagcgaaattttttctacaaatttttaatagttaaaatcataaagcaaaaatcattttttaaaattttattccaaatttaaaaatcaataaaacgcttttttgatgcgcgctttttccaaaaaactttttgggaagagggggcaggcggcgccgggaaaatttttgaaaatttgattaaaatttgttgaagattttcaccaaaaaatcatcaaattttgtgatttttgtatcatttttctaatgagaaataagagttttggcgcgccgctgagaacagtttttcatcaaattaccaaattttgcgattttggagaaaaaataggagttttgggggcgcggcggtgccgataggcgccgccggggaaaaaaactggaaattttaatcatttataaacagtttttcactgaaaattagccaatttataggtaaaattttgaaaaattttatgggaatttaatccaattcttaggggtgtaaaagtcgcatttcgcgccaaaaagcgaaatgcgaaacgccaaaaaatgcgaataatgcgaaaggcgaaatgcgaaacctcggcccatccctggtcccaatgtccctgcttctcaaggggacagccccgggggggg

SEQ ID NO: 28072 - DNA, 1421 bp, Heterodera glycines
  misc_feature (1388)..(1388): n is a, c, g, or t
tagccttacaaaaaacaaacaaaaattttagcttctaaaaaagttattaagaaaaaaactcaaaaatttcgacttttttggaatttcatgttataacttttttggtaattgtctaatcgcgaagcactagctttgaaatatcttctaaacatgttaagctttcgattgataccaagattgctggatttggttaacaacaaaaaaagttataacccaaaaacttgggctggcgccaaaacgtcggcgccaaaacgatacggacccctaaaaaataaatacctggaaaattggttctaaaaactcgaaagtagcttaacaacgtcaaaaaaactcattttccgtgttttttagaccactaagagtgtaatggctgagaaaatagctgtgggagttgccaaaatgaagtcaatcctccagtggtggatttggtctagtggttcagacaacggatccacgtaaggggctccgagcggcggttcaaatccggccttccgccccaaaagaaattaaactgtaaaatttagaacaaataattctctgaagttttattttaaacttggcttttcaatgtttttaagtcccaccgtgaggcggggcagttctgttgtatttctctgtggtgcggaagtgtaaaagatcagcccacggtgggactcgaacccacgacacctcccataacgcgggatgctctaaccactgagctacgcaggtctcattcccccacactcatctcatccctctgagatgcactcttctcggcccgagatagagcgtccaaacaccacagatctcttctctcctcggcccgagtgagagagagacgtcgttctccaacaacttttatagattgttatttattttaacctatatttttccccaaaaaaacctttctatggtctttgatcatcccatctaaactctaaaagtgcccaggtgattggatttatttttggatagctgctttctagctcattttcaaaccaagagggggttttcacctttctgatgggctctttgaaaacagctttttgattgaaccacgtcgctccgcttccgcccattgggccaaaattcgtcgaatgcaccgccgcgcataagtcacttcagaatcgcttaaatgggcggtcgactcactgagaaatgaacgcatttcgggcgacaacgctaaacaaccaagtcaaataaatggcatgttagtatattcaaatgtgttatgttcaccttcctcttcctcctcttcgttcccatgtccgttaaatgtcgttaaattgtgataatctgatggcggtatgttttccttgtcgtccccctcatctcccttcttcaattcgctgtcccaagtgtgtcgtctttttgtagtgcctcttacagttttgcacattttctanaaaataaataaaacacatcaaatttaaaatttt

SEQ ID NO: 28073 - DNA, 1622 bp, Heterodera glycines
tgtagtgggaaaacctattagccctcgcacataaaatagctaaacaatgaagtctcacaaattgtcgctcatatgtcgcataaatagttagcgcacactgttttgttttgttactccgcgcgctcctttgttgcatttttttttaaatttggccctgtgtacgcatatccgaaaagtaccaaagtttttgaaaagcaaaaaaaaaggtcatcaaaaaaatcagcggccgaccccacttcgcaaaaaatttggccgacttttgaattatactgttttttcaggaatctgttcacccaatttacaatgtgcatatcgacgcatattccaaagcgcaacgatatttcaaagcatgatcaatgggcttttcaaatgtaataaaaagcgagtcgaaaaactgacaaacggtggaaggttaagcattcgaaatgagaggaggaaaagcaccgggaaaagcaaacaaatcatattgacaaatgctttcattttgtttgttaatgagtggttaccggtagataaagtcgaagcaagcgaaggaaagagtgggcggggaaagcgccgaggggcgacggcgttgggattttcttttctcaacggaaacgaaatgtattccttcacttgtgcaacaatctcgcatttccgttttatttcttaatcggactccataaaatgtatggcacgtcaaatgtctacggattaactgttgacaatgggaaggatgctcatggaaggcaattctcctctggtcatcccaattcatcccagaaatggtcgccgttttaccagcgaagaaatcacgacggattcggtggattgtatgcaccattttaataaactttttgttctaatcacaaaaacattaagcgaaatgggagagataagagaagaccaaaacaattcaaactattccccaaatattgttcataaacaaaaaatgtcgcagcaacaaatgcagtcgaaaatgtgcaaagataaaacgagcaaaccattaacaaaggttggacaggaggaattagcgaaaaaatgtgtcagtgatacagtatttgtagaaagcaatatactgtaatggactattaatcttacaatttgtttttacgcctccaatgactataaagtcgataggacttttgtctaacaaaattatggattaaacgttggaagataacacacaataagcatatgcatactaagaaaaaggaggggcttcaaaaattagcaaactttcctttgaaagagataatgatgatttattggggggggggggggagagggggcatacccaaaatatcctttggtgatacgttctgtggttacaaaaaccgaaaatattgaaatataatttttagcaaaatgtttttatagcaggttgaccaacttctttatgaacttccacaacaaaacaaattctcaataaattcgctttgtcaaccgccagagtttcttaaagtgttcagtgatgtgcgttgtttggtgggcgaaaagcagtttttgattgtgtgcttttgggttctccacgcccgagggtgattttcaatttatatctgaggcattatgcctaattatgcttaacttccaggtttgttggctggttaatgatgacaaattgttatttgacgatattttac

SEQ ID NO: 28074 - DNA, 1238 bp, Heterodera glycines
aaaaagcggtgggccataatttcgaaagtagatttttttaaacttttgcacaattttcaaaaaaacatttcgtttcattaatttttttttttgtcttttcggtgtattttcagaaggttttagtacatcccatttggacatccttaccatgatgccggactccctttccaccgcaatgtccttcagcatggaaaaggcgaacacaaacaaaagcatggtcagaaaaaggggcaccgttatggtggccatttgcttgttcatgtacgacggaatgggcaaacggtggagacggagcgaaacatttgccaaagcatcgtcacctttggccttaaaagcacgtaaaaaagtgaaatctctatatatttttttaattgggcacactgtgaaaaacgacaaactaacaataagtccattttcaaaaatatatatattgatacggaccaattcgatgaacgccttttcgattgcgtactgaatcgacaggaaaccgctggaccaatagggcggagattcgggaatttggtagtcttcaaactgcttttcgctatcatcgcgccagaattggttaatgagttccatgtcccaactaaacaatggacaatttgaaatgaatcagtttttaattaaaccctctaaatatcattagttttcaaccatgtccgaaaaatatatggaattaaaaaaaaaatttcgttggaaacaatccgccgatgggagaaattgggtaactttttgaatattttaagcaactcttaacaaacccggcggtgtctcattgttagcactgccggaccacatcatattttgccatatttttgaaacatagtccaaaatggcaaaaatactcatttttggcgaaaaactactataaaagccagtaaaacacacccatcctaattcgagattaaaaaaaacaaaaaatacaccccaaaaatcgatttttgaattcagcccccccccccccgaagccaagggtctggctcatttcagaaataagaaaacaaagattttggtgtgtctttatgatggaataatttagatgaaatttttgcacacacatataaaacatagttgaaggggggggggggggatcatactcgggggagaaagggtccctcgacggaaacaattgggcgatgcccaactgggcaggcaacaacctgttttttgggcatgttcatagttgtccgtagttaaagaaagcccctaaaattttgagtaaactttgttgagtattt

SEQ ID NO: 28075 - DNA, 1507 bp, Heterodera glycines
ttcggtcgattcttaggggtgtatttttttgaattttttagggccgattcttaggggtttccgttttattgaattttttttaacaaattttccaaaatatgcaaaaaatctgaaaatatgtacaaaaaatgtcaaaatatgcatgaaatatgcagaaaaaccctaaatatgcaaatatgcacaaaaatcccgaaatatgcaaaaatatgcaaataaaagtcccgatttttatacgcaaacacaaaaaataaagtgtttttcctgctatttagagcatggagaagccaggaaaaaaaaaatgcatttgcatattttttgcagccctgcttaccaataattaatttattaatatttatttgccaatcttttcatattttagaaatttgcaaaaccttctacttccgtcagtttcattgttgtcatttggtttccggcgttttttgcttactcctttgagccctttaatgagaacaacgaattgactcgggaacaattgacatttaaaaagactaacaatagcagatgttttctgcttgtccgttgtccaattgcgcgagaagaaagcaaatggatcgaatgggaggaggaagcgattggctgggaatttcttcatcagccgaacagaatcaatattcaaattgatgatgaggagaacattggggacgggtcagtgagtattttttattcaaaaaattcaaatttattcgtttccatttttaggcttctcgacgcaactcccggcccaagtgatcagcagcagaagtgaatgaatgaattgttgcgaagtgatcgaccaatttgaattgcggaatcgaagaatgaatttgagcccatttgacgtgctcataaaaatatattctaattttttggagttttcacaaaaaaaaatttagtgttaaatgttgtggattcaaatttgataaacgaattttaaaattcggaacaaatttaattttgtttgcaacgaaatgaaaaaatggtttcggcagtgaaactcgctgttgacccactcgcgcatcaattcagatttggatttaattttaggcattttcaatattttatcctaagagatatatattcaaatcggaacatatttgacgaaaaatggcaaaatatgcaaaaaaaaatctaaaaaaatatgtacaaaaaatggctaaatatgcaaaaaatctgaaaatatgtacaaaaatggcaaaatatgcattaaatttcaaaaaaacccaaaatattcaaaaaaacccaaaatatgcaaaaatatgcaaataaaagtctcgacttttacacgcaaacacaaaaaagaaagtgtttttcctactatttagagcatggagaagccaggaaaaaatatgcatttgcatatttttggcatccctactaattagactacgtagaacccaggaaacatattttgacagtcctggtaattggcatacctaacatgtttttggcatttatttttattttaatataaaagtaaaatgtgaaatataaaagtaaaatgtgaact

SEQ ID NO: 28076 - DNA, 1617 bp, Heterodera glycines
  misc_feature (49)..(49): n is a, c, g, or t
taatttgccagttttacccacctgttcatgatcctttttctacaaatgnagcattccacattttcggtgatcgaaatgcgttgccgcttcaattcgtcaaggcgattctttgttcgtctaatcaccaaatttgtgaaagagacaatcaaattggtctgaaatataatgggattgaggagcaaatttgctaaaatcaacaaactgaggccaattgattgttcagagactcaaacaaagctttaaccgcttcgcaaattctgttgaatgcagttgtcggcggaatgagagcaaaagcgcccactataagcaaaggtcggttcaattggcttttcctcttgcgcttgcctgtgtctattttggtcggatgccttttgaacaacttcagcgcctccgaaatgtttggtttgcgccgaatttcgtaatcactttcaacttgaatgacctctttttgaggcatttcgccttttatataataatggaaaaggtcgaagaaaatctaaatttcattaaatcgttctgtttgtccgtttgatttacgttgcgagtcgatgcatttctttcatcgtaataagtttggcagtgtctttctgcgccattgaaatccatcaaaatttccgtataaattttcaatgcgtttaaatgctgtcctaatttccccataatgatcgctctctcctccattaaatcttaaacaattaattgtaaataataagtgttccaaagccaagattacttaattcgaacaaaaagattagattttatttggagcgaagtgcgacattctcggctcaatccttttagaccatataaaattcaaaaaattttccaggctattaaaaaaaaatatttttttccctacaaaaataagaagctaaaatcagttatttccacccgccgacccctcggagtcgcatgctaacccatatgagctttttaaacgtgcaaatgcttactttggtcttccccaattagatctcttgcactttcaatcgaataatgctggtcggtcgccaaaaaatattgtaatttccttctcaatatagataattcatcatcttcggcgacaaaagatggaacaccaatcgacggagaggagagcgaatggaggaactgaccgagcaacgtattgcacctgagcacgtattgctccaacaattccccgtgaaagtggggactctcatcactccattcgtaaataacgtgttcctaaacagggagggggttcggtggtaacaaaaagaaacatacgacgaatgagagaagttgtcttatttattgtcaggtgaagtgttggaaataaacttttttttaataaacctcaaagttcagaaatagtgcatttttctgttcatgtttattttgaatttgtccatttcactcaccaaataaggaatggctgccgttatgcactcctttttgaggaagtgcagcaccatctcccggtcaaatttcacgcttggttcttcgcccctttgttttgggtctgtttctttgtcatccatagaagtgaatatatgaaaagaaactgataaaaattaaattttcccatccccttttttgtacctgaacacccgagtcgatattggcagacaaaatgggagcagaaactccaaatca

SEQ ID NO: 28077 - DNA, 1570 bp, Heterodera glycines
ttgtgaccttgcacgaggcagttgaggcagcgctgttgttctgtcagccgttttcggcgagctcccggtgttgggaacgccgggcactcactgggaagatgatcagttcccgagcagagcgagcagggacgaccccattttcttgctgtggttttggccctttccggatttttgttaatcgcggagaacgccctatattctggttggtgcgttactccacgattaaatggccttggtggttggctctgtcggttgttggagtgacggttgtcacccctttgatcccaggcacccctctgttgaggtggggaattgaaggtggatgaacgtggtcgttcatcgcctcggaggacatgtgcacatctctgcacttcctcttttacttccactattgcttgaagtgcctttcggatgtcaaggcacgaaaatgtccttcctgaggaaagctctttctccaccacgtgggtgaggatggagaacggaagcttcgacttgatcgtcgaagccatgaacatgttttcctcagattcgacgaagtccattagttggaaacagattcgttccacggactccgcgaagttgcggagcgagagcactgactctcccggcttggagaggtgcagtagctctgcctgcaaagactcagtgatagttttactatcaccaaatcgcttcttcaagatgtcgacaaccctcggataattttcgtccgagggtgggtacaagtcgactgcccgcctagctggcgagttgtggggaaggcaccccaacaaatagatgtgcttcttgaagtcgtcgattggaaggttgtccactgaggaacggaagagcctccaaaacattggccactcccttggctctcccgtgaattttgggagagagatgggaggtaggtacacctcatggcgaggtgggggaggctgaacatgttgaatttgtggaggattggcgggctgagagataatgctcccagttatttcgtcgtcatcctctggaccgatcactccatcgatcgtgtccacttcacctcgggctttgtccgcccattccatgaagtgctttcccgatggcttaaagtcatcgtagcgttgctcctcttgttggcggtcggctccattgaatttgagcaggagggattgccatttgtcattgcaatcctccaaaagccgaatcgctcggcggagtccacggcgctccgctgtgaggtctgcttgaatgctcacgtctgtcgtgtcctttccgaggttgacagtggccgcctcaatgtaggccttggtacgggcggcacaaggcccgattgaagactcgaagattcggctgctggtggccggttgtgtctccctttgttgggtgagacttgggtcggcggtgatggccgaatgtgtcttgcctcttgttgggcaagacgaagaagtcggcgactggtggccgaatgtgcctaccctttgatgggttaggcgaatgagcggcggcgatggccgaatgagccttccctttgttgggttaggctaaatgagtcggctgctgatggccgagtgtcttgccactggttgggcaagacgaagagtcg

SEQ ID NO: 28078 - DNA, 1081 bp, Heterodera glycines
tttttacagcttaactaggccctattaagcttatttccagataatcccgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcaaattttttgaaattttttaagtgcaaaagtggtgggtgtctgcaaaaaattttcaccgggtttaataaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtctgcaaaaaattttcaccgggtttaaaaaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtct

SEQ ID NO: 28079 - DNA, 1098 bp, Heterodera glycines
attttaaaaaatacacgaacttgtcgtttttaggtacaatagtgcataattaaacacattaacatgtatgcagaattaagcaatggaagatacaatttgaaaattattaagcaattgggaatgtcgtttttaggtagaaatatgcaaaattaagagaaataagttacaagaagatacaattttattatgtgcacgaacttgtcatttttaggtagaaaagtgtataattaaacacattaacatgtatgcagaattaagcaacggaagacacaatttgaaaattattaagcatttgggaacgtcatttttaggtagaaatatgcagaattaagagaaagaagacacaatttgtaaattattaaggaatagaagatacaattttaaaaaagtacacgaacctgtcatttttaggtagaaaagtgcataattaaacacattaacatgtatgcagaattaagcaacggaagacacaatttgaaaattattaaacaattgggaacgtcatttttaggtagaaaagtgcataattaagagaaagaagacacaatttgtaaattattaaggaatagaagatacaatttagcaaaaattaagaaaaataatgattaaatgaaggaattactcaaaaatgtgtaaaaattacacacatggggtgtgtgtgtatgcgtatgtatgcatgtgcgtgtgtatgcgtatgtatgcatgtgcgcgtgtgtgcgtgtctatgcgtgtgcgtatgtgtgtattgtatgttttttcgagggtgaggataaaatgtgtttgaaagttttgcataatatttattaacttatataaaacttgttaattttaatcataaacacaaacaatgctccttgcctaattcaacgtaaaataattctaattataataaggaacatttacaattccattgaataagtaatattcaaaggaaacaagagaaatagacaattttgaatctaagattgaaccgagaatagaaagtaggtttgacaaacagttgactgactgtatgtgacgagaaagggtagataagggctaaatgtatgcgcggactaggtcttgcaataggattaaatgattaaatcatatgatgat

SEQ ID NO: 28080 - DNA, 1580 bp, Heterodera glycines
acctccgtaaggactaacttatatttacgtagcaagtaattattgcaattcaacaattgtatttgttttaaccatttttgtatcatttttatgactttcaatcaaaacagcatatcaaatttatcaaaatgtgacatcaaaacagcatatcaaatttatcaaaatgtgacaagtctatgcatcaaattaaaactataaatttgggaaagcaaccgctaacttagcatgttttttagttatatatatttaatgaaaggcggataatgttgtggtgccaaagccggtgaatttatagaatcggtaagatttttttggtttagcaccacactaaagtgaaggcagagggattagaattttagaaatggggggggggggggaaagaaaagtcggacggttgggaacagcagcaattcacagatggacaatcatcgcccggagagactaatttttgtcagattaattaaaacggaacacccatccatcacaacgaatgatcgtcattcaattcattcgccagttttctaaattctttcagaagatttgaatgccggtgatttcgacgtccccgccaatttggagtccgtggaggtcgtgcggctccactcggtgtgcgtaagtgcagtagcgttcatcgttgatgaaaatctgaaactcggtcagtatgagaaagcattgccattgcgctggtcggtcacttggaaggcgtactcctcgttgatcactttcaggtcaaagccaatgcctttctccagtggaattttgccctcgcgttcttcgtttccccactcattggctataaataatcactttttggtaaatttaaagataaacatttctctgataaactgacctatcaaagaattccgtataattgcctaaaaataaaattatgttttattttaattgtttttggctttgccttttcgtcaaaacgggggttcaaatgcagggcaatgtccccgtttttcttcagctaaaatttaaaagtaaattcagttttaaattttccgcagaccaaatttatgtggaaacgtttgccctttttctcgggcgttccgaaaatcaacagagtttttccgggtgcaaaaccatcgccggtgattccgctctcataaggaacgggctgaaaaacgctgacgaaaataatcgcatttcattttccgataattacgtaatatttccctccccaatggatttgcgtgatgagaacatcgccgtcgatggaaaagtgtgtgacatgactgaacaaatggaggctgttgaggaaatgaatcatccgaattgcccaccttaacggaacgcgatgctcaaactccttcaattctttttggtccgcataaacagtgaatttgctgtcgtgggcacgaatctgaagggagtccaatgggtggatgagtcattcattcggtgccaccccggggcaactcactcggagatcgatgtcgtccccctttttatatggattgctcttgcgctcctccttgacccattcaccctttattaaacaaacaacacatgtttaattagcattaggttgcaaagatgattcaattacttttaattaccttcgaaaaagtgtt

SEQ ID NO: 28081 - DNA, 1064 bp, Heterodera glycines
attctggcgacgaatccatcgtttgggaaagttgccgatcaagtcgttcgtcgcttcttctccgaatttgtcggggtcaaacagcaaaagcctttcgactgatccgtcgcaatttggcggtgtatgccatggcttaagaaagtcatgaataacttatgacaaagtgttcggtcacttttaggcggggcattctctcaagacaaaccgcacgaacggcggagagcaaacggactctgtcgatgcatttgacagggacggagacgaagggaatttggatagacttgctaaagaaaaacaaagcgatgaagttcccttaaacagaatcagaaaactttcagtatgagtcagtttattgtcattagggattcctcaaaatcataattgggcaccgaaaatttgtcccaaacaacgcttattggcatcagcggaccatatccccttaaaacttttcacacggcgagtcaattttggtctcccagtgcaaataagtttattttttatttagtaatcagaacgccaaaacttttcaaaatttaaaatttttgtggaattttcccttgtaagaaacgcaagagccgatctcgagttaaaaacttaaagtttcataaaataaacttgcgatcgatagagggggtcaaaatatgggcctatgcaaaatttcaagaaaagttacccacagcaaaaaaaaattttcccagggcaaagttttttctttttctctcagtttgacgcactatttccatgtctctaacatataaaataacacatggttcattttttaccaataaacaatttttttaaacttttgactaattaagaaatattcttcagaattttcccttcaaaatgagcataaaatggttttatttggtctattattgaaaaagttataagctaaaaaaatttcataaaatcaagggtaaaataaaatgtctactgtttgtatttgttgttttggcgttctgtttttattattattttatttatttgctttaaaaaatgaaatttaataccccaacacaaagaaggatttgaacctgaaacccccttttttggtgactaac

SEQ ID NO: 28082 - DNA, 1026 bp, Heterodera glycines
ctcattttttattagcctaagttaataaagaaattgtttcatctttattattatatttaaaattataaaattgttgacaattaattaattggtcgccattttgactgaatgactgtttaaatcataaaaatttggttcatctgttggattaaatgtatttagaagtgattttatgaacataaatatttattaagtgctcaagtactaagattttgtcattaatgttaattaaaaattatattaacttataaatagtttactgctttttcctttttttaaatattatattttaaaaactattaattttaattaaatgattttcaaataaaaaaaataaaagcgttttcttaatttttaaaaaaactaaaaccaaatctgatcactttcatggcccaaagctaggtggtctttatttgatatcctgcatatgaactgcccattaaattataaataatttatggttagtattaaactcttattttaattttatctaatttaaattatctaattaattctcttggtgtcctcgtttttattaatttttatcacgttaaattgtttcggcctatgattggcatttaaattgcatagtttaaaataattcattttttaatttagaaagaaaagtatatttatagaaaaaattatagataattaaataagttctcattgatttaaacttttatattcaaaaatccaaaattattattttttgatttacattccacttcaattccccacaaatttagttttttgatttctcttcttatcagtccattttagagctgtttgaaatatcttcatgggtcaaaaaaatctcatatttttgggtgtatggtaatttttaaattttgatcaaaatcataaattcaaaaattttatgaacctgtaagcctttttgtattttcatttaatttcctcatttttttctttctttttgtttctcatattcatctgttatttagggcggttcgaacatatcaatattagcaagacaaataaattttggggttttgtgtatacggc

SEQ ID NO: 28083 - DNA, 1649 bp, Heterodera glycines
  misc_feature (1627)..(1627): n is a, c, g, or t
tgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttatttctttttaaacaggccaaaaagtttaggcttacttttttttcagaaactgatcagaagcgcaccaaactttgcagggatactgaaaggaagagaaataacctattttaaatattatctagtcagttcatttaaattatttttatccaaaaaattttttttttggatttcggggcagtccccctgaaccgatgcgcccagatttatggggagaccgaatccttcgggaatagcttcccgatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttatttcataaatattttttcagaaaatgctctgaaacggaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgcgtctcctattattttatttttttttcaaaanttttgaagggcggggggggggg

SEQ ID NO: 28084 - DNA, 1841 bp, Heterodera glycines
  misc_feature (97)..(97): n is a, c, g, or t
ttttaaatttatttaaatttccaatttttttggctttttgaaaaaatgttgtctatttttcggcaggcactgcctctgtcattgttttttatttatntagaaaaataaatttattttttttctttttgattattttaattgtatttcatcctgaaattttttaataaacattttcaaactttcaccttattaatttaaggcgaattttgccttttttaataaattctcttgtgaaaaggcaaaaaaaggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaaactttttacttttttcacttttaaatttatttaaattttcaattttttttggcttttttgaaaaaatttttgtctattttttcggcaggcactgcctctgacaatgttttttatttatttagaaaaataaatttttttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccataccacgttgaaattttgtttctttttgattattttaattttatttcatcctgaaattttttaataaacattttcaaactttcaccttattaatttaaggcgaattttgccttttttaataaattctcttgtgaaaaggcaaaaaaatacgctcttttaaatatgcctatttaaatgactttaatttttttcacttttaaatttatttaaattttcaattttttttggcttttttcaaaaaattttgtctattttttcggcaggcactgcctctgacaatgttttttatttatttagaaaaataaatttattttttttctttttaattattttaattgtatttcatcctgaaattttttaataaacattttcaaaactttcaccttattaatttaaggcgaattttgccttttttaataaattctcttgtgaaaaggcaaaaaaataggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttttaaatttatttaaattttcaatttttttttggcttttttgaaaaaaattttttgtcttttttttcggcaggcactgcctctgacaatgttttttatttatttagaaaaataaatttattttttttctttttgattattttaattgtatttcatcctgaaattttttaataaacattttcaaaactttcaccttattaatttaaggcgaattttgccttttttaataaattctcttgtgaaaaggcaaaaaaataggctcttttaaatatgcctatttaaatgactttaattgctgtcctttcgcttacgaccataccacgttgaaagcacgccatcccgtccgatctgcaagttaagcaacgttgggccttcttagtacttggaacggagacgtcctgggaatcgaaggtgttgtaagcttttttacttttttcacttttaaatttatttaaattttcaatttttttt

SEQ ID NO: 28085 - DNA, 1497 bp, Heterodera glycines
  misc_feature (1458)..(1458): n is a, c, g, or t
ggacttacaaaaaactgtattggactcataaagggtcattgggactcataaatatttgattggactcaaaagcataattcgatgctcatttttgaacgtagccgcattattcaaaaggcaaatccgtagattattttgtcggctggcacatttgttccttttctttcgtcggtttttcctatgtctcgttaaaaatggtcggctggatggcaaaaaagcttattctgcaataatatgctcagattgtaaaatataagaagtacaaatatgaataaaaataaaagtacaagcattgaatgggtaaaaaatattattgattggttttattgccttccaatactatttaaaaatattaaaaaataataatttaaaacaattaaattattaattaattaaattcatttattccgtactgaaatgagcttttaatgaattcatttcgttattaaataatttttaaatgttagttttagtgaaaaaaaataaatatttttcgaattaatcgatacaatgaaactcattaaatttaaaaaaaaaataatgagatttccaatagattattttaagtccttcaaaatattttttttcttttataattaagtttatactttaattattaattttgatcgtcatgataaaattaatatttaaaataaatatttatcatttaatgaaatagcttgctaagaaaaagaaaaatgttgataagataaaaagtattgccaagtatttactgacaggacaaagttgcgcaggacaactgccgcatttctttttatgacgcatgaaaagtaattattatttaatgaactaagaattaacgcttcgatgattggtaaacaatttaaaatttgcggtcgacaaaatccagcatttaatgaatccaatttctcgagttttagctaatgaagtgctttggcttagtcctttagattacatagtaattaattggtctcattaacggaaatatttatctcacgcaccgatggcgcaacatatttgagtcattaaaaaagattcacaatttatttagttcctctcgtcagttctcattgagttgcccttttatgttgcatagaaaacaactttttttaccttttgagcattttatgatcagattcactcttgatctgttgataaaagcattcttcatcgaatttaacacattttgcaatagttggcagcaaaattttttgaaatactaatttagttagagttttttacaggagtttcatcttatatttcgaaaaatacttttttaatgacaataatatttttgggattcgcagaatttttaggaaaaaatgggggaagaaaattgttttcccaagtgaatttattcaaacggccgttaattatgttttgtccattagtaaaaacatatttaatcatttagaggcacaaattttttaaaatgattaatttataatactttcacttaaaaaataaataattcanaaattaaaaaaaaatcaaaatttttcataaaaaaatatt

SEQ ID NO: 28086 - DNA, 588 bp, Heterodera glycines
caccagacaccctttcccccctttagggtttcactgcagtctaagcggcttccggcagtaaaagtgaatgaattgtcgagaatggctgaattactcgttgcgagagactcagagtgctgctactcctttttatttgttgattcatttcgctcgaataaattatttggcggttgtgtttggtccagatcgatttgtcgactttttactctcgattcgggttcctaaaacaccgatagattatacagagaacaatttgcacaagatttaaaaaaatacacattgttagaaaagatttttaatacgaaaatttaaagaaaaacagtttttgaaaaataattacttactcataaactttccaattctcaaaaaaaaggtaatttggtttgtggttcgtaaccgaatataactttcggcacaaaaattaaatttccttatggagaaatggccttttttgctttcgattgtaagctgacgaatttaaaaatctttttgctgcagcccgacccagccccgaagcgtaacgaaggaaactcgaacgtttcgacgaaacggacctgggggacaaatcagtgcaattttcacaccccc

SEQ ID NO: 28087 - DNA, 1154 bp, Heterodera glycines
ccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataagctgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagttcatatttagaggataaggagttgaaatggtggaattccaaaaaggtgaccaagaaaattgtaatcgaagattattggcgattatcagctcggtcattccgcaaacactgattcagtttatatttcgcgacgaatgagctgtaattttgcgaattagacaaaaatgatcataaagtaacaaatgatgtcgcgacaacgcgaaatcctaagataaaacccaaaataaaaaagaggaaaaataaaaaacaatagaaaataaaatggggaaaaataaaacataaataataaaaaatatttttacatttagtttggaaaaataatattataaaaaactatcgaaaatataattacataaaaatgaaaaaaccttttgaaatgaataacggaaaattgttgaaaaggaaaagtgcatttcctcaggaatgaaaggaacgaaaattaattaatattaa

SEQ ID NO: 28088 - DNA, 1422 bp, Heterodera glycines
ccttccttttccatccgttgtccgtcgctttacgtttatattcactcgtcccagtgaaaggtgttcgtcccgaactcccgtctcgccatatgctttattcgtcgtcaaatagcggtgaattgttttctcgcgtatcctttcgtcctccgtctccaaataatccgcttggtcagtgggctcaaaatacaccaatttcgttagcgttccgccgatgtcgatgccgaaccaaggcatggcttaatttggtcaagttatttcgaattgaatggacagcgaaattggcacccaatcttacgacagtcgaggaaagtggaaatggaaaaagcccttcggcggccctgttgaaagcggtcaaaaagtgactcaatgtcctccagagaaatcattacagaaaggaggaaaggtaagtgaatggaaaaagattattttgatatgcaatctgaaggtggaggatggaactgagtgacagacagattgaattgattcgttggaatgtttcgctcacatttttagttatgcgagaattttaaactttggattttaaatttggaaagttttgggtaatttttatgcattcgtccattttatgacggcaattaactaacaacattgttgttaattaagacataaaaacacttttttgggagtgggctgatcatttgcgatttgatgagaagacggctgagaaacgaatgaaatgaaaggaaatgtttgactgtggagccatcgcattgagaagaaatggacggaccatttgggaaacgaacagccaaacgaggaaaagacagaagcgaaacggatgaaattcacattttgaacttgtgaagaaatggaaagtggaaaaagggagagaagaacattacaaaaagaaaagtcggacggaaaagcgaaaggaatgcaattcacatgaacggactgataagagcaatctgaggaaggaaatccgaggataaagcgaaggaaaggtaatgggtccaagttttaaaaattacaaaacaacatttaatagggaattaacaagaaataattgagagtgaaattgctttaaacgacttacgcggaagtgaaattgacggaagtcgctttctgccgctggacgcatttgtttcttctgatgttgccgtagcacaatccatccgagaagaaattgagcaaaaataaaaaatagaaatatgcaaggaaaagtaattaattcaacaagagatcccacaaatggaaaaccaaaatcaaaaaggaaaaaagattgaaaaattaaaaacatttcgccaatattaattaaatttgaatgaatggtggtcagtgggttaaactgtaaaaagatataacgattttcatttttctacagtatatgttcaaaaaatacaaattcttttttgtgtatagatgaaagcattggctaaaaccataaaatgttgcccatta

SEQ ID NO: 28089 - DNA, 1375 bp, Heterodera glycines
ttgaatatcgaatttggtttctgaaaacaaatgctatcataatgaccaagaaaaatgtgaattatttgccaatttatttgtaaattcgtttaacaattctgaagttgatccaggctttctaagcttggacaacacttttgttaatcaaagctttatatcagatatagaatttaacatcattgagacccaaaaacttttaagaaaacttccgaataaaaatggaacttctccggataatattagctataaaacattgaaaaattgccatccttcattagcaactgttattactgaccttttcaggatttcattagactctggttctcttccagatatctggaaggaatcaattgtttttccccttttcaaaaaaggggataaatttaattctgaaaattataggcctatttctataacctgctcactttgcagggttatggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttactattatacaaattggaaaaaattggtataaagggcaaacttttgatgtggataaagggctttttgagtaataggacttttcgagttaaaataggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattgtatatatgctataaagcaagagcagatacagaaattatgcataaagcattgcataatttattcgaatgggcaaataaatggcaaataaaagtttcagttcaaaaaacttttgtattatatttgggttcaaaaaacccaaaagaaacatataaatttgatggaaatacaataaatgctgtggatacaattaggaatttaggagtaaacattgataataaattacaattttccgatcatgtaaacaaaataacaaggaatgcgtatttacgtatgcgttccttgtttcgaataattaaatccaaatcatctaagatttggattacgttatataaaacttatattaggccgttattggaatacgctccggaggtttggaatccgtctcttcaaaaaaatattaaaaaaatagaaaagtgtcaaaaatatttcaccaaacgggtattttttaaatgcagccttccaccaattccataccaaaat

SEQ ID NO: 28090 - DNA, 1284 bp, Heterodera glycines
  misc_feature (1268)..(1268): n is a, c, g, or t
catcatcagatgagcagaagcgaatgctcacaaaagatttttaaaaaactcaaaattcgaccgccaaagtctggaaatacgcccctcctccctgggcccgtaccgtactaaaagaaggtggtcatggacaaaagaccacgaaaatggtggtaaaacccgttgaagaagaagccagttcgtggtcatttgacgatagttggtgttaaaaatggcatttcgtggtcattttttatattctaactggttcaccaccgacttcgtcgtcattgtgaccaggtcattaaccatggtcgtttgatcagcaggtcattaacggttttagtgcactttcggcgtccaatcttcatttttaggccatagctttttccttacttggtcaatgctttacattcttggtataaactgaaagcctaaagtcccgggaatttattaaaaaaagaaaatactaccattaagaaaaaataattacaatgagtaaacacgaaacgcagctttttcgagtatattcatgaataattttttgttttagcgccgatttaagtctacaaaaaattctatagactttaggcttttgtttgatacaaagaatgtaggcattgaccaagttggaaaaaagttatggccaaagaaactgaacattggacgtctaaaatgcattagggcctacgggccattggcatcaagaaaaaaaaagatttcgaacagttttggttcagcagcaggacattaacaaagacaaaattaaaatttccaaaaatcagaaagaagggcactaattaaatgagacgagtaattagttaattgttcgctcaaaccttttatcgtttcttaaaaaagtaaaaatcgagaacaaaaaaattcaaaattcatttttaaagtttgtcttgcctattattctattattcaattaaaattcaaaatttattttatccaaaattctacttccaaaaatcccttaattaggtaacttattggatgaatggggaagcaaagaattgtgatcccttaaattgggttgatcagattttggctcctttctttacactgtgaatgcctcgtaaatcggcttccccccccccggggaattcccaaaaaattttctgttgcccaaccctcggggcggggctgtgcttttcgtctcacaaatcagttctcccccaccattcgtcgtattgcaaaaagatttgcttcatcctttctttcgctgcttttgcttcttctcttgttgataaaaaatgtaggaagaagacaaataaatgggaacagantgtgtggcgacctgca

SEQ ID NO: 28091 - DNA, 1816 bp, Heterodera glycines
  misc_feature (1643)..(1643): n is a, c, g, or t
atttccgttggttcaaatcttcaagtcgaattatgtagctggccgaagaagtggtggcatggagaaatgcctaaacacaatggaaatgaaaaacaaatgacggtaatactaccgatggtacccccccccattttttttggtagaaaaatttatttcttataaaaaaccgggaaaacatgattctgaggcgtattgtcgacgtgcgcatcacaaaagaataaagtttcctgtactagataagatatttctctctaactttttgtgctaaattaggaataccgagaacggcagattttgttcgcaaacaaaaaagaagttagtatttattcaagccttacgaaaggaacctcgtaatattggacagagaaaggcatgtagactaaatgaaaacaatattaattaagtcaaattaagggatacacaaggcaaagtgccaccaaatgtcttaaaataatttacaatttgcttcgtcgaaaagtacataaaaacaatttgtttttcgggtctttttattgtaaaatataatttccggacattttaactgattggcacattacgtcaaagtgtttcatggtgaaatttttgtactttaaattgttttcaacacaattagtaatttaaaaaataaatttaattttcttttctttttcattataaatgaagtcttacattttcacactcagaagacaaatattttttaaatactctgaataaactttttcaatttttttaattgtaaaattgccaagaaaatatttattctgctttgttatttcgtaattttttttaatgttttcaaattaattaagctaaatgttgtccgtcctttcttttgtgtgttattccatttatgaactcgtctccattttggtaataatttcaatttatgggtcagataatttatttttttataaatttaattgtttttttaaataaatgtaaggaaattgcccattttgtggtcaatgttgtgttctatcggttgcccatttttgctcccacttgcccatggttcggcacgtcgccctcggcactttacaccattggcacatttttggtgtattttttcgaatatctaatttatgtgcttcatattgccatcacccttaatcgttgctcgtgcgtttgggccccaatccggcacaaagaagtaaaacaaacacataaacaatttacaccattacattttctcagttttggtgccgtgcttgtgagccgacaattgcgtttgcttttgctctttctttggcattttctgcccaccgtttggtcactattgcccagttggtccaactcgacaaaacggacccgtccaagggctcaattccgctcattgtcacctaccaactttattttgtatgttcaaatttttgcgaattcatttgaaatttttgtggcacttcgtatcgctctttgattttcttgggattttcagaaattgaacctaacttttttttaatcaaaaacaggaaaatcgcgttttctaatattttattgtgaaaaaaataaaaataaatacaaagaaatagaatatgatacaaaaatttatttaatattttttgaagcctattatttaaaaaaaagagttcttgaatttttttttgtcctgtctgtgcacattattatttaaaaatattcactanattaaatattatcaaaatgcatagcatttggaaagtcgaaaaaataattttaaatttacattgtcaatataatgcaaattgattaatgattaaagtattatttcaatttaaaattttaaatttatctttaattattaaaattttgaagctattatccgattgattccaatttg

SEQ ID NO: 28092 - DNA, 866 bp, Heterodera glycines
ggaagatgaatatagggaacagaaagagcacaaaatttgctacaaaatgcaaaaaaccaccatgtccctatgacttctgtacgctgagaaattacttgttcaatttcgaagtgtaaaaaagtactgtaattcctaggaaaacagtgcaaaaaattcgtgccggaagacacgttcgtttgcgtaaaattcgtcgtatttcgcttcatttaggaacctttccctgactgttgtaagggtttccgccgttttgcagctgctgatcagtgatagcttctccagtggccaattcgcgagaccgaactgttccaggcccataatttggccccgaaatgatagccaatcgtttgttccattacctgttttacgaattttttcttaccgaaaatttgtagacttaataataatttattagtgaagcccaagagaattcaatggccaactcgaaaaaatggaaaagccaagaaaaaaaggccaaatgagttccaaaggtggcattgacaaatgagttgcaaaagtgcatgccaaacacacagaaaagccaattaaatgctcacattgcataaaaaaagggcgggggagggctaattaaacaaacagtacccgggggttattatggaaactgaaaagccaaaaagaaaaacaaaaataagaaaataaaatattaaaattagagttgtaagggaccgggaaattttgccaaaaaattgtgtcaattaaaaaaaactatgaggaatcaaattttgtcgataggtaaccaatgagtaaacaaaaaaaaatcaaaatattttaattcctgcagaggaattgaaccatggaaaagaagaagggaaagacaaggagactagccactaggccatccgcacaat

SEQ ID NO: 28093 - DNA, 1042 bp, Heterodera glycines
ttcctttccatggccaaccggacttggttggccagggtggccaatcacctggcttggactggccacattttggtccgcggaaatccctggaaaaaatatttatttgctttattatcaaataattagtttttttttgcctttgcttgggtttccaatgtgcacatccgtaacttcaatgttcttttcttggccaattgctttgattgcttggctttcctgtacaaatttgcttttcatgttttgccattctgtgtcgttgcccgcatggccatcagcagcagcggccaagtcgaacatggcacgggcaaagcccaaattgtagggacactcatcctcataattgatttccatttttgcaatatctttatcaggtaattaggaaaatttcatattaattagtttatgtcttacaatgatctgattatagtattgtaattactagtactgacttacgtgtcgatgtgagtcacacgttgtgctgattcgagcctggggtgtagcagtacacggttctctgttacccgatctcacacctccgcgtcattcacaaaaatgccattttccctttttaaatgttggcagtccttttaccccatccttccacgaatgcccccccccgttttatgaactttactcacccctcctttccattgctgcggtccgctgaacactgccacaggctgaacaaatgtcgccattggccagccgcactgctgtacactgcttctgctgctgcttttgatcagtcttcgcgcctgtgacggcgcccagcgaatggcaacagcgaatgttgctgctgctgctgccatttttgccaaaaaaaaatcagaaatagaatgaagacctgtagaaaaaaattgatatgacgccgcgggggggagaagggggaacaaaaaatgtgttggatgtgagtgggggggggggggaatttctcttccaaaaatatgtgaaaagagagtgagagagcaagacaaaaaaaaagagataacattaatgttgaaatagtggaaggtagagaaacagacagaataggaaagaagag

SEQ ID NO: 28094 - DNA, 1076 bp, Heterodera glycines
  misc_feature (1071)..(1071): n is a, c, g, or t
gccaaattggcaattttgggccccggaaatgtctgtccaccaaaaggtcaaatcggtcggagagaagtgccaatttgagcccaagctgggcacggtcaacaaacggcagaatgtgcagccaaacgtcgtagcaaatcgttctgaaatatgcggggggaaatgataaaaaaataattcatccgaaaatttcaagtcgcttttcaaaaatttttcctttaaattttctctaaaattttttccgaagatttataaaatttaaaaaaaatcggggggggggggattttaaattattacttaaaaatcagggctggagcgcgaccgcgatgcgcgattcacggcgttttttgcgcgatccgcggtcgcggcaatttgaatgcgcggtgcgcggccgcggttttttttttttgcgcgatgcgcggcgtgccgcgcattttttggttgtaaaatttttataaagaaaatttttttaagcgattgtttttttgaatattcaaaatttaaataatttttttttgaaaattggattattttcataaaaaaagttcgtttcaaaatttcaatttttccccgtcagagctgacaaaacctttaatttttctttaaaaaaaattgactcgaaattacaaaataggtcattttttacaaaactttaaccaaatcgcactcaaattttcaaaaatttttcccggcggcgcctatcggcaccgccggatccagccccctcccatcagtccccaaaattttttagaaaaatcgcgccgaaaaaagctgtctgaaaaacaaaaaatcatagggtttccatgactggaactctttcgcaaatttgaacactgactcaccccctcccccattcagtcccttcccaaattttatatgcatcgggattttaattaattttttatataagaaaattttttaaaaaaagttttaaaaagtggtttaaaaattagaaaatttgagtttttaaatgcgcgatccgcggccgcggcaatttgaatgcgcgatgcgcggcgcgcggttttttttttgcgcgatgcgcggccgcggggccgccctttttttctgtgcgcncccca

SEQ ID NO: 28095 - DNA, 558 bp, Heterodera glycines
agactttgtgtttataaatcatcggatttacttcgttgatcctaatgacccaagagttcacactcaaggcattgaggcgacatggagagcactcaaaaatggattgcggcacttacacggaactaactctcacatgttacccacctatctttgtcagtatatgttccgtcggttccatggaaattcaaaaattttccaaaatattctggaagaaattcgataccaatatccactatgattgtggctttactttgtgtattggctattttaggctgacaatttgaaaaaaataaaaattggattcaaaacaaatcattggactaataaaaaaattattggactcataaattttcataggactcataaatatttaattggactcatatactctgattggactcataaaaatcagattggactcataaagtgcactagagccgaaaatcctttcccttttagtaaggctaatagagcatgttaagagctttcgaatgataccaaaattgttggatgccaaagaaaaaagcttaagtggaaaaacgtgctggcgccgaaacg

SEQ ID NO: 28096 - DNA, 1073 bp, Heterodera glycines
attcgggtgtatgccccgaataagccaactgacgcagacggaaatgtttttggtgaggaacattgttgccgacggaattcgatttgactgaacttaatgttcttgtgaaaaaaaggacgaatgattttaattttacgaaaggaggatgccaaacaatttaaaggattattttgaatgctattctgtaattatttaatgttttgtcccttatttttttttgttggccagcacgaaaagttaaccatgatctgagcgcctgtcgttaggtttgtttaatatttcgtgttatgccatattgtaaaatattcttttattaaatcattgattcactaaatttaattgtatctctctctctgtatttagtgatcttaatcatttaatctgtcatcataattgtaaacattttttgccatttctgaataaataacaaaaaaggggacccaaggtttttcgctgtttttgcctccatgcggcttcacgtggcgggtccctgtacgtctttcgcgcaccaacagcagcagctgctgctgtaggcaaagatgtcggagatgcggaacataaaacagccatacccaagaaacaaacggcggatagtcctagagacgcggcgcagccgcgtccctgagcgcgaagcgctttcccctcagcaccagaagccgactgtccaccctagttatatatacgttatataggttttgagtttcgtttcaaaaactaattccggccggccgaaggccggcctgggtctgaaagtagtggaagggtcttacaactttttgaggagaatccgggaaaactataggttttttgatccgagcgccaactgagtaccagggaccgatttctcacttttgtttgtatttcagggaccgtaactttttttctaaaactcgaatcaaaaagtgcccgctgtgagggcactccgcctaagggtcctctacaaggtggtattttttatttttttattagagccaccccctgacctgcaaaaaagggcaactgaagcgtgctcaaaaatgccacttcagttcaaggggaatgccgcgccagggtttgatctgagcggggggtgg

SEQ ID NO: 28097 - DNA, 835 bp, Heterodera glycines
aaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccctcggaatagcttccctatagcctgtactttattctgcgttggatttttgctcccataattgtttgagtaccccaaacgacacttgaaaaaatcgatttttttgttt

SEQ ID NO: 28098 - DNA, 1133 bp, Heterodera glycines
tttttatttatttagaaaaataaatttattttttttctctttattattttaattgtatttcatcctgaaattttttaataaacattttcaaactttcaccttattaatttaagcgaattttgccttttttaataaattctcttgtgaaaaggcaaaaaaaggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttatttcacttttaaatttatttaaattttcaattttttttggcttttatcaaaaaattttgtctattttttcggcaggcactgcctctgacaatgttttttatttatttagaaaaataaatttattttttttctttttaattattttaattgtatttcatcctgaaattttttaataaacattttcaaactttcaccttattaatttaaggcgaattttgccttttttaataaattctcttgtgaaaaggcaaaaaaaggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttttaaatttatttaaattttcaatttttttaggcttttttcaaaaaattttgtctattttttcggcaggcactgcctctgacaatgttttttatttatttagaaaaataaatttattttttttctttttattattttaaatgtatttcatcctgaaattttttaataaacattttcaaactttcaccttattaatttaaggcgaattttgccttttttaataaattctcttgtgaaaaggaaaaaaaataggctcttttaaatatgcctatttaaatgactttaattgctgtcctttcgcttacgaccataccacgttgaaagcacgccatcccgtccgatctggcagttaagcaa

SEQ ID NO: 28099 - DNA, 679 bp, Heterodera glycines
aaaaaaaaaatttttcttgtatttttcttacagaaaaattgcctaagacttttttcttgacaaatttttaggtttagaaatttttttaaaaaattttgggaggggaaatgtagtgcaccccccccccccccctaaaaaaggaacaagaagaggaaaggaaaagccaattccaaaattttgcgttttttcaaattttattgttaattccaaaaaaaaaaaaaatttcccggcggtgtcttcagcaccgcaacggtttgccaagaattgcagaaaatgtttttttttcgttttctgtctgacatcataaggccaaggagcaaacaatgaaattaaagaaaatcgcccaaatttttcagaatttttcctctttttacctactacatccacctcttttacaccggcccccctacgacaaggggggggggggggtaagtgtaggcaccaaaaagtttatatatatttcattacatgccaaacaaaatgacccatcctcggtcaatcccccttttttttgatttggcatttttcaacacggtattataatgactgatttgttttttctgtatagatgatgagtttttccgaccgcacgattcgggcatcagcacaacaacgacgggggaggcggacgatgatgggacggaggagcgggagcagtacatggacaaaaacaacggat

SEQ ID NO: 28100 - DNA, 1386 bp, Heterodera glycines
  misc_feature (1366)..(1366): n is a, c, g, or t
tgcacttccatcatgctcatcatcatcgtcttccaattcgccgttgtcgtgtaaatttcgactgaaattaaacaaaaatttaattttattttagttttgaaataattatctaaattatattatgaattgttttgtttgaaacttccgagtcaattttgcccggatcaggacagcccagattcatacaaatcactaaactcagtgaccatttaccaacctaattaattaattggtttttcaaaattcaataaaaatataccgagagcgcacaatcagctctatttcgcccaaattgctcgcctgaatcacccgttccacttcttcaaacgtttttccgctcaacaaaacgccgttccattcgagaatcttttcaaggtaaacattttcaaaataattttggcaaaaaattttgaaccaataaaaaataagtattaaaatatactttatctaattatttaattttaatttttacttgatctccttctcttaattcacccaacatttcttgagctttgctgctaaaaattggaaattaaaatattatttaaattaacaaagcaaaagtaattaaataattgattaaataaattatttataatttacttaatgtttatttgatttacctgtcaatctttgttataaaagcacctaaacagcgtaaaatcattcaaaaaccttaaattatttcgaagaattgccaaaacgtcgccggaagattttttggacaataattttgttcattttcaaccaaattaagcattctttcttggtgttgttaaaaaagttattgtccaaaaattcgtctggcgacgttttgccttctccgatttcacttacccaaatcgccgtttgatagctaaattagaacacaaaaaatataaatttaaaattgcattgtttttgcttaccttttttcctccaacaattcgaatgcccaaatctgaaatcacaaattaattagaccaattaattaattgattgatttttgaatacctttaaaaatgttttcatgtttgtagtgccgagttagcagaattcgtttcgtttcggctgatgttcgattgcgcgaccaattctctgtcgatggcattaaccgcggagtctaaagaaaagcgatacgcaaagaatttttataaaataaataaaaattgcgaaaaattttattatttctcataaaataatttttcctttttaagattctcattcaccttaatgtttgaagaagaatgcgctcttctgttggtgttgttcatctcctcataagtcaatgaattgtctgaattcattttgagtaattaattaatgaattaattaattcttccaatttttaattaaattaaaataaatatttaattgaaatgcccanaaaatggcggtagcacctct

SEQ ID NO: 28101 - DNA, 777 bp, Heterodera glycines
tcaatcgggtacttcagcgtcagaataccacgcttggactgcgcctcgtctcccacgtacgagtccttctgtcccatgccgaccatgacgccctgatgacgggggcggcccacaatggacggaaacaccgcgcggggcgcgtcatcgcccgcgaaaccggcctgaattcttgcaattagactatgggattaaatagtgccacaaattagaattttttatgtcaatttgcaaatggcattttgccctccttgttttctttcctgtctctccctcactcatcttttcccttctctctctctttcatcttttcctcttacctctccctcccccacccttttccccttttcacacactctctttctctctctctctctctcgttcgctctttctttctctctccctctcttctctccctccctcactctctctctttcgccctttctttctctctctatctctcttctctccctccctcactctctccctcccccacccttttccccttttcacacactctctttctctctctctctcttctctttcgctctttctttctctctccctctcttctctccctccctcactctctctctttcgccctttctttctctctctatctctcttctctccctccctcactctcaccctcccgctcccttttcccctccctctcttctctccctccctcactctctccctcccgctcccttttcccctccctctctcttttcacactcactctctccactctctttaaccctctttctctcccctccc

SEQ ID NO: 28102 - DNA, 1007 bp, Heterodera glycines
aatttcaatttgcggatcctgttgcaggattggaatccaaaattttttacaggaccggatccggccggattaatcctgcaaatcctgcaatcctgcaaatcctgcatttaaaatttgccggatcctgcgcaggattgcggatttttggaaattttgaaaaaatttcaattaaatttaaaaaatttccaaaacgataaataagtgttccgatatatttttagacaaaaactggtgaaaattaatatgaaaaattgacatcaggaatagaatgaacaagcgcgtcctcatacctaatccatatgtatattataaaaacaaagtttctgtatatttgtcattctgtcttagaaatttttttaaaaaatcaataaaatcccgcataatcctgcacaaacattcaaatttgcggatcctgttgcaggattggaattcaaaaatgtttgcaggaccggatctggccggattaatcctgcaaatcctgcaaatcctgttttttccaaaaaatgcaggattgcggactgggatcctgcaaaatcctgtgcaggatccggtcctgcgccgggctctaaataaaacctaaaatttatacgatttgaagtttagagatttttaaaattatctttcccattttaatacctccaatttattaacatgtacttttatatttgcggtttttcttcataaaatacattcttatcacagataattatcattattcctcatttaattgattcatttcttccgctgatcacagtttttgttgttcttttgtccctcactcatcattgtcagaattcattcacttgggtcggaagtgccatcgataagactaaaaattgaaaatggaaatttgcaattaaattgtattctcaatttactgacccgtctccgatttcttcctcattaatagcaatttgaattgtgttccaagggtccttaaaattcaactcaatcgcttccttctcctcaataggtcccatttgttctcatcccgcgaaatcggacaa

SEQ ID NO: 28103 - DNA, 984 bp, Heterodera glycines
  misc_feature (959)..(959): n is a, c, g, or t
aaaaagtgtgaaaaattttggaaaaaaaattcctttaacttttaaaaaaaaacccattttttgctttcctatcctttttaagggtaggattggcctctttaaccaacataaaacggttaatgagtttccggcacacggccacgaggaggcctgcgattggtaatggtaccttagtgcgccttttgtttttttgaaaaataaaaagcgaaattaccgaaataaaaataatttttgatccgaaagaaaaaaaacgaagggtgtaatcgcagcactgaagcaaagaaaatttaaataaaaagaaccaaaccaaagggcacaataaacctccaaagaggtgctcccagtggcttaaaaggaaaacagcaattattgatccatattaaaattgtgtgccaacccacgcaaatattcaatgtttgtacgttgctcattccccccttgaacaatctccaaaattcgctcatctattttgattcaaaggaagcgaaaaatggttttttttaagtttaaggaattttttttcgaaatttttcgacgctttttgtcccgacgatgttttgtctcgacgacgttttgtctcgacgacgttttgtcccgacgacgtttcggcgacgacgttttgtcctgctccggagcggaaacgagggtattttcaaattcgagaatggcaccgaatgagtgaaatcaaaaaagagattgaatttgttggaacaccatcacactttgttcatggcgtccaacaacaccagcgggttcatgtggccatccgccggccgttgggccattcgtttcgcatttttggcctcagtctcagcctcacgctcccgcaacaattcggcccacccgcacggcgatttccatccgcgcgcgaccatttcagtgcgaaggccgaccaaagtgagcgccacgtccgcctgcacagcgacggcactttgccaaaacacgtcatggttctgtgngaaagcaaagcatcagaattttgaa

SEQ ID NO: 28104 - DNA, 1057 bp, Heterodera glycines
cgaaattaatggcaagattcggattcacccggcccttaaaacccttaatacgatcttttctcgacaaaaaatttcaaaattttgattttttgaaaaagggggactaccatcggtactattaccgaaaaatgcataaaaataagaacattgcagggtctttttgtgatggtgtagggtcagttccgtattgctaacataagcaattatataatttatacaaaaaagttgcatcatgaatttatatcgcaaaaaaaaaaaaactcgaaaattttgcatattttaatgaaatttaatatttttttttaattaataaactaattaaagagtggcaaaacaataccttgtaataacaaacaataataataaaacaaaaacaggagaacaataataaaaagcgatatgaaccgggacttgatgaaaaattaaattcgctttttggatgacttttagaccttggattattccgtagtaacaatggaaattggacaaaatctcggtttcagtgtctatttcaaggcatttctttttgaaaaaacggcttccgggtcctagaaaaatccaaaatgccaatgaaataaatcccagtccatccgccggtctcgaattgtcaccaagaaaatggattactcttcccaatcgccttccaatttgtgcctgattctgagcccgtgcagcgccaccaaagcggccaccttcaaaaattctcggatcacaaatattcattcagagaaatttcgtatgaagtgtacttgttccgccattttgacgttcggttgtgtcactgatgagcaaaacttttggccgttcacacaaacagtgccggaaaaccggtggtcaaggccaagttttcgctaaaaaaaaacaaaaattattaaaataaaattgttggtccaaatctccaaatggcatctcctcactgtctgaaaaagtggcacgtccaactgttgctgagtgcaatgccttttgagcacacattttggtgtctgtttgccgttgacaccgcactttaggcttcgtctaaattttttttaaaaacccggttaaaaatttgtctaat

SEQ ID NO: 28105 - DNA, 1080 bp, Heterodera glycines
agtagagaccggacaactggggtcggagggatcccgagtcgggatcccgactgaatcccgatcccgatcaatcccgaacattttgaaaaaacgatcgggacggatcccgggtcgggatcccgaccgaatcccgatcaatcccgaagatttttttcgggatcccgcgggattatcgggatttgctcaaacccatttttttttacttaatatcaatttttgtattttcgcctcagatgatcatttttcataattttgagaaacggaatcaaaaaatcagagtccgatcttcactttctttggccattttagggcgtttgtttgatgcaaagaatgttggcattgaccaagtaagaaaaaagtacaaagttatggccaagaaactgaagattgtaattataaaagtcggttggacttataaaaagcaatagaaccaaattatctttcatacattcaatatcgaaatttatagagttcattttaaaattcaaatcttccaaccaattcctcatcaaaatgctttctcgcttctcctacgatccgttctatcgccgttcgttgttgcctatgaccactgttggcaacggacgacaccagggatgttgatcgtttcgtgtttttagggtgtttcgtgttcgtatttcgtattttggcacgaaacatgaaatttttaagcactggtaaggatgggtgaggggtgagagaaaatattttttgaaaattggagaaggaaaatttatttgaaaaaaaataatttgttcagttcttttacaccataaaaagaaataaatatatagccgggtggctaaacctcctgtctttctttgatttttgccttagttcgaaccccacacataattgaattttttcattgttccttttaaatatttgttgaagtaagtaaatgtaagatatttttaatttaattactagggagtgtaattatatggatataaaattgcgaagtatggccataaaatatcgaccaaaaatcgcgaaatatggacatataatggcaaaaatatggacataaattttccgaattgagcgctaaattttcaaaaatttctcaaattcattaaa

SEQ ID NO: 28106 - DNA, 2238 bp, Heterodera glycines
tcatacatacattttcagattcctataaatgtactcattttatagcgaattgacaacttccagtactaagggtatcctcatgggcatattcccatgagggtattatctttaaaaattttagtatttctacatgtatgactcaaagtgcgttaaaatacgcttttattgcagtttagatgactttaagcttttttcgtgtattttaatctgattcgacccaaaaacacggaattcgaaaatttaatttctcgactttttgttcgaatttagttcaggggtatggaattggtcgaaaactaatgccgcattttatgatcagcgacctcgaaaagcccttgagttcaagttccattaagtcggctcggatatattaaattttttatttcctttaatttagattttgtgaaaggcattctgtcccccaccccactccggtacagtaagaaggtgccctcctcccccgttgttgccttaagggataaaacatagggatggcgggaaaatccaattccggtttgattttgggtgggcttgcccccttaaaaccccaaaaatggaaaaaccatccccccaggaaaacaaatttttaaaaaattaatttttttttttttaaaggggcttttaatagaatttttttaaaaaaaaatttcccccctttcgaaagttttttgcttttaatttttttttttttttggccccaaaaatttttgaaaaaaatttttaaaaaaattttttgcccctctttaaaaaaaattaaaaaaaaggggggtttttctttttaaaaaaaaaaaaaaaagggggggccccccgagggccgttaaaaatttttttaaaaaaaaaaccccccccacaaaaaaattttttataaaaattttttttaaaaaaaaaaaaaaccccccccccccaacacaaaccctttttttggggggggaaaaaaaaaaaaattttttgggggggttttaaatattcttctccctccccccaaaaaaaaaaaaaaaaatatttttttttttttttttttttttttttttttttttttttgtgtggggggaaagaaaaaaaaaaaatttttttttttctccccccccacacaaaaaaaaaaaaaaaaaactcccccccatttttttttttttttccacaaaataaagaggggggggggggggacacaaaaaaaaaaaaaaaattatcttctccccttttcctccccccacccaaaaaaaaaaaaaaaacctttctttcgcccaaaaatttttttttcttccataaaaaaatattggggggggttgtgggaacccacaagaaaaaaaaaaaatttttttcccattttttgttctaaccccccggaaaaaaaaaaaaaaaccctttttttgcgaaaaaaattttttttgaaccccctaaaaaaaaggggggaggttggggaacacccccataaaaaaaaaaaattttttccccatttttgggtaaaatcccccgaggaaaaaagaaaataccattttttcggcaaaaaatttttttcgttaggcattttcaatttcggggtgagtgtttgggagagccagactagagaaggcaaaatttgggaccaaagtttgcggtcaaatccccaagagaaaaaagagatagccattttttgggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgtttgcatttcaaatatcgtgtgagtgtaaaggagagccagactagagaaggcaaatgttggtaccaag

SEQ ID NO: 28107 - DNA, 797 bp, Heterodera glycines
  misc_feature (29)..(29): n is a, c, g, or t
  misc_feature (743)..(743): n is a, c, g, or t
aagaggctctccggaacggattagcatcnggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagaaagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattattcacaatttctgcagctcttangggtatggaaaaaatttttgagaggctctccggaaacggatagcatcggggtta

SEQ ID NO: 28108 - DNA, 885 bp, Heterodera glycines
cttcgttttacaattttaaatctcataagtccatcgtaatctcttaattgttcatcggaccagaccacacggcacggcaaattgtaaagaatcgggtgaattaccggcatatttggccactctttttaagaaatgaatacgccttggtaaattttgaaaaaagtataagagtcaagcagcagaaatccaagttagagaaagacaatgtgcgaaaaagagatagtcagttagacagcaggggagagagagagacaggaggagagagaaaaagagagaaaatgagagagaattagagagagagaaggaggaggagacagggagagagagagagagagggagacggggtgagaaagagagacacggggaagggggaaagagaaagagagagagatagggagagagagagaggagacagggagagagagagagaggagacagggagagagagagagggaaacgggtgagaaagagagacacggggaagggggaaagagaaagagagggagagagagatagggagagagagagagggatacggggtgagaaagagagacacggggaagggggaaagagaaagagagggagagagagatagggagagagagagaggagacagggagagagaggagacagggagagagagcagacagggagagagagagagtgacggaccaactcttccgtcgtcgtcccttttcgcatctcatccccagtgttcttccattcattccgtcacctccttcctcatcatcttccctccatcccctcaccgctaattcttcctcccctatttgtccgtttgtccgtttcactttattggtaaaggaaatgggccaaaggggggggggggggcaattcatttcccttggggtggggattaatcgg

SEQ ID NO: 28109 - DNA, 1121 bp, Heterodera glycines
atttatttattctgttgaactgtggaaatgcagctgatgcggtcggaaaagctccgattttttggggaagttttttcttcagttttcaccactgatgttgaggcaattttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggccgatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacagtttctaaagaggaagaaaaaaaatttttcatttgcctaatatttatttatactgttgaactgttggaaatgcagctgatgccgtcggaaaagctccgattttttggggaagtttttttctttcagtttcaccactgattgttgaggcaattttttcgccaatttcttttgtctacaaacattatttattgcgtttcatcctgtagtgtgtaaaaaattttcagt

SEQ ID NO: 28110 - DNA, 589 bp, Heterodera glycines
atcggtggggtaaacgcgccgtttcgacacatcaatgacacctaaaaaggacaacaaggaattttggcattttatcgtaaacagtgcaatcttctgacctttttccactcgaacgacgacaacgcattcgctcctccccactttgatcaatttgttgacagaacgaattcgacgccgggaaagttccgaaagttggagcattccttctgaaaaagcaaacatttgacaaaacgtaaataaaaataacattttgcatcttttgtacctttattgtcgtactccgaaagtgtcacatatgcgccgacctcctcgattttatcaattttaaccattacggggtcgtcaatttccgggaattcgtccgcataaaaacggcacgaaagagtagccattataagtgttttaaaaggaagttattcaaataacataaaaaggataaaaaggcaattatgtagaattgtggtcccgaaaaaaatatgaacttagattcataaaaaataatccgcagccaagcggattcgaaccccagaatttgtaaaattattcatgaaatttttatggccttatgtcattacctaatttaatattt

SEQ ID NO: 28111 - DNA, 1446 bp, Heterodera glycines
  misc_feature (50)..(50): n is a, c, g, or t
  misc_feature (467)..(467): n is a, c, g, or t
  misc_feature (1224)..(1228): n is a, c, g, or t
  misc_feature (1345)..(1349): n is a, c, g, or t
actatttcgtttcaaattgaatcattttttttggctttttgaaataaatntgtgaaaaatatacgaaaattattttagcttttaattatgcagtacaatgcttttaagccccgccgtgaggcgggacagttacaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaataattttttttggctttttgaaataaattgtgaaaaatatacgaaaattattttagcttttaattatgcagtacaatgcttttaagccccgccgtgaggcgggacagttccaaaattttgtaccacattttactgtgnaaagtccaagtaccctaattggacaactacgtgtcaatgagcacagtcgcctttggccagttgtggaaacgaaaaaatgggaatattaaaggggggggctctttttctaaaaatccctcttttcggcttaaccatcccctcccttttgggcccaattttcgtttaaaattgaaaacatttttttttgctttttttaaaaaaaattgggaaaaaaataacaaaaaatttttttcgggtttaaattttgcgggaaaaaggtttttaaagcccccccccggcggggggccccccctttttgggcctattttttattttttaaaaaagtggtcccgggattttttttgttttttttaaaaaaaaattgggaaaaaaaaaaaaaaaaaaaaattttttttttttttttttttttcttttttaaaaatgtttttttttacccccccccccgggggggggggggaaaagatcccccaaaattttttttttcccctttttttttttttgggggggaaagaaaccaaacacacctcttttttttttttaaaaaaccctcttcttttttttaaaaagaaaaacacccccccccccccttctttttttttgctttagggggggggggaaaaaaaaaaaaaaaaaaaaaaaaaaaaaaaaaaaaaaaaaaaaaaaaaaaaggggggggggggggggggggggggcgccaaaaaaaaaaaaaaaaaaaaaatttttttctttctcgggggggggggggggaaaaaaaaannnnntaaatttcccccccccccctccccccgggcggggcggggggttttttttttttttttttttttcttctcctccaaagggggggggggggggggggggggggggggggcgcccaaaannnnnaaaaaaaaaattttttttttttttttttttttttttttttctccccccccccccccccccccccccaaaaaaaaaaaaaaaaagaaaaaaaaaaaaa

SEQ ID NO: 28112 - DNA, 1040 bp, Heterodera glycines
tgaagaaaaaaattgctaaactcattaaaaacaacaactccgttcgagttgctgtgaggtttgtacaaaagacatgtccataattttttttttaattttaaaaaattaggatcagaccgcaaagtggcaaagaaaaagaagagcccatttgcctgagcgtaattcctggcgaaccacaacttactattgggcgcgataaatcttttacatacggttctaagcttaaaagttttatttgtaaaagttggctgattttttagatttcgtcttcgaccaactgactccgcaaaagaccgtttacgacaaatgtgtgagggaactcgttgatggtgccttcgaaggatacaatgccacagtttttgcatatggacaggtttttgtttaatttgaacaaagttcaaaaaagtttgtcggccgttcacagactggcagcggtaaaacatttacatgggcactagcttggagggcgacccggctaaaagaggcatcataccaaatgcggcacaacaaatctacgatgaaattgaggaaaggcgtgaacaggcccgcagatctggcaaagtgatcccctcttttgaggtttccgctcagtttattgaggttcgttggtggttgtgacaaacaaaaagtattgccccaaaaatcacgatttggcatttggaatctattgcattttaggcgtcataccaaactaaattctaggctaaatgcaacaagcagaaaattatgaccaactaagaaaaagagttgatcaatgacgcttactgtggtcattgattgggcatctgaaagtcgagtcgatgtgcgcctaaagagtacaatagagccaaaaaaaaattctcagaaaattgagtcaaagttactcatttctctagaaaaaagcagcgatatttaaggcagtgagagaggtagaaaaccaatttccattttttttttttgttctatcaatttaagcccgaaatttactttttaccattattgcccattttttaactcatgaagatattctggcatttgccaaccttcttgatgtatccaaa

SEQ ID NO: 28113 - DNA, 856 bp, Heterodera glycines
ccccccgttcagtttccaatgcccacaattggccccgctgtcgttggcatttgccgtccccagtgaccatgaccaatccgtgtgcggaccgggcgcatttcccaccaatttgcagccaatcttcagcgccgaaacgggccaaattgttgcctacgaggagcggtggacgaacatggaggaccagcagcaaagccagcactccatgtccatacggaggtccaaactccaatttatccatcgttcctccatccgaaaattcaaatttttcgatttttaaaaaattagggggagggtgaggttaaatttttccacttcaaattgcgaggcgctgaatttgatgctattttgaagcattttaattttgatctattccaggagatttttttgaatttttttcactaaatcctaataaaatgcaccaaaattggaaaaactgtgccaaactttcttaaaaacatagtattagagggtctaattttttaaatagtttttatagaatacatagcaaattttcctctattttgcataaggaacaatcttaggttgtattttaaaaaaattgtattggcatttttccaaaatttcatccatttttagggcgcccgacccccgcgcgttcagccaattgctgggtaattccgctaatgtgccttttctgccggccggctttgacgacgtggagctggaggagttgttgcgcttttcgaacaccgccggcacaattacggcgaccagcgctgccggtgaactgcccgaaaaggacggcgatgcggaaacggcaaaggcggaggaagagcgctttttaaattttgaaggtgcctttttcatcgtttaaaacaaaaaaaataatttagga

SEQ ID NO: 28114 - DNA, 1220 bp, Heterodera glycines
gacggaagaggaggcggagccccggcgccgaatggacgaccccttttgcgcgctcgactcgtcgcccaactgctgctgctggactcccttctggtcagcgccggcgccaaccttctccgccgtggggctgagcagtgcgcgtgaaatgcccgagatcagtttcgtcgcctgcggtgctccgctgccgacggcgatcagttggggcgacgacggcgcacgacagcgacgtgccactgccgctgaacttgttgcttttgttgttgttgttgccgctgctgtcagttcggtagtcgccgatggcgacggtgccgacggggcgggcgaacaacacaatccgctggcgacaggcacccctttgtgctgctgctgccgttgttgttgttgctgataaagttggtggttgtactgatgatgggtgttgctgctgctctgtcgatgatggacgacggcaccgccgccgaacagcgcagcggcgatcagatgactcccgcggcgatgttgcgcttgttggagccgagcggagtttggctgactgatgctgctggtggtggtgatggtgctgttctgttgttcttcttccgctctgtcccgttttactttaaaagaaaaggggcacaattagaagagatcagcaaagagaatagcgaggccaaacaatgtaggtcaatataaaaccaattttaggggggggggaggaggtaaagccggaggagcaaaactccaatttatatgaaatcggatttaggctaatttagaaagagacatggaaaaaaggggaaagaaacattttccgattgtaaattgggggggggggttaagccgattttggaaaaaaatggaggacaacagcagcagcagaagagcaccactcaattcattcactcactgtgtttattaagagcacactcattacaattataatttaaaaggaaggagggatgaacggaggacggacatcgaactgagagaatgggggggggatcaaaagagggggggggggattattttcgcttttaattatgatgtacaatgcttttaagccccgccgtgaggcggctcctttttgtgcactattttcgtttttaaaattggatccggatgttatggcttttttaaataaattgtgaaaaatgcaaaacaaaaaacttttattgcgctacaaatgcttttaagccccgccgtgaggtgggacaggtccaaaatttgcaccacgttttact

SEQ ID NO: 28115 - DNA, 1641 bp, Heterodera glycines
  misc_feature (1495)..(1495): n is a, c, g, or t
  misc_feature (1501)..(1501): n is a, c, g, or t
cccccccccccccccccatccccgaaatgccctcaggtgaatgggcgcccgccccgccgttttcgccgtttattatttatggcatattcagtcacttttcccctccaaaaacggcgacccggtcttccgaatgttttttgttccccgatacagtattttcctactttttttcaaatttcaatttcattttcgctgctcagctgctgatcccttcattttgtttcggttttgttttacttttatagtaaaatgagccaacaaaatcagcttccccaaaatgtgccgcttttccgtccgccgccgccttttcccccgggcgtcgtttcttcgcacttttcgtttggcgctgccaattcgaacatttgcgacggtcagccgcagcgaccgtcgcacacctctcggcgaatatcatcgccaccagcaacactttgggaatgaccagcaatgtcggtggtgttgaacatgattttccgagtgtttggccaaatttggcaccaaacaatgtttttggaatggaatttccgccgaatctatcccaattaaatctgagattgggtcatcatcattcaatcccattaattattgttaagcacaaaatgaagaaaatgccgaggaggaggatgagccggaacagaaacatcagcagaaggacagccaacaaaatggagcgaaaaatgggaatttaattgcataattaagctgaaatgattttaaatttatttctcttaatctacaggtcagaagatgcactccgccgccgccttcaaccagctgatgtgttgcccggccgctgcggcgatgagttttttgcccgcggcgctccaatcgtcggccaccattgcctcgggcaatgcctgtgagttttttttatataaaaatattaattttttgtctattgcaattagcggcatcattacgctaatgagttgggggtttaggcaccgctttcgaccccatcatgtccacctttggcggtcttcaccacccgcaccgatcgcagcagtccgtcgtcccctcgtcggcacaattcgtaaaatttgtttgtttttttaaaattttatactcttaattaaacaaacagagtgattcccccatttaattaacattgttttttgcctcttcataataattccttttccgttcattcattgctttgcgctgagaaaagtgtgccaaaaacaattaaatttgctcgcgattcgctccccttttgtattctctccccccctctccacaagtgccgccgcccgctccccactcactcactgttcttccccgccgcttttccgtcctcaaaatccccacgagaagcctcaagttcccccggggcacccccttcccctcggctcactcaatttttccgtttttgcctcagggtggtccgtccgtccgcgcccgtcgccccaagggttgtggctgcttttgctcccctctctcccttcttttctgcttcttctcttctgggtggcccacccttttgccccccccccccggngggagntggagtgagtggcctttcttttcttctccccccccattccattatcacacgaagcggaaaaaagcctgtctctgttcttctttttcgcacccgtttttcatgcccaaccccatttgttttctttcttttttctccttttt

SEQ ID NO: 28116 - DNA, 1158 bp, Heterodera glycines
  misc_feature (1106)..(1106): n is a, c, g, or t
aaaataaagcccccctttttgagggggggggggggggggaggggggggggtcgaaaaataaagcccccggggtcttaggaaatacggtgtttagcctgtttattgtataaatatttcaatctgaattgaactatttccattgcgcccataaatttaatttatttaaaatgtttttattaaaatgtttttgttcaaatcccattttaaatttaaaaaaggaataaatgtcgactttttgctcttatataattaggtggttcgagaacaaaaatgagcctatgacgcaattaacatggtcgtgccaagaggagctttacagctttgctgtcgtctttaaatagaaataaaataataaacaagccgtaataattctcacacattgaaaaacaaaaataaaaacaaaatgtgaacagacatttccgaagcaattgaaattaaagaaaaccgaataattattaattactttaaaaagaatacttaaaatatttatttttaaaattttcttcaaaatactaaaaatctttaaaatatttatgatttaatgagttcgagtttcgacttttaaataagtccattcaagccaaaatttaaataaaaaaataataattttgccagcgaattaattaattttcgcaccttcacattcaaacacgcaagggtagaaacataatattgtgtacaataatgacgcacatttcaaactttgcaccctatgggcgctgatgacgatggcatttgaccgccgccatcaccattaatcatcaccaaatgcatcgccttgggcaacacaaagggcgtgccgcctctctcggtcggcacaatgcgttttaatgggtgccaccctcattgtttttgaagcttttgcgcaagtacaaatgccggacaaattatgaggatgctaagatttgttaattgagtcggtggatgtttcggtgccgaactctgaaaataaatctttttttttcttagtgagccaaatcccataaattcgttatcatccgatccgaaagttctgcgtgtttggaagctttggttaagctattttgaagattgtgaagggctttcaaataataagaactttaatagattgatttatgacgtcccanaattctcggagccgaatttttttttacctataaatttccatggaatttttat

SEQ ID NO: 28117 - DNA, 1003 bp, Heterodera glycines
agtaaaattttaaaaaatatatttttccctgaaacattcgtatgaaaatttagtttttttaaattttcggtgggaaacgactgagaggggaggggattgaagtgcattcgccactcacacttttccgtactcctcgcgagggatgtaccggcaggcggtgaatcggtcggccaacgcaaccaattccagctgaaatctcataatggattaacgaaaaattgtagtttttccaagttttcaaatcccaaagaatccaaaaatacccattttcatcgaaatttttgtctcggtgttacaaaaactcggagctttctcatccaccgcttacatcgttgcagtctaacggactcaaaagagtggcgagcattttggcgtgggcggtcacccgattcttgagccgttgccgctcgttgaacacattgtcacagaccatggcatactcacgcaacgacagcacaaaacagcgccgaatgccggacaaacattggagatggacgtaggcaaagtccgattgggggtccaactaaattttaaaaaatggaaatataggacaatgtatattgaaatgggcaaaaattaaaatttttaaatcagaattacctcaagtgagcacgaggggacggggccgacggacgattgggccgcgcttctgcaaaacattcggcaaatccaatcgcaaattagaaaaattcgttaaaaaatataaatttttggaataggaaaaagcaactaacttgaaaatgtgcatcaaactcttcgtggccagccgacagaacacttcgccgtccggccccaaattttcgcgtgccctcagccggtcaaaaaactgacggcacagtttcacttttgcgtagccgaccgcgcggaggaagaggcggacagcatcaaccgtctttcggtcggtggcaacagaattgctcactgaacttggccaacacggtgatacccgaggcgaagtgctaaaagtgggaaaaatgacaatttagaaactctcaaaaacttt

SEQ ID NO: 28118 - DNA, 1058 bp, Heterodera glycines
  misc_feature (523)..(523): n is a, c, g, or t
ttatcgttaaaatgtaattttcatatattttcttgattatttcaaagctttttttaaatttattatatttacttttataaaaaatttttaaagcaaattactgagttaagtttttcctgtgccaattagattaccatttcgtgaaatgccgattttattttccttggaatagccaaaatttgtgggccatcggagtcagcgaaagaattggcactaccatatacatcaatggcattctcttaaataaatttcctttttgttagcttttcagtggtttcataggaaatgaattttccttattttttttctcttttgatgcaacaaaaacactgattgaaaaaactttttttttttgtaaattatggagaaaatttaaatgaattgctcaaattttattctttaataataaatagggttgctacccgacccctagtggggggggggggctaaatgtcagggtcgggtcggagaataggccaaaaaatgtcgagggtcgggggctcggggttcggggaggcatccnttataataataggtagtcatttttattgtttttataaagatttttttatagggactaacgtattccatcagcttcagataacggaaacgaatggaaaaacattgccaatgtaaaaagaatgattattacgacagaaaattgcattttatttaatttattttaataataatatttcttttaaggggataaattatggacagaaattatgccgttattttctaaataataattaatgcaataatttttacaataaatcaattcgaatcaaatcactgcacattttctttataatgtttccaacaatacagaaggataataaaaagattaaaataaatttgctttttttttattatatagtaataatttagaaattattttatgtcaaataatttacaattaatcaagttttgatttgggcaaatcacttagttaggacagagacgcgttattattttatgggttttttggctaattgaaaaaaaaagaatttttatcaaggaaccgcctgtgaatttttgggttttcctgtgatttg

SEQ ID NO: 28119 - DNA, 2261 bp, Heterodera glycines
aaatttgacaataagaattttcaaaatttaggagttttgtacctaaaaaataaatgcgctaaaaaagatgaaataactcaaaaagtaatttaaacagcagcaattaaaaaaagtttttcgtacaggcccaaggagttaagagaaaaaagtaatagaaaacaaatacatttttttccaatggcataatttaggccaaacaatttataataactaaagaaaatatttaccaaaaaaacccaaaaagaaaaaaagactaaaaatccaaaacagaatgaattatgggaactcgcttctcattctctccctttctcttctctcctcgttaatgtttgggcttcttcccgcaacatgcccacacgtaatttttgccgcaacaattgctgagcgcgtagccttccgactttacacatttggccccatttttgccattcccaaaaaaggaagtgaagtggcctcgtcgtcgtccgccattccctcccctaattcccttccaaaattatttttaccgcatttactcctttcaatccatttgcccttggcattttgccgatgtttttgcccagtttggttgccggggccaatcccccagggcattccgccggggttttcttccgccctcccctttccggaaaaagggaaaaaaaacagcccaaaagaaaagggaaaaaaagcgccaaaaaaaaacccccttttgggagggcaaaagaggaatttttttgggtttttgacaaaaaaaaaaaaaaaaccaggggggtggggtggtttttctttttttggggggaaaaaagatttttttcccctcttttttgctttatttttttaagggcaaaaaaagggggggggacaaaaaagggggcccccttaaaaaggggaatattttccccccccccccccccccttttaaaccccccccctttataaggggggggaaacaacattagggggggaggagatttttcccccccgagaggggggggcttcgcgcccctccttgtttgtggggtggccacaaaacaaaaaaaaaaaaaaaaccccccccaaaaaaaaaagggggggggggggggggcggggggtgtttttccccccccccctcccttttatttttttattaggggaaaaaaaaaaaaaaaatttttttttttttttttttaaaaaaaaaaattttttttttttttttttttttttttttttttttttttttaaaaaaaattttttttttttctttttaccaaaaaaatttttttatttttttttttttaaacccttaaaaaaatttccctctttttaatttaaaaaaattttttcctttatttttttcctttttaggccttttttaaaaaattgtaaaactttctttaattattaatttttaatttaggctttttcagttttataatattttataatttcaaagcttgataattaccatttgaatttttggtaatgtttaaattacacaatcttaagttagaatatagcatatatatatttatgaaatcaatgttttttctatagcaattttaatctttatttttttaaatgattacactgtttccggtacatgtttctttaagttgtttggacatttttcgtgaaaaatgaataaattttatgatttaattataatttttaaattaatacaatttttagccagaggctgcagagttcggcggtgtaaattttttttgaattttattacattgttattaatttagggttgagcgataatcggtaattgtaaaaaaccggtaattttcgggttgaaaaaccagtactttttggtcattagtgtgtgcaaacaaagcttaaacaaaaattttaaattcgaaaattgtaattttcgactttttgttcgagatcgagtctgtgattcggaattttcgatcatttttacatcgattctgaccgtttttaagcatttttgagtttggggactatgatcaatatttaccaaaattttgattggacacataaaacccgaattggactcataatctgcaatagaatcaaaaatagttaaatcgttaaaacctaaaaatccgggccctagaaattacaaaaaattacatatatagaaaaaaaattactacataattgaagaaaatgttgatgtgagcagcaaaataggaaatgaagtggaaaataagggaggatgaaggactcagcggatggagagaagcgatgccaaatggtgtgctgtgagggtaataatgccaatggtgggatgggggcgcgtcgttttgtgcgtcgttttgctaaca

SEQ ID NO: 28120 - DNA, 1007 bp, Heterodera glycines
  misc_feature (27)..(28): n is a, c, g, or t
tttttttgagattacacagataaaacnncctctgctgatcgctgtgatcagtttcgcactaaaaaatcctctgccgatcagtcgcgccatcgccgtccgcccgcaacagccgcttataaaaatgtgtgtgccgaaatgtaccataattattaaacgattttgagataaaatgcacatttcttgagaagactaaaaaaacgaaaaatgggagtaaattggtaaaaaattgaactaattagccaggtaagctttgtagttgtcgagactcaaagacaccaaataagagaaaccgagcagaaccaacactgagataaacacaagtttcttttctcgtgtcgagactctcgacataaaaatatatgttttttttgattttcttaagacatgaaataattgatttccaaatcaatttttagaaagcacacaaatcattgttcaatttaatgctgatttgtgggtggaatataaattattaataaaataaagcgcctgaggggttttttaaattagtgagacatttgttcattctttccactgtgaacatttatgatttagctatataacatatgtgagggaaaaatgctgcccatattttatttttttgatcaaaaatagagcaaaaacacacaaatgaaaatgaatcatgggaagcgcatgaccgaaaattttttttacccatcattaaaaattctaattataaatggtgattggcggtatacatcacagcgacagattgggacaatggagaaaacccacacactcaaattcatggggctgttaaatgtgattaatgtgcgtgcaaaattctgcaaccgcgcgctaattatgcaattaattatataatacacgttatatgtgtgagaaagttcacggcccaaggccgtccgtcgaccattttcccgtttcccgcaaaggcaaaaatattttttgtaattttatgtgcgtttcgttgtatgtacaagcgcaaaaagatcaatcaaaaatgggaaagaaaaattatttttgga

SEQ ID NO: 28121 - DNA, 1365 bp, Heterodera glycines
  misc_feature (66)..(66): n is a, c, g, or t
agattaggtacaaacatttgaatgtttgcctcctctctctaacagatattaatggggacgggacanaattcgccgcaaaaaaagttataacttactaagagaaaattgaaaaaaatatttttaagggggagggggggggggacaccaaatattaattgcaaaatttaaaaattttatagagtaacaaacagtaaaccctgctaaatcggcacgtatcgatggggagtcgagaaaattatgggcatttttgttttattcaattttaaccaaaatttttatgtttatcccatgcggtgccaactgtcggatcccatttttgtaaatatttttccatattatgtccaaaaatggttatttatgtgaatttaagcaattttatttatacccacccaacccactcacctctcatttcgtttttgccgattgacttcatgcagaatcgtcttcagacaatccaaatccaacaaatcggacacaactaaattttttgcaataaattaattaagcaacaaaaaagggctccgacctcctttccgctcaaccagctgcacaacgcgtgccatcactgtttggcattgtgcccgaccaaaactgttcaactgatccacgagataagtgagcgcctgctcactcaaataaagggaacgggcagcgaaaaatttcttgatctgaaagaacaaataatgatggtgatgaacggtttgcacagtttgaaaagagaggaacaactgggcgccagctcggttttttcgggaaataccccattttcacagttgtactaatggacaccaatttgtgtatcattcgattgccttgagttctttattagccagtacaaatttgaaaaattctgtcaaattttcagtcaaaaattttttttttaggaaattcaggtccctgttttgtaattttgcatgacaacagaggaacttaagcgctctcagaacgatgtccacaaattggatggatatgtaaaacaattttggagctgaaatgagccgttgttgccgaatgattgtgagtataattccgctcaattcaaactcaccaatcgacgcaattccaacacattttggtttgctgtcgccgctgctgctgctgttgttgttgaactcatttgttgctttctataagattgacatacaatatatacatataacggaaattaatccgagataaactggtaaaaagaaaaccaactaagtaatttttgcaaaaaaatcaccaaaatgacgagaaaatccaaaatatttttttgaagatcgtcaccaaatggaaaaatgatgaaatgaaaaaaaataacaacataaaggagaggaataagcggataaattccacacaaatatgtcctaattttggacctgc

SEQ ID NO: 28122 - DNA, 1801 bp, Heterodera glycines
  misc_feature (11)..(11): n is a, c, g, or t
ataattatttnttgaataaaaatatatttaatgatttttaaatcaaaataaatttttatgctaaatttatatttaaataaataagatgtgtagagatggtgtcacgaaattaaaagtaaactttaatataatttgttctttttttatcttatgtttattttattggttcttttttcaaaattacaatattttttactttattggtaagggcatgaaaaattataatttttatttcaaataaatttcaaattaacaaaaaaaaatttcatgacatcactatatgtaaaatttagtgctacaaatataaatttctcatggcgaatatcgattgtaatgcttcatgtattgatttatttattctttattattaattcaattataaattatttgtatttcattttggtcaaattttgtatcattctctcatagcattatttttcttgaacatgagtgtttcttataattttaaggcctaataaagaaatatttgattttttggaaaaaatattcttcgtaaagggtgagaaaaatttaattttcacaagaaatttcggtaaaactgttatatccgcaacattcaagtttccatatcttgtgataattacattgacctactttctcccggcccagtcccattataaacttgtctgtctgttcatctcatcccaagccaatcctccccctcatttccaaagttatcgtgccattgctatccctttcctttaataaatctctctctaaaaacagtaatttaaaatggctttaagccttaaatccggggacataacaacgggtccttttttcaaagcatggactcgtccaataatgagcagcagcttcaggaaattgaggccttggaggtgtagctgtgtgtattataatttgataactttgtttaaaccagttaaacattatttagattactacctatattaaagggcgaaccgtcaccgacaattacttggagtaaagatggggaaattttggtggagacaaatagggtgactatcaacaataaaacccaggtgagttcatcaggcattgattttagtacaacaagcagcagaacggttggaacttctgtcccaattagccatcaaacagcggagagtgctaaagggcggccatggcagtaaagtaaggggaagaggaggggataaacgtgggaaagggtaattgatccattaattcatccaagcattgatttcaaactaacctaattatgacacaaacagtgcaaaggattctgctcatttctgatagcaacaaaaagaactcgggtgcgaatgtcgcgcagagaattgtgccgttggacccccaggaggacattgcagaaaaagcgttctgtcgccactcacacttcgtgcatgtcctgctgaactttcatccgttcggacaatttggtaattgctggataattaactaatggttgctaattaattgcccatttgtattagcttctgacgggcagcggcgattcaatttgtgcaatggtcggcttttgttgcggtccaaatcaaataaaattatttcggcattcagtaggacgtggagagcggtcaaatgatccaaaatttccatggccatcttggcgacgtttttgccattgacatccccaagttggacaccggcaacattttcatttcaggcgtaagaatgtggcttttgttttttgccagtgccttacaaaactcaaaggatgctgatcggcatgccctcgtctgggacattcgaaccggacagtgcagtgcagaacttcgaggggcatgagacggacattaacacaattcgctaccacccc

SEQ ID NO: 28123 - DNA, 1283 bp, Heterodera glycines
ttttctctgccccctctcgtcgtcgcgctttctctttgtgctgtctctccttctttcgctaccctctccactctcttcacaaacttattacctgaaaaagccgttcgaaggcagatttaaaacgccgggtgaaaaagaaaaagaaaatgaatggatatgccatttggacagctatgacctgagcgagttggacctggagcggacttgcgatgaaaacgacaaggaaatgggacagattttttgttacggaaaaattcttgaggtatgcctccgcgagacgtaatagagagggcgggggagaggggtcggcccatactttatttgttaggggggcgggggggggggggttgcaaaataagcaaatcagcatgaaaatgaccattttgtggcacttaagcgttcaatcgaagactatccaaattttcttagtacatgactttttgggtattactgatcaccgattcagcacccatcccgatcaaattcggacccctagtccgaattcaaacagtcaaaaactttgggacacaaattcaaaaaaatgggtttttaaccggttttctgcggaatgtgcttgaaaaaagctgaaccagcgacgcattggcgtgcagtggctttcacaaagtgaaaaatgtcggctcctcctccattctttttttgattcctttttttgttttaagttgaatatgagtagtgcaacatttaatcaagctgttcgccctcttttatcgttattggtagttgttaaaaattaccatgttatgtattcatttttagaacgtacgaaacatagttgaaattttgcaggaaaatagcttggtataagaagggtttctgcatgcaaaattttaaagatattctgcgttttttatttgtgtattgatttcaatgtaatatgctcgttttatacgatgtatgtatgtattggtttcgcataaagtgcaattgcctaatcgcttcaaataataaactttacggcggtgtcttctatttggctatcgaatgataccaagaatatttaatttgggtaattctagaaaaagtcatgattagggtttgtaattatatggaaatccatattttttcctggactgggggaggcctgaaacgcatgaaaaacttgtttttaacttggtttgaagcctataggaagggagttctatatccctattttccataatttttccatatttcgcgatttatgtccatatttttccatattttgggcatttaaggccatattttatggtcattattttggattttttcccaaaaaacctcta

SEQ ID NO: 28124 - DNA, 975 bp, Heterodera glycines
tattaaataattttacaccaaaatcatacaataactggcgccgctgcccgtcaaaatcccgccgcgtcataatcttttttatgactttttaattgatttctaaattttaaaaagttgcgggttttgaatcggttttttgtattaaatgtgaatttggatgaaaaatattttcgactctttgttctaatttgggcccgtataagaaatgggtcgaaacgaatgccggattcgtgatcactgatcaacggcccgaaaacgcaacttttatggagaattgagaaggtcaaatggtgccgaacagggcaaactgagaagctaaagtactgtacttttgtcttactgacagtatgaccggtccattttaagttaaaattcaaaaagtgccacattgttgcactttccttttgctcaactggcagagttagggcccatagaatgagcaaattgggtgactgacgttacaagtgcatttcaagccaaattccttggccaaaaaatggcacggcatacctctttccatttgatgacacgtgacagcaaaagtttgtgcagcagccgacaggacgagagcgcattcggtgtggcattttcggcagggatgagaggcacaatttcgtacagaagttcgagcggaaggcatttggtggccattgttgggagatgcagggggcagttttgttatttggggtaattagtgagcaaattagctgattagcattgaacgaaaccgtcgcactggcactttgaatttggtttggcccgtttcgtcccgacagcagcagcagaaggaatggccgtttttcttttctctcctctccgtttgcttttctctctttcccgttgtctgacttttcctttttgctctatcgctctctcccctctctctctcttcctttattcctctcttcactctctctctttttatttttctctatgccttgcgagttcgtccttaacaatgaatgattcggtcgc

SEQ ID NO: 28125 - DNA, 826 bp, Heterodera glycines
ttttggaattaaatggggaaaaatatacgaaaattattttggttttaaataacgctgtccaatgcttttaaaccccccggtgaggcgggacagttcaaaaatttggtaccccattttactgtggaaagtccaagtcccttatgggacaactacgtgtcaatgagcacagtcccttttgtccagttgtggaacggaaaaatggaaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggctttttgaaataaattgtgaaaaatatacgaaaattattttcggttttaattatgctgtacaatgcttttaag

SEQ ID NO: 28126 - DNA, 516 bp, Heterodera glycines
gtctcaacatcgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggaattggcccgttccgtagacaaaatctgctaacaaatagcattaaaattcaaagaaattttcccgacggcgtctaccggcgccgccggacccccgcccccccatgttcccaaaaagttttccgaaaaaagcgcgtcgcaaaaaaagcgttttttttaatgccaaaaaattcgtc

SEQ ID NO: 28127 - DNA, 1042 bp, Heterodera glycines
  misc_feature (45)..(45): n is a, c, g, or t
taatgccgtgtcggctaccgcgtttcttctctagtaattattttntggcgttcaacaagcattatttattaatatttttaatatgttggacatgaggatttgagttcatctataaattattttaaaccttttctttctacagaattttcgcatatacgactacattatttgcattcatgcagattaatgccgcgtcggctaccccgtttcttctctagtaattatttttggccttcaacaagcattatttatgaatatttttaatatgttggacatgaggatttgagttcatctataaattattttaaaccttttctttctacagaattttcgcatatacgactacattatttgcattcatgcagattaatgccgcgtcggctaccccgtttcttctctagtaattatttttggccttcaacaagcattatttatgaatatttttaatatgttggacatgaggatttgagttcatctataaattatttttaaaccttttctttccacagaattttcgcatatacgactacattatttgcattcatattattgtcaactttaaacaaaagcaattgataaatattttcgttattaaggcgagtggttttgggttatttcaaaaatttttaaaaattgcagattaatgccgtgtcggctaccgcgtttcttctctagtaattatttttggcgttcaacaagcattatttattaatatttttaatatgttggacatgaggatttgagttcatctataaattatttttaaaccttttctttctacagaattttcgcatatacgactacattatttgcattcatattattgtcaatattaaacaaaagcaattgataaatattttcgttattaagacgagtggttttgggctatttcaaaattttttaataattgcagattaatgccgcgtcggctaccccgtttcttctctagtaattatttttggcgttcaacaagcattatttatgaatatttttaatatgttggacatgaggatttgagttcatctataaattatttttaaac

SEQ ID NO: 28128 - DNA, 850 bp, Heterodera glycines
cttattacttggaacggagacgtcctgggaatcgaaggtgttgtaagcttttttacttatttcacttttaaatttatttaaattttcaattttttttggcttttttcaaaaaattttgtctattttttcggcaggcactgcctctgacaatgttttttatttatttagaaaaataaatttattttttttctttttattattttaaatgtatttcatcctgaaattttttaataaacattttcaaactttcaccttattaatttaaggcgaattttgccttttttaatgaattctcttgtgaaaaggcaaaaaaaggctcttttaaatatgcctatttaaatgactttaattggtgtcctttcgcttacgaccataccacgttgaaagcacgccatcccgtccgatctggcaagttaagcaacgttgggccttcttattacttggaacggagacgtcctgggaatcgaaggtgttgtaagcttttttacttatttcacttttaaatttatttaaattttcaattttttttggcttttttcaaaaaattttgtctattttttcggcaggcactgcctctgacaatgttttttatttatttagaaaaataaatttattttttttctttttattattttaaatgtatttcatcctgaaattttttaataaacattttcaaactttcaccttattaatttaaggcgaattttgccttttttaataaattctcttgtgaaaaggcaaaaaaggctcttttaaatatgcctatttaaatgactttaattgctgtcctttcgcttacgaccataccacgttgaaagcacgccatcccgtccgatctggcaagttaagc

SEQ ID NO: 28129 - DNA, 1387 bp, Heterodera glycines
  misc_feature (1347)..(1347): n is a, c, g, or t
accattttaaacagttgcattatttaataataatattataaattatataagtaaaaaattgatttgggataatcttacttatgttcattcaacattttaaataaatgcatcataatttataataatatataaattatataaagtaaaaaatagattggtataattctactgatgatcaatcaccattttaatattagctttattatttaatattatttatttaattatatgaagtaataaataatcctacttaggataaattactattttaaatatatcattattatttaataataataatattatacaaattcaattaagtaaaaatagatttagataagcctatttatgataatttactattttaattagaattattattaaagatttgttatcttactctgatgatcactatttcaagtcatcaaatttttcttcctttataagtctatgtgattttatgattactttacttcatttgacaatttcttttttctttaaaaagaattcgttattttaaatatatatttatcttctattctaattatattaatattagttaatttcttaataaaaaaaatttgtttaaacttttatgtaattaaatgaaaccaaaaattaatggattttaatttccatttgaataattttatttaagaaaacgtaatgctctattctttttttataatttattttcttctaattattcatcgttttctaatccacatttcaaatgcaattcaatttgtgagttaattaatcagggtaattaatttgtttaataatttttaattagggagacgacaaaatgctaatagcgtttgtgagcaatggtcagaaaacgcaaatcagtgagtattcaaagcaaaaatatgagacacaccttggcattgtgtattatatgagaaagaattggcactgtgacaaaactaggagagatttgatgaatatgaacgaaaagaatgtcaaaaatatcgtaaattgttggactttatttacgaatatttgttcagagaatacgtcggaattccaacagtgaagccaaaatttgtatttaaaaacaaaattgaaattgaaggaccaataatttatgcgataaattgcttggcgaaaattttgaaattttattttaactcttatttgtataattataattataaattaaacaaactttatcattttgaaccaaaaatgttgaacgtggagaaagttaattatgaatcaaaattgtcaattaatgaaatgattttgcaattggcaattgacacagcaaatgaatagcaaacaaatgaaagtttatacgaaattattctacaaaattgtggaaataaatttgaaaaatatttnggaggaaatgttcaaaaaagcagaagaaagagcaaaaaaa

SEQ ID NO: 28130 - DNA, 1805 bp, Heterodera glycines
aaaatgaattttgcatgataattaatcagtcactcatcccaaatagcagaggggattaaggaactttcccattcggtgacaatggaatttatttacaaaaacgaatagttggacgtaaaaacatacaaagatgatgtagagctcaaaaaggcgatttattttgagaaaaaaattaattaaattattctttttttattttgaaggttaccagcgaaaaatttagatgaatgattaaaagctgatggatgatgataaacaattgaagaatgatcaagagagggaagattttgaaaaacatagcaaatttgggcattatttatgaatattttttaaattttcttgacgagaatttttgattttaaaaattatgtacaattaacaaagaaattaccatttaagttcattggaaacccaataaaatcagaaataaattaaagatttcacaggaaaaatgcaaaaaagcgaaacacataactttaagaatagttttcactgacaaaagaatgagattattacaaaaaaatcttgaaatgcaatcattgaagctagaatttgataaaaattttgcattttccaaggtttaaatccattttttttggtaaagtccatgttttatgtccattttggtttgtatttttagtccatattaactctaataatgagaaaagtcttcgttgaactgatgagtggttctaactgattgacacttttaaattctcatttattcatttcattttaaacggatatttaaaaatcacataaaatgccaaaaaaagcataaaataaaccaaaaaagtcctgaaaataagcaaaatgtaattaaacccaaaagccgttttgggattcttcggagaacgtaataaaattttatggacgattttcctgtgaaatctttaatttattttgtgctaaaagcttcaaaaaaggtcaaaatatgtgccaaaaattgctcaaaaaataagtgattttatcaaaaaagtcatttgtatagctactgcatgcattggattcgatcctgggaccccccttttgtgacaaactcacagaccactgagacgaaaaatccaactaattttcgcttggagccagaaattgacccgttaatgaggcaaaattcacatattaattcattcactcattaactgtaataatttggataattggttttttcagtttagttcatttctttttcatttttgttattaccaattcataaaaatgtctgacaatccgaaggaagcggagagagaaatggaaaaagcgatgtgatattctaaatttgaatgtccatggctaatcattttgcttttccgttttaagtttcatcgctgccgactgttggcttgaggtgttcggtttgcttccacgctcacagcttggccttggcattgcgctgattagtcaccgatttgactattacgtcgacgaacacttcaaaatctgcaaatggacatttgacaaattgaaaattcgaagcaaaatcggagagaatggcgcaaaggaaatggaaattgtcaattccgatggaaaagaattgtcaatcccacaaaattcgttgccgaacaaattcatcagattcggatgcattttgattaagtgaaaattcaatttagaaatgatttgtaaccatttctggttttcagctacatcgaccaaaatgtgctcatttttctccgccgttttcaccgttttttcgccacatttgaaacaaaaattcacattggcactgtgaatggtcgcatttccaaggtcgctatgctcaccatttggccaatggtcatggacaccattcctgtgatgtattt

SEQ ID NO: 28131 - DNA, 813 bp, Heterodera glycines
gccgagaaaaattttgtaatttttaatgcgatttattaacagatttgtacacaaaaaaggatgatttttgggattactatgcttaatttgttaacggattttctttaaaaaatgataaaatatatgttagttaaaaaaatatatgagaaattatattttgtcgattatgaatagagctcgcattttgaggcatatgccttttttttctgcgcacttgttccgatatattaagcataaaaaagcattttccatttggtttgagtcttctacgttgacttttattatgccttatttgcctttttcctgattttcgtgcctaaatgtcttttttggcattttgccgttttggtgccttttttgacgtttttttcgaaaaattccaaaaaatgcaataaaatcggtaaaatatacccctaagaaatgacccgaaaatttttttttagaaaatacaccctccaggaattggaattttttttcaaaaacacccctaataaatgaactgaaaaaatttcataaaatacacccctaagaattaaaatttttcgaaaattgatcgccaaaattttatttattttttcttgattaaaaaatttaggtttaaaaattttccttattcgtaaaacattataaaatatttaactagcgggtgcgtgaaccgtcgaatctgggactgggataaagcgcttcgcgctttccgagcttcgctacctaggctgtgaagcgattcgaattgatcgaatttgagctcggacgggcgctttgcgcccgtttttcaaattttgttcggcttggacgggcgcttcgcgcccgttt

SEQ ID NO: 28132 - DNA, 1794 bp, Heterodera glycines
  misc_feature (1772)..(1772): n is a, c, g, or t
  misc_feature (1784)..(1784): n is a, c, g, or t
atacatcttgaatgcctaaaggctggggtaaaatttcaaatattttttctagatttacagaattatttttatttagccttgacaaattatctatgtgcccattatgtcgtgcagaaataacagacgatttcaagaatttattaagcggaaaagatcaggcaaaagttgaaaaaataaatttttaatatttttattattattatttattttaaaggcaggcccatcaaattcaaaaagagaacagacggacatgggtatatttagggttctattttttaagcacaatattaattaatttatctaattactaataaacttttgaacaaaaaagtcagaataatcaaaaaaaaaatcgaaaaattgccataaatagtaaaataaacattaaaaattaatttaaaaaataactactcacaaataaaagttgaatttttttgaccaaatttaagattgtaaaaacggaatttcttgctatttactaatcatttgatttttaatttacaattaagatgaacaatttgcacgagctctaatgtatgttgattatgatgatgatgatgatacaattacacatggtaataatccaacggcaaatgacgcagcaatggcacaacggatgcaaaaacagctgcaggagcaacaggaagaagcggatgccgaattagctaggcgtttggctgatcaactttagggtaataatttgggctggcaatttttaattactaacaataacaagttattcaaattaataattaattaataaatagtgaagaattaaaaaaaagccaaaatacgaatttaaattctgtgccttcaacaaatcatattaattttgatgcactgtttaaagattagtctagaataagcccccattgcatgcatttttaaaatatattaaatatgtgacgacagcaccgtctttgaattttttttttttaatttctatgattttgcaaaaatcatagaaattaaaaaaattataaatttaaataataataaaaaaggaccaataagtgggtaaaaattaccagtatgtcatgtgtaaagcctgtctataataataataataatgatgtgatgaattaattttcctttaaaatgttttaatagcaaaaataaatttttattcatttttaaatatcaaaaaatagagttattaatttcatagatttttgacgaattgcgcaattctcgagcaccgatgaacacaatggacactgagattttgaaaatgaattgcgctcgtgaaaaaaactttgtttctgatccgtattttcgtaaacctatatggaaagtctaagccaccactttaacgaaaataatttgtcatcatttcaaatttttcaattattttttccttcgatgttttcttaaacctagaaaattttaaaaaatccttaaacaaaaataaagttttaacaaaaacaaaaaacctaaattttgttgcagatttttgaaaaacaaatttaaaattgcctgcatatgattcattgttaaaaaggcttatttgatcatctttgacatttttatgaaatttaaacatttactgataaatttatagtttttttacaccacttttaagacgagggattaccaaaattagagatacaatgaaaaacatcccacattttggcgttagtttacttttcttaaagtgatatgaaaaacaatatccggttttgtgacgtcatattttcttcaacatcgaccccagcaatttttgcataaacaaggaaaataaaatttcaaaaagcgcatagttatggccaaantgtacacaaatntttcttgtca

SEQ ID NO: 28133 - DNA, 1115 bp, Heterodera glycines
aaaaagtctagggagttgtgaaaatttttcttgaaattttgagtaggcctagcagaaagtggacaaaattctctaccgaattgccttttgaatgatgtggctacgacttattcccacagaacagcataggatgtcaaaattgacaaccataaaaaagatcaatttttgatcattttcccttgtaatacggtagaaatcagtcatttttgggaataaattctggactataatttaggatagaatataataataataataaaaaggataaatgctaaaatgctttgtcaaattgaattgttttcatggcactgtcttcgctctttcccttccaattgtcccatcgctgtgctaattgactgatgtggcgttgcgtttctctggccatcgtttgccaaatcagcattattttcagtcgcctccggcatttcgcgtggtgccacaagtggcgggaccgaacggcgaaaggaacagtgccgttggatacgcaatgcttctcgatcatagccaagccttagtttttgctaatatagacgagctaagaaacatgaaaaagctagaccttaagttttcatgttaatttgctttaaatcaaataatgctaattgtaagtagttaaattatgattagggttataaattatatggattttttagtccatataaatccatattttgggggttttcgggaataaatccatattttgccatttttgcgtttttagtccatattttatccatttattggggaatttcataaataaatccaaaaattgccaaaattgcgtttttagtccatataaatccatattttgggggttttcgggaataaatccatattttgccatttttgcgtttttagtccatattttggccatttattggaaaatttcataagaaaaatgcaaaaaaagcgaaaaatacacccctaatggtcaattttttttaaattaaaaaaatacaaccctaggggaaccgcccactttggcgcgggtattttggcgccctatataaaatggcttttttggcgccagagttgaaaaatctccaaaaattttcagaaaatttttagtttgtctttctttatggataattataagccattttctttaaaagaac

SEQ ID NO: 28134 - DNA, 932 bp, Heterodera glycines
acgccatggccttaaataacctgtttgcttttgcgtcgacacatggcgaaaaggcacccgcggaccaaatgggcggccgattggacacgtgcaaatacaacggttatgaatgaatacattatctaaaaaattttatatttttaggacagttttcatttctgttcagcgatttaattgcgccgggggtccgtcgtccgtcttttgctcaggtgtataccctggcacccgaagacgcattgaatgtccgcgaagaggcgcttgacaccgccgtttcaccacacgtcagacgcacaatcctcgaaagacttgaggcactgatgcgacaaaacccatttgggcagaccttccagactgtgggtacgaagattgccgctgctcgtgcagcaactggcgaaatgccgcatttccgagtatatcatactaataatcatatttaaatttaaaaaaatttaaaagattgccctgttaacggatcgcgagttgaggagcgttccgcttcaaggccgcactgatgtcactgttattgagcgggcggatgcaccgactgccaagcaagttgcagtgatttgggtccaagaggatggacttcctcctcaaatcagcggtagaaattgcacagttaaaagacctttactatacgattcagctttctgggtgtccgacaaggccgggaagatgcgcgagctcaagagtggaatgccgcaaattgatccgtgctgcttcccactgctccatccccgcggtacgcttggatggcgatggtatatgaagaagcgtgggtccgaggtatataataaaaaataaacttaaagtacattgaatgataaagaacacccgacccgaagtgcagttggaggaacaagaacatgatcagatttccgacgacgaattgggcgacgaggttccaatcgacgatattgtgggtacgcagc

SEQ ID NO: 28135 - DNA, 906 bp, Heterodera glycines
taaatagggaggaaaatgtttttaatcaaatatttttacttttttctgcaccttgttttggagcagttacattaagtctatgttatagccagcatcctcaaacaaatttgatatcttcaaattttttattccttttgccggtatattaaatactcagaatttagaaagacatttaaaaaaataactctaattactccacagtgtttaatcgtatgcaatgtggttaattatcattcataacattatcacgttgttgcttaaatcccctcaacatttcaatttttctcaattatgcccctaggctcatctttaattttttgcttaaaattacaataatttttttatattccactgttttcaatactagcaaacttttccatatcacttataaggctgatattcctagtttttgttaacaaataatcttttttatatctagagcgttgaataaataggaggaaaatgttttaatcaaatattttacttttttctgcaccttgttttggagcagttacattaagtctatgttatagccagcatcctcaaacaaatttgatatcttcaaattttttattccttttgccggtatattaaatactcagaatttagaaagacatttaaaaaaataactctaattactccacagtgtttaatcgtatgcaatgtggttaattatcattcataacattatcacgttgttgcttaaatcccctcaacatttcaatttttctcaattatgcccctaggctcatctttaattttttgcttaaaattacgataatttttttatattccactgttttcaatactagcaaacttttccatatcacttaaaaggctgatattcctagtttttgttaacaaataatcttttttatatctagagcgttgaataaataggaggaa

SEQ ID NO: 28136 - DNA, 466 bp, Heterodera glycines
tcgcgagttgcgatgcggtgcacgctttattttatttgaattaaaaaattacaacgaatacattttattgaattttcctactgtataattttttatcgtccggtgacggtaggggtcagttgcgtctggccagttgcgtctggccgattgcgtctggccagttgcgtctggggccggttgcgtcttgggccagttgcgtctggccagttgcgtctggccggttgcgtcttagtacttaaggggccggttgcgtctcaaacattttttgaatcactttttcaaagaatacaatttttgagagaatgatatttgtattgaattcggttaagtacatagagaaattataaaaaatctattttaattaaaacgaaaatacaaataaataataatgcaattaaaaagaaaatattgattcatttggtaattgctggaaattcccctaagcatttcattaaataaattcgga

SEQ ID NO: 28137 - DNA, 1688 bp, Heterodera glycines
tgtggacagctaaattttgtaaagggtaaagtaaacccgcgaaaagacgagccctacggttgaatttattgaaaaacgggagacaaatccctcaattttcaacggactgtctacaaaaaggggtgaacaaaaacccggaaaacgattcgaggagaagacgaaaagttggatttttttgtaaacgggaaaagcaaatccctcttcacttcaaatctcagcatcggaaaaggaaattgtgaaacaaatcacaaaatttgtcagttcggtaaaatccttcgacaaaactgactctcaaacagggaaactaatcccatttcgacatgcagcaacttcgccaaaacaaaagatcggacaaaggaaattgtatggaacagcaccaaaaacaagaaggacagcaaattggctcgttgaatttgtgctaacgatggaacgacttcctgagctgaaaggaacggaagggacgaaccaaattcgaaaatttttcaaaaaattttcgtcagcaaccgaagaatggacggaaagtcgacgcatttcagcgctagaaagcaaaatgattggaaaagcagagcgtgcatttgacgccgcgatgaaacatcggccgaaaaatttcaacaaaatttgccgcggaatggaaggaattttgagcgagtgggactgcaccgaaatgcgagctttcaatgaattgtgggaaggagtgaagcgaagaccggaagaaacgttggacgaattcgcggaacgaatttacggcattgttgaccgcgctcacccaggtttgccgccaaactttgtcagcgattttgcgataaagcacttaattcgtgctttggaaaacccggaaatttcgatcggtttggaattagctcgccgcccaggcatgagcttcgacagctttgtcgctcttgctgtgcgagcagaggcagtgcaaaaacccaccaaatcggccgaatctggaaaagagcaccgtctgaaatttcaacctaaaacgactgttgcgccacaaaaaattttcgcgccaaggacaacccgaatcgtctgctataactgcaacaaaatcggacacatttccagcaactgtaggctaattgaacggaagcatttcaactgtgtaccaaaagcgccgcagcatgaaaattttgcgacgaaaagtgccgattttcgaaaaaattaagaagctgagaagaaattgaatgatttgcggttgtcgaaccaaccaccggcacaacaaacaaacgtggaagctggaccaaaacggaaagcgtccaaccgacagcgcaattcgtcgtcttcaagttgcagcgtaaaagcagcaaaaattaaggaaaattcgccggaaattccaaaatggtttttgaatgctatgattgctgccttggctttgctcgccagcacattctcgaatgaaaagtcaaagattggacgaatttggaaaggcaaaagcccaacgaatggcagcgacgacgagaaacgacggaaagcagatggaaaattgaggacaattttttcgccgaaggccggggaggaaatggccaatgatattgcagacaacttagaaaatttgtcgatagcaaacaccgaactgaatacgcccctttcaacaccgaatgccctaccgatgagcccaaagcgcagaggacatcgcttcgtagagggcgaggatgtgatataattgtgatttaaaatatgtttgg

SEQ ID NO: 28138 - DNA, 882 bp, Heterodera glycines
  misc_feature (834)..(834): n is a, c, g, or t
tagtctaatctactcaaaacggttcagaattcaataaactttaattccggtgcgaaaaatggggtttgacaagtttattgggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaaagactttacaaaataatacccctgggagaagggagtgggaaacatgatttcaaaattttcaattttttcttgtctaatctactcaaaacggttcagaattcaatanaaataacattcacggtgcgaagaatggggtttgacaagtttattgggg

SEQ ID NO: 28139 - DNA, 666 bp, Heterodera glycines
actcggcctcttcgcggcctcgtggtgggccttcgcccccctccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctcgcaccgaaggtactcactcggcctcttcgcggcctcgtggt

SEQ ID NO: 28140 - DNA, 1384 bp, Heterodera glycines
ttccttttgtcgaaacacctttatgaagccataacttttttatatggttggtcaaatcaaatgatcttcgtgtcattcggaagctcttcataaactctatcagctaaccaaaactcgcagtgattcgtacaaaagaaaacagttaaaaatagaaatacaccaaaattcggacttttttgcagttttcaagctttgactttttgtgggttgcttaatcgcttagaaaatgcttacaaatatcttctaaacatatatagctttcgaatgataccaagtttatttgatttggccaatacagaaaaaagttatggcttcataaaaatgtctcagacgcagttgactcctaccggatcgaaaaaaccacaaaaaatggcaaaatctttctttcgttcgttcgtcagtttggccccctcctctcccctcaattggcttcacttacacagcttttgctccttccaagtaaacttgccacgggcctctcacagaacagaatgcgtctccgctctccaattctcatttcctcctcaatgaaaaggccgagaatatcccaatttggcacaacaacgggccgaaaagatgcaatcggagaaggccgagggagtgaagaggtggagaaagagtgatcaaaagtggaagatggatgaatggttagtgaagcggaagaagacgaagcggaggaggaggagggacaatcggcggaatgggcggaagcggcggaggaaagcggcgaatcggccgaccggcggggggcggtgggcaaaccgtcgcagcacaactaaactaaacgcattttctgaccggtcaaaacctccgctgctcatccatccatcttcaatgcttttaatcacttccattttaccaattaaaatattttaattttcttccattttatttaattatcccgaagtgaaaatgccgaccccaaatgcgttgttggcaaatcgtttgtttctcagaaggcccgactttgtgaaataggcccttcccttcttcgcgtggtcgccgccccttttctccggcaattgcacagcttaattacctaccaattaaaaataaatatttctcttttaccatttttattcattccgatggtcaaacatttcaccattcgacacgatcggcacaaaactttctctgctgaaattttaattggccattattttgttaccctttctctttaaaatgttaaaggagtgtttccaaacttactgtacacaatgggacaattcgctccaattttcgatagtttttggcacaaataattgcgttttaacacaacggatcgtctgaagaaggcacaacacgcttggcacgactgagccccaaaatgatgcccagtggcataggcatggcaaacgcggcattcgaaatcgggggaaaccat

SEQ ID NO: 28141 - DNA, 412 bp, Heterodera glycines
cctcaaaaagttgtaagacccttccactactttcagggcgctcccggccttcggccgggagaaaatggttttagcaacgaaactccttgtcaatataacatatatagtaactagcgggtgcgtgaaccgtcggctatttagctgggaaaaagcgcttcgcgctttgggagcttcgctacctagactgtgaagcgattcaaattgatcgaattagttggagatttttttttgaatttttaaaaaattattatgggtttttagtccatatcgaggctcaagacgggcggttcgcgcccgtttttaaaatccattgaactcactcgggcgcttcgcgcccatttttcaattttgttggccttacagagattagaagaggtacaacagtgattagaagaggtacaacagtgattag

SEQ ID NO: 28142 - DNA, 1007 bp, Heterodera glycines
  misc_feature (41)..(41): n is a, c, g, or t
  misc_feature (49)..(49): n is a, c, g, or t
aatcatcggccgattgtgaattgtcagtcgctgagcaaagnccttctgnttaaggaaagtgccaataaatgagccgtttctgtcgtgtccttcccttacctacagaaataagcactgtcttcggcacgcaaattctccccaaattcgatcatttccttgcgcaccctttccttttccggcccgtctcccttaagtcgcgcggcgtcgatgccacgaaggcacgcgaattcgtctttcagagggttactcaaagagcaaatggaaacatcgaagtcggggaaacgatttaccagggctgaggccaattttagggtcaaaaagtctaaagtgaacggaataaaggggaaggcgaatgggacggacctttgccggactttctctttcccgaaacgcaaatgaatgccttaagagacgacgggagaagcggagcaaacattgagcatacgaaaaacggaaaatgaggaagaaaatgggggaaagggaatgaaataccagcgaaaaacgaatgaaaaaaagagaaatcggaaggaattgcgaattgtttatgtgcaataacaaatcaaaggtgaagaaaacaattcacaggtgaaaaaacggtggactttttttgttcattttctcctttttcttatcctccgccgacgataatattgttgatgggaatgtggatgagtttgacgaagaatccgatgaagcccataatggcgaatccaatcgcagttgcaaaggcgatcttctgatactctacgaaagtggcaatgtttagggaaaagttaattactccgacccataagcgttttagcctttggctcggttaattgcaattttcccggtggcgcctttcggctacgccggaacattaattccttatttttcaaaaattaacccattttcccccacggaatttctctaattattggcatgctcgggttcatctctaaatcggaaagttcaaataaaatttgagcaaaaaagtgcaggccctttctctttcggaaatgaaaaac

SEQ ID NO: 28143 - DNA, 1206 bp, Heterodera glycines
  misc_feature (1126)..(1126): n is a, c, g, or t
  misc_feature (1191)..(1191): n is a, c, g, or t
ctccctttttgtgcactatttcgtttcacattttctctttttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcgcagtcgcctctgacctcttatggagcagaaaagggtgaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgcctctgacctcttatggagcagaaaagggtgaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaattggatccggattttttggcttttttaataaatttgtgaaaattcaaaacaaaaaacttttattgcgctancaatgcttttaagccccgccgtgaggcgggacagttccaaaatttgcaccacattttactgtggnaaagtccagtacctt

SEQ ID NO: 28144 - DNA, 950 bp, Heterodera glycines
aattcatcataattttttaaaaattgaaaacttttcaaacttttttttatttgcccaaggcttggacccaaaaaaccgaggctttcccaggctgagaaacttgatgaatgcttttcaaatgctctattaaacttttcaattggcttgttataacactaccatggtcggtctcggcagtcggtatgggtttttcaattttgctgttcgctgagcccgtaccataaaggcgatttggagggtaccggcggaaatcgaaaaaatttaaaacaatttaaatatttatttaaaaatataagtccaccatttaccatcagaacaccgaccgccttaaacattaaaaggtgaaatttgtttttataaataacattttcaatttttaccaaatgataaatacgaaggtagtgaattgtgtcactcccttaaattattaaattaaaatatttcgggaagttttatttattatttttgcataaatttttatcataataaaaaaatatattacgattcaacagaacgtaaacattgacgaacacacaagcagcagctagcagataaatggcagaagaaaaaatattcatttggctttgttaatccgacttttttcttcaaataaaaaaataataaattgcaaaattaaaatgaaaaattttattcccacaatttttttgtgttaaaaatgacagaaattttcccacaaattctttctttttttttgtgtgttaaatgtttcccctcaatttcttttatgatcttttggaagattaacggaatgggaacattgacaaaaaattaacgaacaaaagaaattgggaaaattctgtaaaaagtgttcattgtcagtacggaaaatgggatgggttaatagaaaatggcgtaaagtcgtcaggggaggggggggggggggtggagaagaaaaagccgcttcttcttcatgagagagttgggaatgc

SEQ ID NO: 28145 - DNA, 2006 bp, Heterodera glycines
ttatttgccatgtctgtgataccatttgacaaattgtggtacatggacatcatgcagggaatgtacaacaactaatggaaaaaaaatactcatgcccatgtgacaaatgaaaagggtcgtttttgtgccgaagttttggcggcagctaaaattttctaacttttttctttattgtctaaatccaacaatcttagcatgactcggagattctttacaagctctattcgctcaagcatataaaaggaagaaaaaaaacttaagaattccgaatttttcaattttcgttttaaaacaacttggtaataataccaagattgttggatttgatagacaaggaaaaaaaagtaaaaacaagggtgcttggtttttaaccaataagaaaacaattaaatttgactgttttaagaaatttaagtttcagattttgatccaattcaaaaaaaaagttggaacgattttaccataaattttatatcattttcagattttttcaccataaaataaaaattttttatgaaaaagctaagattttaattggcaaacattttaaatatttccattgaaataatcttctgctgaaacttacttcgaacacgaaaaacataatgattaagatgatgccgtgaacagtgtgaatgcgttgcccaattggcaccaaattggcatcgaaattcgtacaattgtacgccaaagcgtatttatcgcgttggaaaagaagcaaatccattatcaaaaaataaataaataaaatttttattgtttttgataaaaattataataatttattaaatttaaaaagatttaaatgaattcgtttgaaggcagaaaaaagaagaataattatattagaagattcagtttttgtaatttatttttgttgcttttccatttgccattgtatataaataaatctgtgcttttgacttaaaaatttgtaatttattcattggtacagaaaaatactttttggtaagaaattactcaaaaaggagtaattattcattagacaaatgaaaaatatattctttttaaatctcataaatttcaaatctcataaatttcaagcaattatcaataataataacaaaagaatttggtctgagatgaatgagaaactagagtattagcgggaccgggacctggtactgaaaaaacgtcgtacaaatgagtacctaagtcccggttttcggtatttggaggaaaggacacggaggaacttaaatgagcttggcaattttaattgcaaaatgaatatcatcattccaagtttgataaaccctaggaaaagcaattgtaagcatttgtggacaaaaaaaatagcaattgcagtttcatattttgggttttaaataatcaaccaccgtaaccagaaggatttggtttcatcaggaaacgttttgcctttttttcagattcttctagtcattttgcaggcttttgctagggtatgcacagaaaatggattaaatttgatcaaaaaacgtataaacaaaatcgtaatcaagtaaacataaaaccatccttggtcaatttcccaaaattaaaacctaatcaaaattttcacaagtcatcttgaaaaattttttatgcattcatttctatatgaaatttttattttaaaatcatgtacaataataataggcaatttgtaaaatgatgctttaatgtatacttttaacatcacccaattattggggcctttaattagggtggtggaacattggtagggactttttcttcccaaggggcgtgaaaaagtgaaccaaaaaaatcggggaaagtgtaccgtgttaatgaacagaagataaaagaggaaacagatgcaatcttattaaatatgggcttaaagcctgttattaattatttcataaaattattataacttactttgttgaaatttttttttttcatataaataaaaattgaatggaaaaagcaaaaacaaagccggctttagtttgtaataggttaacattctattgctattttttattattaataataaa

SEQ ID NO: 28146 - DNA, 1013 bp, Heterodera glycines
  misc_feature (953)..(953): n is a, c, g, or t
ccctgcccctacaacctatcacatgggacccctgtccctgcgacctatcacataggcagcggtctgggacccctgcccctgcaacctatcgcagggatctggggacacctgtcctgtaatttaaagcatttttgcatataatcaacggacagggtcgtccagacccctaccccctgttctattaagtaccctcagacccatgtcccttgtcatattaagggtccagacccctgccccatgtcctattaaaggatccagacccccgcccctagcgtcactatataagcagctcgttttaagaaatgtacagttaatagaaattattgtacccattacctctaaacattcatggagaaaaatatacaattatcggttgataaagaattggagcgtgaacctttaccaccgccggaccaacaaatggaacgcgaacaaccactcatacaaccaaaaatcgaaccgcctgatgaagatttcccacaagaaaaatcgtcatcgtttataccacagcccctcaaacttttgaaaacgatttgtcatgtgagaaatctccaccacctacaaaaatatccgagtccgacccgcagactctgtttaaaacagccaaattgacaacagagtggtcgcagaaggaaacagtagaattatctggcagttcggcagatttaacacaatggctcgaatacatcatgaaacccgaataactgcccctacatatttacactatttaaacaattctgtttttttcaatttgttacaaattattaaaaatgaacaaaatttgtattcatcaagtaaaatgttgtcattactgtccatgtcattatgaaatttgtaaaagatgtaggacacaaagtctattgcatttttgcaccgtacacttcccctggtcagaaaaatggtgggtgtgcccaaaatgtgcggcatatgtcccatacaaaattggagacaancactatataaataagttacaattagaaaaaaattatttttaaaaaatggtttaacgcccc

SEQ ID NO: 28147 - DNA, 1384 bp, Heterodera glycines
  misc_feature (1266)..(1266): n is a, c, g, or t
attccaatcagtgggactctattctcctgcgtttcaatcaaaaggactcaatccaccgcattcaatcactgggactcaacccaccaacattccaatcactgggactcaacccaccaacattccaatcaacaggactcaaccctccagcatttcaatcactgggactcaacccaccaacattccaatcactgggactcaatccaccaacattccaatcagtgggactcaacccaccaacattccaatcaacaggactcaaccctccagcattcaatcactgggactcaacccaccaacattccaatcaacaggactcaaccctccagcattcaatcactgggactcaacccaccaacattccaatcaacaggactcaaccctccagcatttcaatcagtgggactcaatccaccaacattccaatcaacgggactcaatccaccaacattccaagcaacgggactcaacccaccaacatttcaatcagtgggactcaattcttctgcatttcaatcactgggactctattctcctgcgtttcaatcaaaaggactcaatccaccgcattcaatcactgggactcaacccaccaacattccaatcactgggactcaacccaccaacattccaatcaacaggactcaaccctccagcatttcaatcactgggactcaatccaccagaatttcaatcactgggactcaattctcccgaattcaaatcactggactcaatctcatcaatccttcagcaacacaattaccgggactcagttctccgacatttcaatcaccggaacttaacctcagcaacggaatacagaactatttaagaggaatccagaaattgaaatataacccataataaatcaaaacactatggtgtataattattgcctccaccccataaattcaaattaaaactgacctgtttaaaactttccacctaaatttgatcccgcaagtggcacgtcaatatcccaattgcatataaatattccactcgaacaccggcaaaacatgagatgtagcatttatattgctttttctatccatcaaaggctttttctttcattttttattactaatcataacatgctttttattcaaaacaaatatcaaaaaccaaatcagattcttttcatattataagcaaggaaaagtacaaaaaacttttttaagtaacaaacctttttcattcaaacgaattctaatgtatttttttaatcattatcgtttacataagcaaaacaaaagctttcacatncaaaatcaatcattaaaacaaaacgaaaattttagacaaaaaataatgataacagcaaaaccacaaattttttctacacacaataacagaaacctcatgtaccggattttccactcaa

SEQ ID NO: 28148 - DNA, 1507 bp, Heterodera glycines
gataaaaaggcacaatttacgccaaagtttgaccggttttaacgtttattttggtaattttttttcaactttttgttcgaattcggatccgaggttcggaattaggcaaatctgagtcctgattcgtaatcagcaccctcgaaaacccccggaaactgattttgagctcaaaataaaaaaaagttaaattagggacacccattcttcaggattgccgaaaatgacaagatttatacaaattgctttttgctttgatagtaaatccgatgttgacgagcagaggatccaaaagtagatgatcgtctctgcgatagtttctgttgctaaataataatcggtttttggttctcatgttctttaggcatgacttttaggcgtccaatcaagtaccatccaatcttattactgtgtcaatctttaatttcttggtatcaactagtctcaggaataaaagaaaagactaaaaaggaaaataagaaaaaaaatggacgcctaaagcgcactggcgccgttttttcgtttattcgagtttatgggctcgaaattgctcatatatgctggtcctaatcagccacaccgaaccctcccaataaataaacgtgttctttgaaacaatatggaacaccatcaattatttttcacttactgtgctttgcgattcttttgactgttgttggtccttctgaattttcaatcgaattgcttcattctctttagcgctgtctccaatttgagtttcatccatagataaaaaaattactctaaaaatgtaattttaaaaattaagactgttgttgtgatcatggtcatgtgttcaatttctaatgatagaaaaaaaaaatttccttttttgctttttcatagaaaataaacaaacttcaaatttatatgctttctttatcgttatattttcagttttcaaattgcattattgtttttaaatgaccagctacatcgaacaagaagctgatctttctgaaggtcatgattcagactcggaagtttctgaacctgttgcaaagaaagcaaagaaaaataaagaaaagaaaagaaggcatcaaattaggtttaaaaatttcttcttaaaccttatacaaaaggaattttagtagtgatgaagaagaggaggaagatgaaggagatgaggaagaaatgagggattttattgttaatgaaggtgacgaagaaggtggagatgagggcgttgaagcggaagcagacggcgaagttatcacagatttaatccaaaaaggccttaaaattacctatttagagcgaaaaggggtctgatgtcagtgatgatttgctggatgacgatttggacctactcaatgaaaattaccaaaacactcgtggcagagttgaaattagcgatgatgaggaggatgtcagagaacgaatcaaagacagaatttttggaccgagtaattcaccattttttatatttctatgttgatttccatttaaagggtatgaagatgaagcgagggtcgaacagcctcaatat

SEQ ID NO: 28149 - DNA, 1992 bp, Heterodera glycines
  misc_feature (50)..(50): n is a, c, g, or t
  misc_feature (57)..(57): n is a, c, g, or t
  misc_feature (171)..(171): n is a, c, g, or t
  misc_feature (203)..(203): n is a, c, g, or t
  misc_feature (1820)..(1820): n is a, c, g, or t
  misc_feature (1848)..(1848): n is a, c, g, or t
  misc_feature (1909)..(1909): n is a, c, g, or t
  misc_feature (1921)..(1921): n is a, c, g, or t
  misc_feature (1926)..(1926): n is a, c, g, or t
ttgggggtgggtcgcctataggaggaactagctccggcccaccccacgtngggtcgncaagtaaagaagaaatatcacacttttctctgacttctctacctcaagcgtaggattcctacactatcaacaacgacctgccccttatgggattgtggtcaacaacgacctgcnccttatgggattgtggtcaacaacgacctgcnccttatgggattgtggtcaacaacgacctgccccttatgggattgtggtcaacaacgacctgccccttatgggattgtggtcaacaacgacctgccccttatgggattgtggtcaacaaagacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacatagagctgtccctcacgggatacatttaaatcgtctttttattatatatcaatgactgcattagggcacttccggtttccattatatttacaatgtaatgtgtcagcttctcaatgaagtgaaaccaagtgcatgtcgggcgacgcaaagaccctaaagaaaataaggacctgcccttcttgggattgtggttcgaggcctgccctttgaggattttgggccacaacggtttacaatgatgatttccttattgttaccggccaacatccggtgcgaagctggtcccgcactttgccaagaccagtggactggtgagaggtaacataggatattggagttaaccaaaatttatcgtcaaaatttgatgacaataaagacctccctttgggaatggtggttcaaggacctgctctttcttgagattgtggttcacaatggtgtatcgattagttccttatccaataatgataactctctgcactcagtgcccttagggcagatgggatgataggtgagccctggctgatagatttcaacagcggcttcatttgtggcaagcgaagaaacgacaccatttttcacactattacttcatttgcataaatatttgattttgtgtgcactcattggttaatttccttcatatttttgttacacccatatttttacactgattttgtatttaagatgccttctaaagatcgtgagttgaaaagaaggaagcaagaagagcacctgcgacggacggagcaatctgtcagtccaggtcgcttacctatcccaaattgccctcctcagggcaattcaaactgtcctattctggacaacccattgagtgcagatgggaatggggcggcatcgccccggggttttaacaccccaaatttaagtgctttgcaattgagcacgccggcttcttccattggaagtaaaagacggggaagacccccgaaaaccggagcggagtctatcacggcttcgcaaaatagggtgtcatcaattgacacacaaatcactccggccactcaaaatattgggacatcgccgtgcagcaaaaaagggaaggttgccgaagttgaccgacccaagtttgctactgaagcaattgcttcaacgccagtctccacgcaaaaaagccgtagtgggcggccagccaaaaaaactagaggaccaggaaggggcagaacaaatgattcgttgagcgaacgctcttcaatgggtcagagctctgaagcggccatanatgtggctgttttgcccaacgtgcctgnaaaaattaattttagcacagtacaaattaatttcgcaacccagcggaatttagcgtgtaanatctggaaatgnggagncactgctctttacgaatgcgatgcaagaagtcaggcccagattcattgaaacgtgctggaatgatc

SEQ ID NO: 28150 - DNA, 1085 bp, Heterodera glycines
  misc_feature (984)..(984): n is a, c, g, or t
  misc_feature (1049)..(1049): n is a, c, g, or t
atccgtttgattggtgccggcgctgaacagagaattaaaaaaaatataattaaaaattatacatttaatttaagtttctctttgattgtgccgccctcatttagcaataatagcaacaataataatgattcgggcacaacaaaagcttctacaactaatgatgatgatgatgatgcgaataatttgttgattttgcaccaaaactgtgcgacaaatgtgggagaaaaagaatgctttttcgagcctaccgtatcaccactgtcattcctactgtacatggatttatctgaaatatacggtgaatgactccatgattattggcactattaaatatttattaaaatgaattttctacatcgtatttttttttgttttgaaataaattttttaatttatttatttaagtttaaaataatatttggattaatattagcaaatttttttatccagataattaattacataattaaatcaactaattacctaattaaaataacattaatcaccaggaatgccaaaatatgtgcttcacccaatccaactgttcacatcactgaacaacaccgaaaatgtcgaaaatgcacagaactcgccgcgctttgcacgcgcccgctttcacgttcagtttaacgctaccgcgcgcgcgttcgcaccaccgcttgtactgctcgcgcatgtcgtgtacgcgtcgccaccaacggcacagcgcgacaacgacagcgacgttgagtttggattggcacaggacgctgcgggagctgccgaacttgtggaaatggcaccagccacgggcataattgtgccaagggtgaaggaaaaaaacaattttgaaacttaaaatttttttaatgctttaaagtaaaacttaaaaaatactttcaacattaaattaatttttaaatattaattttcatataaatgttaaaatttgtttatttttaattttttgcataattatcggtaagaattatttgtttcgattanatcttttcaattttttataataaattaaaaaatattaaaaaagtaaaaaattttcctggctttanagttaaacaaagaaaaatgcattaattaaactttat

SEQ ID NO: 28151 - DNA, 1041 bp, Heterodera glycines
ataagcaaactaattagcgaatttggggtcatttatggccattaatgttctctattagcctccaaattttaaagaatttttaattaggttacaaaaaaaattagaaaaaaacacaaatttttttaatagttttggtcataaaaattttacaggctgatagagaaaatttaaacattaaatgaggttttgataagtgatcagaggaactcgcctggaaatagtcggccaatttgagcagcatcagcacatttttatctaaaagttgagaattcaaattaaaaaaaaaaattgaaaattaaaaatcatttttcacccctcagggggttattgaataaatacagtatcatgtcatggcattacggttgggcagaaaaggtccgttcagaaaagtgatggcctccaaaaactccatgaattggtccatgtccacgcccaattcgtccaaagtgatcattcgctgctgcttctccttcatctccacgctgagcatgcgactgatcaccggggaaacggacatcagccaatgggcggacacagcgatctgctgattgtaagcaaaattgataagtgatctgaccaagataaatcaacgatttgatcaagaattattagtgatctgatcaaaatcattgttgtgattacgcccccctcccccttataaagttgagccctccccccttccgcccccattgttttcaatgagtctgataatttggcaattacacatcctgcacatttgcggatgaatttttgtgatagatttttgacagaacaggccttacttaatgtgcagtatccatacataaattattatctaaatttcatataccgaaaaattgttttttgcagacttaaatttaacaagcacaaattgttttcaaaattttttgtatggaaccatgaaaaaccggtgatgcttaatgttgctgttattctttctgtttttcacctgtttgtcaccaattttcatcgtcaaatcgtcgtcgggtaagctgctggatggcgccgggaactgacttaaaaaatggggaaaaaataaga

SEQ ID NO: 28152 - DNA, 1163 bp, Heterodera glycines
  misc_feature (1146)..(1146): n is a, c, g, or t
  misc_feature (1151)..(1151): n is a, c, g, or t
tcccgaaccaaatttctgttaattcgctcgaaacgcttatttcgggtgccattctcaacgaatctcatccttactccttcttcccgcaccaataagtttccaaaatttggtctcaaaacttcacgcaaaccttcaacaaagtcctcgtgaccaacattttaattgcgaatttgctgctgttcggcaccattgttaccaccaccgtttgctcgcggcggcaaattcgattggatggacacatgcagaaggcgccgccgaatttcatcgtcatttgctgctgctgcttccatttcactaaaatggtgttcgttttcctccgccgacaaactcaaattccggttaagtcccggcgaaatcggagcgttaactactggttcattttcaccatgaactctttcaacccgtcgctgttgctcttcaatcgcttcgttttgtgcgaatgttcgcaaattcaacgctctttgtcgtgtcaatggcggagagcgaattatcatttttgcacctggctcaggtatagcaaaaacaaaataagtttccgctgtcgacacttttccactttttcgtttgatggcgtggcgattaggacggcgaatgcgatagttcggctcgaatttgttgcaatttgaaaactttcgactcgaattgttttgttgccctttatcctgtctcaggatttttaactccactttcttttcaacttcaactccaactcttttcttcaaattttgaaatttgccctggctcagggtcaattcaaattccgttggttttgttgtccggttcggacttcaaacaaaactatctaattccgatctcgcctttccccgttttacctgctgttcctcaggagcgccaaataggaatttcgaatattccaaccaaattcctttcacttcaattcgaattggggggaggatggagttcgaacgcacaatgataaagccaaacaatatttattttaaagtccgaggagatcgatgagcaatttgagaatcaatttagaaagaaaatttgggagacaaatttaagatgagaataatgagaagtgaaagtgtaccaaacataaattaaagaggtcaacaaacataaaataaatagagataaaatgccataataatttaaaattaaaacaaatatcttaattanattanaatctccaacaa

SEQ ID NO: 28153 - DNA, 1867 bp, Heterodera glycines
ttttcggccgttcagcggccgttttttaatttgtgatgagtcggacgggcgcttcgcgcccgttataaaagtttgatggactcagacgggcgcttcgcgcccgtttttaaatttgttggccttggacgggcgcttcgcgcccgttatttaaagtttgttggttcatacgggcgcttcgcgcccgttattcaaattttgttggccttacagagattagaagaggtacaacagtgattagaagaggtacaacagtgattagaagaggtacaacagtgattaaaagaggtacaaaagtgattagaagaggtacaacagtgattagaagaggtacaacagtgataaaagaggtccaaggccttacagagattagaagaggtacaacagtgattagaagaggtccaacagtgattagatgagtccagcagtgattagaagaggtacaacagtgattagaagaggtccaacagtgattagatgagtccagcagtgattagaagaggtgcaacagtgatgagaagaggtacaactgtgattagaagaggtacaacagtgattagaagaggtgcaacagtgattagaagaggtccaacagtgattagatgagtccagcagtgattagaagaggtacaactgtgattagaagaggtacaactgtgattagaagaggtacaatcagttaaaaaaatccttttacttattaaaaataaagttagaaatttataatatattgtagaatatttattgaaattgaaaggaattaatttctcgaaaattcaaattaaataaaacatttattcatcagaaataatttaaaataattaataaaacaatattaaattaaataaaaaattaaataatttaaattaaaacatttgttcaccaaaataatttaatttaaattaaaatttaaattaaaaatttttatttattattaataatacaaaacaaattaattaaaaaatgtaaaagtaagcaaaaaatgcacagaaaaaaaatggtttatgaaaaaatataattaaaaaaatgtattaataatttttaaaaaattattaaaaaatgctttcttttattaattaaaaataaactttaaatttacaatgattgagtattattgtattgaaaataaatttttgacaaattataattaaaaaaacaaataaattctttaatttaaaaataaaaaataattaattttaaattaatacatttatttaccaaaattatttacttcaaattaaacatttttatttattattaataaaagaaatctattttttattaataaaaacattgaaaataacgtaaaaatgcacagaaaaataatgtacaccgtccggatccgaacctaccgccccccccccccagaagatgactcagaatccccaatcacacagggattctgaggtcttatcgatgtcaaaagtaaaatctgatcacgtattcgtgatcagcagcctcaaatagcatttttttctgaaaattcgaatttttccagaaattctggaataacttttttccttttttagatagaaattcctaataaagtccataaaattctcctgatttttctctatttttaaagctttatttgctcaaaattggtcgacccttaggctagatatgaatttttcaatattcgcccaaaatcccgtgggccaaaaaattggaaaatagttttgaatttttaaaaaattccaaaaattttgaaacgaaaaatagacatcatattcgtgctcagcacatcaaaataccccagaaaaatatttttgacccccattttcaacccaaaaaaaaattttcgaaaatttctagggggcctagctcgaaaaattttgaaattttccaaacatgaagtacaccattcgat

SEQ ID NO: 28154 - DNA, 1103 bp, Heterodera glycines
ccccccccccgccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaa

SEQ ID NO: 28155 - DNA, 828 bp, Heterodera glycines
acggagttggctgggacggagttggcgggacggagttgtcctttttgtattgggacggagttggcaggacggagttggctcgggacggagttggcctgggacggagttggcctgggacggagttggcgggacggagttggctgggacggagttggcgggacggagttgacccgcttcgcgcgaaaacgaccctgaccgttttttgcagacctactaatcatcaatccttcccttcaacgcaattaattcttccttccctttgtgaaatcattcggaactcggccaaattgtgctaattgcgaaaaatgaaccgacggtaaaaggattttaaaagtcacacaaattcgtcatttatttagctaacaataaactgttttccataatttcagttggatttgcaacgacgtttggatggacattttcccatcctttgaccgtcctcaactcggcctcaaattggcacttctttcgccacgtttcaatgcgttggtggacaaacatttcaatggcaaaagcgaattgactatttggagaacgatcaaaattcatcgcaaggacaaaggaccagaaacgaaactatctgtgcggatggatgacaaatttgtggaatttccgttgccggaccgtccgttgcccagcaaaatccgttttaagcaccttcggattatgtaattgaaaatcatagctatggcaataaaagctttccttccattttcaggcacatcgatcactccgtcatcgcttttcttcgttcaaatcaccaaattttcgacaaaagaggcaccaatttagacttgtggattccatcatcttgcaccacggatgttt

SEQ ID NO: 28156 - DNA, 1729 bp, Heterodera glycines
atattttatttaatctgtttttttcaaaatactttaatattttataaaaatagtttattattgctcagaaaaagagatagccaattttctggcatattttttattactacataaacttaattgcattatttaaaataactggtatgactgaaactaataatcaacaattacttgaaatttacttataataatgaaattaacaaatattatctttaaattctttacaattaatatgatattatagaaaaatgaattttaaaaaataataattaaaaaaagtaagattaatttttataattaaaaatgaaaaaaatctatttaattaagtccattcatttggattctgatagatactagaaatcaagcagaaatagagaaaaacaacctatttttaggttaataagtagccgcaattatagtttttaaaatttattttatctaaaaaatgaaagaaaagaatttattgctgttgccaaaaaagcactactactaatctactaatcaatataggaattaaaataattggaaattattcgaaaaagaaaaataaataaaataacaacacttaatttaaaaattaataaaaggtcaataataattaattaatgcaaatgataacattgcaagcatatatgcgaacgattaatcagttacctgtacaagagaattatttaattgttaaattaataattaaaaattaaaatgattaaaaaatgatccaaattgttcaataaaaaacgagttgtctaaatacgagtcgatatcggctaaaaatttgaatttgaatatttttgataacacatcccaaataaaagttaaatggtgatttcttgccattaattacagaaatattcggacaaactaattttatactttttataatttatattttgtcttttttatgaaataaattttttttacatcttttaaattttttaatcagtctcactcgaacttcaacaaacttatccatttttagtaataaaaattcccagttcctgccttttcttttaaaaattatccaaaattcagtatattttaaagcgtgatcttaataatttagcaatttttttgaattcgtaataaacataatattgtagacaaatattgaatgatttaatatactattatatataaccaaatcaaaaattcatccaacaacacactcaaaaaatttcagcaattaattgtaaaatataaaataaatataaaattaattgacttaatatacaaaataaatgagaaataaaatagctaataattgaatcaagaaataaataatcaaattttaattactgattacagtttaaggtttaagtcacctatctgcacatttttaaattttattgttattcaaaaatcgaaaaaaccaatctaaaaaataatttacttttaaaaaataaattaaaaatgaataaaaaaaaatttaatgtaacaattggaagtttgtaacaataaagagatttattataatgaataaataattgtattaatcacataattattttttgatattaattttctttattaagatataaaaacttatttaattgctgttgatttcaaactaatcaaaagtctagcagatatgaataggaatttatgtatggataaaaataaaatatggtaacaaaaaaaaattggacactttgtggcagcgcccgaaaaacattcaaaatttattttttaagacataaaaatatttattttataacaccaatgtttatca

SEQ ID NO: 28157 - DNA, 1371 bp, Heterodera glycines
  misc_feature (1220)..(1220): n is a, c, g, or t
  misc_feature (1283)..(1283): n is a, c, g, or t
  misc_feature (1337)..(1337): n is a, c, g, or t
ttccaagttcctgcaatagaaaattgggaaaattagacatgcacaaattgaaaacgaccacaaatcccagtgtgtaaatacaggcgatgggtccggtagtggcaaagccgggagtctggattgtaatctttttgcacaatccgggaccgagacctgaaaaaagccgggttttcacgcctcgagccggtgacgctcaactctagccaaaactgatgaatggtaaatattaaaacaataattttataaattattcttcattatactcgaaaaatgaaatgatttttattaataaaaataaaatttatattttaaaggcttggaaaacaataacaataataaaatataaaatagaatccattccgccaaaaccatacaaaaatcataagtatcagtaacaacacgaaaaaaaatatacaaaagtaaagcagttttaatcgtgagaaactcatatttttcttttattatttacaaaatgtttaaaaataaaatagcgtaaaggtaaagaagaatattgttggggtccaacagggggaattccgacctaatgcagctttggggattaataatggggtcagaaatacgatttttggaaatatcgggaatgcaaaagatcaaaggagaaaagagtcgaagtggcacggaggaattcgaagtccaaatgttgtgttgaatgtgatcgtatatacgcatttccccaaaaccattttatttattgattctatctaattttattacatttttattttttatttttggttttaatctaatttttaacaagtatttgtcaaatttcctgaaaatataatgatttaaatctttttgcgcctgcaatagcaaatcatgctttgatctggttaaggaaactgatacattcttgtcgaatgacaactttcgtaattctaaaaaaaacaattttttgagaaataatttttaattttttcttctggtgttaactgaataaaaaatgtttattaattttaaagtgtctatttttattcgaatctttatcaataattaaaaagcttacattcatttaatttgttttgcaattttatttttgtaaaactggcgaaaagaatattaatcattttcctgaagatgacttctctcggtatgtttggggcggtcccttcccgcttttggctgaaactatttacgccttacacttattttgttttttaaaaaaataaacatttttaaagattatacttacatcattnctccattatttctcataaacttaacatatttcttttatatactttcatttttatttatttttnaaatttttatcacattaacttatttatttattttttcttctaaatcttaatatntaaaaataaatattcatattaaattcactaatat

SEQ ID NO: 28158 - DNA, 904 bp, Heterodera glycines
  misc_feature (882)..(882): n is a, c, g, or t
ctctattagcctgccaaaagcggatagatttgcaagcctgtaaaaaattttattaagaaaaaacttcaaaaatttcgacttttcgaaattttcatgtataacttttttggtaattgtctaatcgggaagcaatcgcttagaaaaagcttctaaacatgttaagctttcgaatgatatcaacaatgatggatttggattacatagaaaaaagttatagccaaaaacatgctggcgccgaaacgccagcgccgaaacgccggcgccgaaacgccggcgccgaaacgcagtggacctatattaaaggaaaaaatttcaaacaacaaacacctagatttttatttttagaaccaaaccctaaaaaaatttgaaaaaaaaactattttaatttgggcatttttcccaaaatttaaaaaatgcaataaaacgaaaaaaacacctctaagaatcgatccaaaaatttctgaaaaaaaagaaatgaaaaaatttctcaaaaatgcatctccaaaatatatttatttattttcttgacaatattttggagtttttttagaacctaaaattccatctctagtaatgaaacgccaaaattgccgaattagaatttaaaaaataataataattggaatttgaaatttttgggacagttgcttacatttttaaattcaatttgtatcaaaattctttaatgaataaaaaacagcagcagaaaaaaggcatttctcattatattcaattattttagctataaaaatataaatttcggtttttttatggccataaggcccaactcttagcagttaaaaaatggaacttacattgagcaattattttcattataataaatggaaaaaagaaattgcttgtttgatttttcgtggctanagaaagagaaagacaaacaaca

SEQ ID NO: 28159 - DNA, 917 bp, Heterodera glycines
tgcattcttcggcaacttgaccacctggaagaagctgcgtgcagggtacgtgtccgcggtgaagaagttcttgaacgtttcgttgacgtcctggaagtcgctcatgttggccaccatgatgttgcagttgataactggaaaggggcggaaatcaacgatgatggttatgccgaattttgctcacacaccgtgtttgaaggatgagccggcgtatgtcagaagctctccgatgttggtcatcgcctgcttcgcctcggctcgcgctcctcccgacaccacatccgtctttcctggcatcatcccggtctggccgctcacgtacagcgtctggttgttgacgagcactgcctgactgcagaaaagcaaataaagttgtgctttctcaattgtcatccattgtttgctccacctgtagcccgtcgcagcaggcgccttggacgtcgcgatgatacgaatggacggagcagcagccatttggggaatggtggtcgtttcagaaattaggacgttggaagtttgttcgctgaaattgttaattaaaaaatattgctactttaatgaagtgcaaaatgatagtcgacaaatgaaaatggttgcatatttatacagagagaaaaatcgaaatgtcaaaatcgaaggaagttcaaatttcaccgaacactttttgaaaatttgtttgtgcacgtttgaaatattcactcagttgtaaaaaattttccacagttgggattttcttgaaatttttcataaagtaatttttcggccgtctctatcgaacttttgttttctgaaaatttcttttctaactcgagatcggctcttccgtttttacaagggaaaatctcggcaaaatttttaattagtggggttttttggcgttttgtccttaggcaatttttgtcaaaatgatgatatat

SEQ ID NO: 28160 - DNA, 1751 bp, Heterodera glycines
taaatcttaaaatagggttgtacttttgccgtttttccctttcgtcattatttttgcccgattttggctgttttaaaacttttttgataagaagataaggaacaaacaataaatccgaatggtcggttttagattttcaaaaaataaattctcattttttagaaaaaaatgaaaattactcaacatttttttttatccaatgatttttttgaattccatttagaaatatgaattttatctcttttttatttaaataatttatgtattaatgttttctgcatcggtttcaattatttctatagaaaaaaattaaaagctttataaaatttttaaaattacataaaacatataataataatttttttcctatttagacattacttttaaatttatgaaattttaattgagattacctcaattagtttgtattgatgttggaatgtgcactttgccacaacaaattgatgaataattgggctgaaaatccattcaccaactgttgtcatatttttgtccaagtataatgcggcagattttgatgccaaattagcggtctcatattttgtgaacaatgagatgttcaaatattggcagatttgatccgtcattgtttaataataatttgaaaattaaatatttaaataagaatttgagctatcctttttaaatcacaaaaaacatttagactattggttaaacctccagtctttcatcgatttatcctttttcccgacgacgccttaaagcacctacgacatcttctattcagcaaaaaaaatttggaaaaataaagtggcgaaaacagatctcaccaaaattggaattctagaaaactttacaatttatctatttttgatataaaaaaaaattagaaaaataattaatttcgaataattgttgaattgttaaaattgagatagatatttgttttttgttttctaacattcatgcaaacgattttatataatatgaaattaaattcatagaaaaggatgaaagagggaacaaatgtcaaaatagagataattagtcatagaggttttagtgtttttaaacattgttttttgaattcaaaattttcgaaagaatcgtttttagtaggggtaaattttcagaaaattcaaaattcgcaaaaaccttaaaatatgtaaaaatgaaaatatcacgatgataatattttaagtcgtaattttccctaaagttgttaaatggaaatatttattgtacacggaaaacttcacacacacgcagctaattaaaacgaatacaaaaaaaaagagagagagcgatgttcaaaatttagtagtaattagaaagaatggaatgttattcaccaaaaacataaaatacaataaatacacaaaataattaaaacacgaaagacatttacgatctctgacgcttaggatattattgcgttttggttaagaattttagacaagttttgcgagttctgtgcttttttattattttttaaaatatttttaatgcagttttgattatgagttttgagacaaaataggcatttgggcgtaatgaccggggcggagtcgttatttaaaaaaacatcataaagggcgttatttaaaaaaccatcattatgaaaatttttgtcgaaaaattatttataattttgctccaaaacaacaaaatttttaatgatggtttttaaataatgacatagcacctaatgaccctccccccccaccccaaaaaaggcaaaatcgggattataaaagtcatccaaagaa

SEQ ID NO: 28161 - DNA, 1140 bp, Heterodera glycines
gtattcctccccgagttgttttttggtcaacgctgggcggcggacagacgggccaggttttttgagacggagtcgagcaccctcgcgtttccatcctccgagtgccacgtgttgttgtgtgggtgtcggcatgaccaccttgagcgggcgtggagttgttcgctgcgggtcgtaccggccgagtcgaaagacggcggttggttcggcctcaacttcaagatggtccaagattttggtggtggcttccctgtcttcctgaacacgctccgatgggcgaacggcattgctttctgggaggccaatgaacaccagtgtacgttggcgttcttgctctgcgagtgcggcagtgattgggtccaatgccggtgccattgagcgtttggcgcgaggcggagtgatgtttgttgcgttggttcgcttcatgtcgaataattagaaaggaatatttgttttttgcgatcttatttggacaattaattgtcttaattggactatcactagtcaattacctctcttaggcatagtgcccattaaaatttaaataaattaattctaacaaaatcctttaatgagtttcacacagaatcacagcgccctgaaattgttgttttagggaacattttgaatttgaaaagtatttccaagaagatttgttgaattttgtcaaagtcatttcagttgaatacgacgcacacaaaagtaattaattatgtaaattattaaaaaaaattagagctcgacatattgaaaaatgcttggacctctggatccggaccagggatggcatggaatccaatttccgattccgacattttggggtcggaatttcgatttgcctggatccaggaaaaacccgtaccttgatcctcatgtccagatcgagctcgagctctaattaaaattaataaacaatcataaaaaaaattttggctcttattcagtttgtcccccataaaattttttttttaatttctaagtaaaaaagtcaaaatataggttttcggggtcgctgatcacgaatccgacatccatttcgaaccccgaacccaaattcgaacaaaaagtcaaaaactcaattttcaacaaaattcacatttattgctcaaaatcgattcaaatgcacgatattgccgaatgttg

SEQ ID NO: 28162 - DNA, 1571 bp, Heterodera glycines
ggaaaaaaattgtgccaaattttttcgtcttgaatgcaatttactgcccagttttaaccggttggttcccaaaaaaatatttgaaaatttgagccacatttgttgcgggatttttgttcacctatcaaaaatcggagtaatttagagctcgacaatgcgaaatacataaattccggtattcagtacaaaagcccttgaattcgggtccagccgattgcgagaggggggggggcagcggcgagcagacattcttttttgcttttcataaccctttttgcgggatgagctttttgaaacaatcgtataaatttttgtttaaaaacttaagttttgtagtttgtaagtatcaaattcttagacttattgtaaatgttgaccgatttccaatttcttaacaggaaccggcggggggggaaatggcgagggggaaacgtagtgcacccgaaaattacaccggacagaaaatttttgagtcggagcaacaaaaaatttttttaaataaactcttcgggtgtaccccctggcacgggaattgaatcaatttcttgccaacaaaaaaaacaaccactgaaaccataaacgcacttgagcattgtgtgtttgttgtgcggtgtgctgtggtacattggccgtgcctttgccatgccaccaaatgccgttttccgctgcttttgctgttgttgttgggccggcggtgggtgaaggtcatcatgtttaaagttcggcacattgagttgctgcagcggcgaccgtttttgtcggtttgttactgcgtccaggcgttgttgcggtggtccatcaaaatcgacgtgtttaaagtccggcacgttgaggggctaaaaattgcgacataaaaatggcgtattaaaaacgaaaaaatgatatacctaattggagaccggaaataggacaaaatcacagaattgcgagtcagttatccgaaaattcggttgttttttttttgttgtttttgtcaaatccagtctccatggcattacagaaattacagaaacaatggctacaaataatggaagggtagccaaaggtttcgttcttcaccattccaacctaaagcgaaaaactcaagaattttttttttaattttttttttttgtaattccggcaatgcgagtttttttaaatgtaaaaaattaccgccatcagtgaagcaatggtggcgccgcttgacccagttgttgttgtggttgtacgtggcgttgtttttggcgcctcacgacttgcaatggacaacgccgaggacagcgacgacggcaccggcgtcgaatgggtgtgccgatggtcaacaatgctactcgtgttactgtcatcaccgccaccaccaatggcaccacggccaccaccatcattgctaatggatggcgagttgttgttgctgttcaacagaatttgctgataggacagttggaccggcaagtcgtcgtcgtcgtcttccgcgccgccgccgttgttgccccccattccctgacgcatgaacggctcatgggcaggcaagtggagtgactggaacaaatttggggacaatatcagcaaaattgtgcggcattgactgt

SEQ ID NO: 28163 - DNA, 1346 bp, Heterodera glycines
  misc_feature (1336)..(1336): n is a, c, g, or t
aaattaatattatgagaacgaaagttttccgaaaatacccccacgtggaagggttaggggatgggtaccaatatggatacttacttacaggctaataaaaagcccgtaaaacccgtatcgctcgaaaagagtacgggttactggcccgtaaaaatccgtatgcggatccgacccatattcgatctctatttaatatacaatatattatcataaataacaatttgcttttaattaagattatttgagaatcgaaattttcgagacgaaagaaccgaggactgtccttgagagtcaatgacagaaaatcccattcccgtctctttctactctcaaaaagctcgagattaagccgaccctttcaatcccggctgagcgtatcccactcaccaattgattcatttgcaacgcattttgtgctccggctccgccaaatccgaattgttgcagcaattgttgggccgttgcgccgccggtggcaccagcggaggccgacttttccaattgagaagcaattgcgagcgcatcattttgtgccctgaattaattattaaaaaattgctaaaaacaatattatactatattttaggactcaacgatttattctgaacatgggaaaaatgtaaaaagtttaatgttgttttttttgtaaatttatttttcttgaaaatttctttaatttaatttaaattaaattaaatttattttactgaattttttgagacgagatttcggatctgttgtaattaaataatttggtaaaaatggaaaaatcttagtgatttgcgtttttaaattttccaaatttatttttctagaaaattcctttaaatttttatttattttataatgaatttttttgtgacgagatttcggatacaatatttaaataatttttgattttttaaaagttttttaaaattttttctcttttcggcacacctcacaccgctgctgttattgctaattatctctaattgctgcggcgtttgtggtggtggcggttcgccttcgtcttctccaacaattccccagccgccaccaccgctattattactattagtgttaatttcattgttgccattgccaatattactgctgttattcccatttgctcctgatcctccttcaaattcattttgtctttttcccttctgttgtgcatttcccacactatttccctctccttttcctccactaccactctctttgtttgctgtgctatttcgtccagtgatttttctaacatttttcttttccaccatttcttcttcatttcccgcactattttgttgtctattttgctgctgttggagttgttgtcctgtggtggcacaantttgtcagac

SEQ ID NO: 28164 - DNA, 1405 bp, Heterodera glycines
tgtatgtctactgcttcactatgggtcacgcccagtgttagacaaaattgctcataacgccaaatagcgcatttggcgtaaattatttcgcgctaattcaaatttacgctgatcactgccattttgattgtttattttgatcagccgtaactttcttcatttccaactaaattgaataaaatttgtatctaaaaattgtttttgaaaaggagagtctttttctaagcgaatgctaagcaatttaactcgtttcaaaacatcaaatttttcgaaatattaatgtgaaaaaaattgaggtgaaaatgtggtcaaaaatctgggtatttgtcgttttctttgttgttctcaacgcctcggtcgtgcagtgcattcaacatcgtcgtgtgcttcaccagtttctcaacgatcttctcttgtgtgccgagatgagagtagcggcctacctaaaattaaaaattcaatgataaagaaaaattgaaacaccaaattgttgcacattctgtgcatgtgttccattccttgttcactgatcagcccccaccaaagatgagagcgcgcaaaagggacgacatgggcactgagaaggtgaagcttcggacggacggggtacgcgaggcgtcaagtgatcggagttgctgccagtggcagtagaacattttggtccaatgttcaagcgaatcgagatcctctgggtgaagaattttggcacgcgataggcggtaaatgtggcggaggtcattcatggcgtccatcagccaaaatttcaatggcccgggtggaattggtgccgtgaatgaagcgaagttttcgtggtcaaggattttgtagatgtcgccacctgtcaaaagttggccgcctcaataacccccacctcatccccatcattctacccgtgaattgttttgtccgagggtgccgtcgcactccgacatcagacagtcgtttccgaacaacgtccccctttccacgagcatccgcttccgaacaaatggcgtcaataacgcgctgaccattgcctgaaaattcttggcccatcgggcgtgtgtcgccttggccattttggttcgtcgctcctctcgcttgttccagcgcttttttacagattctccgccgattagcttacttaataattttctttctgccatgaatacttaaagaatctatatttttatttattagcacaaaaaaactttctaattcgacctattttaatattgacttgacctattaaccgatgcagaatttttttctctatcggtatgcaaaatttggtgcaacttgtatgcatagaaaacaagttatatggagagaagtaaatgttgttttttacatcattaaaatgaagagatagtacgccaaagtgagagaaattataaagaaaaagagaaacgacgagatagtacta

SEQ ID NO: 28165 - DNA, 1595 bp, Heterodera glycines
ttttcgataaagaatattatcgttgacatacataaattaatttagctttttaaaattaattaaaaacaatttcttcaaatattttctaccaccaaatctgaatgtccaccgctgtcgaagcgtgccaaaagaatacggagaatgaatgccgaactcactttatggcttcatttggcattttcagaggattttatcgggccccggggatgagaaggattcgcaattgagcgaattgggaggataaattgcctaaaaattaatttgaccatttcaaatggctcactcaaagtgttcagcaacatttaccgccgctctctttttaaatgcgctttttccgacccgcggtctttagccttgccgagaatttggccagccaatttagccataaaacatctgcccaaatgtcggctgaatgaatgggcgggtcccacggcagatgaaagatgaaagtgagggaaagtgacagcgaatgaaatgccaaatttatatcaaattaattcataagaaataaaaatatattaccacgaaaatgccatttcatcggccgaagggaacaaatttagcgctaattatgctaattgataaattattcatgctccaacactaattgattgtcaggggaagcaccgaaaagggaaggcaaattaattaattttctgctgacgtgtcgccaatttctcaaaactcgggagccaaagaatgaaaacgaagagagggccaagaatagaagcatcaaaggcaattaattaattggccaatcagatgattatgcataagctaaaggcaagaaacaatggtgaaagaagcagaaaagcgattggatgactcaaaaaaaggacaaaaatggacaaaaatcggataaatgccatttttggaaaacgaattggaggattatttgaataaattattatttttttctatgaaacgctaaacaaaacttctacattaatatttgattaattaattgttcgattgacccaaaacagcctttaaatgaaagcataaatttttatctttatttttgagaaaaatcggatgaaaaaataaaatgatgccaattttcgatttttggccatgatgagcctttaggggaaaagcaattcggtacaatattttggataaaatgagaattactataattagaatgtacaaaatgcaattgatttgaccatcttccgtcagttttggccccctttccgctcatttcagcggaatgttctcccattgttctccgctctctgtggtctccgcttttgctgctccgtccccactttcgctgttgctgctgctgttgttgaacttcttgcgcttttccttctcctccgccatggcattgtgcaaagagaatttgctgagtgttttcagtgtactaaacgcaacaaaaaatcattcttcgcaagaaaagcataattagtgtctccactttgagtctattagccgaaaatgttaacttttggcgaatcttagcttcccaggttcagacctttatgcattgtttgggtttaactaaaagtccctcgagcccaccaatcacttttttcgcgccttttaattatcattttaattatttagtttgattatatgtgatgtcataa

SEQ ID NO: 28166 - DNA, 582 bp, Heterodera glycines
ttccaaaatcacgcattttccatctgatcattggacctcagtaaaaatcgcaaataaaagggagtcatgtggaaaatgaaggaaaatgaatcggaatatcggcggagttgtttatcattgcaaaaatgggaggagaaggggggggggggaaacacgttgagaaatggtaaataaaagtcgaggaagtcgtcgggactcactcttggccattcattcgctccctattcccctttttgaatttcaataaattattttccaattttttttctaaattttgctgaaatgtcggccaaatacttgcgcagaatgcccccctccctttcgcttcttttggccctttcgatggccttttgcctaatcactttggtactgaaatgccccgatgaagaatgcgtaatttttaattatgccaattaattaattaattaaatttaattgttagaaaaacaatttgagggaaatcatttgtaagttaattaatgcaatatgatgtgatgagaacaattattaaatgcccttcttttgttagcatttccaatggacggcgacgaaacaaacggaacaaattcatcggaagcaatg

SEQ ID NO: 28167 - DNA, 905 bp, Heterodera glycines
tactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattcttcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttattctgcgttggattttgctccccataaatgtttgagtaccccaacggacacttgaaaaatcgatttttttgt

SEQ ID NO: 28168 - DNA, 2117 bp, Heterodera glycines
  misc_feature (32)..(32): n is a, c, g, or t
tttttgttttcgggggcagtccccccgaaccngatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgacgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttatttcataaatatttttttagaaagtgctctaaagcgcaccaaattttatttacaagttaattttagcactcggatgctttagtatcaaaaaggaagatgaataaaatttttaattgctttttaaacatgccaaaaagtttaggcttaaattaaaaaaattttcttcggttctagctctttcaataagcaataaaatcgtaccaaattttataggcatactccccggtacatgactaacttaacctgaaaactttcaacgcttattgcttttaaaaaatttttcgaaattttgagttttccattattttaaattcctaaatattttttcagaattttattgtcataatattaatgaacttaatgcatgcatatattctggaatggttcatgatttgagaatcatatatttttttttctttagaacccactaaatttcatggaaaatattttttttgattggtggccaaatttcaccgaaaaaatctcataaatacaattttccgaatttttggcactttctttttatcccattttttggatttcatttcttttccattatttcgcttctccaaatttggctttccatctttgaatgtttcgtattggaacttctatcatttcagcaatttctttgtcactaatttttggattttccatttttatttgccaataaattttcattttttcaattttttctttcttagttcttttttctatgttaatgccaaattgtttcttccatttcttaattgtgtcataatagccaactcaaattttcttacaaatttcggcataatttttctcccattcttttcttgaatattttcttcctttttgcttgattttctcttcattttgtttttcttcttctttttcttcccatttttctccaaatatttcgtcaaatgattactgttgtaatttttcatttgctgattcaatggcatattcgtgaaattaaaggcaaaaatttatacagttttgaccatcttttacaaatttttatgaaataaagtaaatttggttatatttttaaaatatttgtggtttgtttagtggttagtgcttcaacattaacaaactttttgttattagttcgacatcggttgacgttttcttttgattttttttttccaaataatacagggtttttctatgttgttattataagaaatgttctggtttaggggtagtaccttattttcatctaaaacagggaaattgctaagaaatttggctaatttctaacaaaattcatatagttctaaaaatttccgcttgccgcgccaatcgggacccaccggacctctcccctcgcacatcaccaagttttttggaaatgggccgcaaaaaagttaaaaatctgattaatggaccccgaatgaactgtaatttatgaaaaaataataataaaaaaaatttttaatttgttaattcctaaaaaaaaaaaaa

SEQ ID NO: 28169 - DNA, 770 bp, Heterodera glycines
taaaaaaagtcatatcaaaaaacagttgacatgagcacccccccggggtcgagagtggagtcccagtagggaatgacgcctaactcttaagatgaattacttaattagttcattaaaatgagggatgggacggaagtgccatcgaagcaccgaccgaccgacccggcacttcgctgtgcatcgctgcttcaaattgccgcagaaactcgcgatgccagggcagaaatgcgggacctgtctgagtggtgacaataacacagcggacagagggccaaacgaaagaaaaacggaccccaatgggccgcgggggcactgtttgggtagtggaggctgaaaatggacggtaggcttcatcctactgtaagttgttactgtactcacagaatatgcaaatcccaaatggaaatgttgtccacgcgcttctccttcagcatgttcagtgcgttgtgcagatgcgctcgttcgctgtcgttcatcattcggtattccttccgcacaaattttttcccctgcgggcttttccgcgtcttttcgcctttggcgccgccccgctccaattggcgcttccttcgcatctgccaatgccatggattttgatcagagtgccttagctgatcagtttgacatttcatgccattcttccatcgttccccccccccgtgccatcgatttccaatcactttttgttctcttttgtctttgatcagtcttcccattttctgatcatttgattcattccaattctccattcctctctccctcttcttcac

SEQ ID NO: 28170 - DNA, 719 bp, Heterodera glycines
  misc_feature (7)..(8): n is a, c, g, or t
  misc_feature (16)..(16): n is a, c, g, or t
tgcaggnntcgtttgngaataacaaattaaaatataattttccaatttctttttctttttgagtcgtcgcaaccggcacaaatttcgtcccaattcgcttttgcttttgggcccaaattgtgcctgcgtttggcgtctcttggcgcaatgctttctattgggcttgaccgtttgtttagcgttgtcacccctttttggtcaggaattgacttattaactgttcatcaattaataaattaattgagactaattagacaattgcatttgggcaattaattaattggctaattacatttcatttcaaggtaatagtttagatggtacccccccccccttttttaaaaatttttttcaactttcaaaaaatcataaaaacatgtttctaggggttttcggggtcgctgatcacgaatccgacatccatttcgaccgattccgaacccctgacccggattcgaacaaaataaaaaaattgattttttaacaaaattcacatttattgctaaaaatcgattcaaatgcacgaaaaagaaaataatcaatgttcgcatggataaaactcagagacatgcaaccaaaaattgtaaaacgcattttcacggtctccaaaacgctgacgccaaataataaaaatactaaaaacccttggaccgttacgctttacaatttttataatatttttgaaaatatggctgcgttagaagaacttcgcaatttta

SEQ ID NO: 28171 - DNA, 1170 bp, Heterodera glycines
ccaccggatcagcaaatgccatggagtcacgctgagaggccaatggcatttggacgtccacctgaagaggaacaaaaaaaaacattgaaatcagttttatacatttaaaaattcaaggaaaaattaaatttttaagatgatttccaaaatttctttttagttttatggtgtttttaaataaatttatgttttataagaggattaattttctttgccagggcctgtatccagcaacaaaatttcgggagtgcctttggccattttgggactaaattttgtaacaaaaaaaaaggtgtaggtacggttaggcgccgccgggaagagttagggtctagtctaatctgttaagaatttttaattttcatttcggggaggggaggggacgtgcccccactggataatacggcaattgttaagattattggtggacccacaaaaaaatgaaaaacccaaaaaaaaaaacacattttaggggttatttgttgcgctgagcacgaatatgacatccatttcgaccaatgtcgaaccaggactcgaattcgaacaaaaagtcgataattcaaattttcgatttcgcacttttattttaaaattgattaaaactaacagaaaataaagcacaggcaattttaacagcaaaaatgagtcatctatgcagattcgaacatacctagaagtaaaattcaaaaatgtaaattttcaactttgttcgaattctggtccggagttcgaaattggtcgaaatgggtatatcttattcgtgaccagcgatcttgaaaacctacggaaaggcttttatttacatgatttaaaaaaaaaattatttttaaataaaaaataattttaaaaaattattcgaatccgggtttggggttcgaaacaaaatcaaacgtagatcatattcgtgctcagcgcatcaaataacccctaaaaatgtgtttttttttggatttttattatgaccaataatcttaacaattgccctggctttgaaattccattaaataaaattcgctagattttttttttgttttttttcaaattgaaaaatctttaaaaaaataataaatgacgtgccaacgggtggaagccggtgtgcaaatgggaacgaccactttcgttggccaacagcaccaaccgacggtccaatgccatgtcaatgccccagga

SEQ ID NO: 28172 - DNA, 589 bp, Heterodera glycines
tgaacgtatacggcagtgtggctaccacaaggcacgaatccatcaatttacggtgaagaatttgattgcaacagctgatgtgggattccacgtacgacttgggccgctctctgattttctcggcgccaaatgttgctccttcacacccgaactattccccggtctcgtgtacaggaataaaaagcctaaattgtcggtcatggtgttctccagtgggaagcttaaccttacgggatctcgatcaaaggaagagatagacaatgtcttcaaacacatttatacgattatatgcaatttcaaacatgatcacaaatatttgtagaaattttcatcatttacatcaataaatttgttgctattgtcacttaagttctcacgaactgaagggatgggtttagggaaactctgcactaaataaatgggatcatcgtccctcattttcacaagttctagagggtagaatcgttcattccccgtttttgtgcttctctatcacgcaagggttagtggcgtaccgcaaacagatgcgatgacgtacataaaaatgctggtctacggtcacattcttgaacccgttgtacgccatttg

SEQ ID NO: 28173 - DNA, 932 bp, Heterodera glycines
tgccgaactcacaaagttataggagtgaaatgtgatatatttgttttcaccacaaggcattttttctgaaaaccggattcaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaagactgggagaaagcaggggctgtggctgggggc

SEQ ID NO: 28174 - DNA, 983 bp, Heterodera glycines
cccccccccccccattaaacgacataattttggcgctcttttcccccaaagtgccttccttctcctcctccttccttcacacattattacctaattaaataattttttcgtcattttttccaattaataaataatggctggtcaatccttcgctctctctgcccgaggccaccaaattcaccaaaaatattttaaatattattttaacaatttaaaatatgtattttaccaatatgttttttatattttattttgccaattgtattccgacgacaattccttctcctatttgacatggcaatataaatataacgtcatactgcgggccaggtcgttttcgcgacgtcgttttcgcgcctgcgtattcccactgtcgtattctcgaccacgattttttaattctaaaattagaatagctatactctcatatttttattaataatatcaaaccttaaaaaatctcttacattgaagaatcctgaacatcacgcttatgaccacacatgaactcacttcacgcaaaaagaaattgtaaaatgtggacgattttctgaatgataaattggtccgagtgtgtgcttctgcaaccgctccgcgactgatcgctaactaacgcgacgatttgttaattgagacaagcgctgacagagtgtcagtaacagccgcacgaattgcacgcggacgcgcataccatcacttcactttgctgttgtatgttgacattggcactgtccgacgcgcactctagacgccctttgatgatcagcggattcaaaccaatgcgagccgaagtgtccgtgcaaaatccgtcgactgtttggcacgacatttaatacaaaatgtagaaggaaatgccgaaacggtacggcacgaaaatacattttatttttcaagaagattcaaattggagtttcgaagtcttatggcacttttaaaaaatttttatcaagttcaccaaaaatgatgaatgcctctacaaaagg

SEQ ID NO: 28175 - DNA, 1566 bp, Heterodera glycines
gatgatgaagaacaagatgatgatgatgatgatgataagaaaaacccagcacgaatcgtaaaaatcaaaaaaacaatgacaacgaaaaaggtggcattgacaaaaatgcattttacacaaatgggtgacagatgtagaaaaagcattccgaaaacgtttcgatcacgaaaagaaacaatttttggatgcccttgacaacaaaattcctggccgtgattttggcaatgccaaaaaatgtgttgaagaatgggaaaacttgatatatttgatgtgaaaaatgaagcagaattgaacacaccactaacagtttataagagaatgttcttcattcattttatacaaaaatcattttgtgttttgttgatctggtaaaagtgttcacgaggatattcatttaattattttttataattagcctatccaaacctttgtcaattatattggaaatcttgagtgtcatcctaaacccaacatttttaacaagtcgataggtatgccatttcccgcaggaatgtatccaagatttttaggtgtgataatgggaggggtaccagggctgggacgcgaccgcgggaatttttggataaattgaatattaaattttaaataaatttttttgaaaacttcgattaatattctcaaaaaattcgtttcaaaattccaattttcccccgtcggagctgacaaaaacatataatttttcttttaaaaatgtttctaaattacaaaataggtcatttttttacaaaatcttttatcaaatattgcattcaaattttcaaaattttcccggcggcgcctatcgtcaccgccggacccacccccatctgttcccaaaacttttttagaaagagtgagccgaaaaacggtttgaaaaacaaagaaattataaggtttgcatgctggaacccttcgaaaatttggacactgactcgccttcccccacccccattcattcccttcccaaattttacatgcatcgggattttaatatttttttataataaggaaatgtaaaaaaatttaaaaaaatgagtgtttataaacttttgctgtttttttttttttgcgtttcaatttgacttcttccgtccgtccgcaccgcttcatcgttcgctcatcgctttctgttccttctaccgcgtcgtcccgcggcgccgcctcggccctccgcacgacgacactcctccggaatgtgatccttccgctttgcttcttctcctgccaattcaatttcaaatttcccttccatgagaatatggaccaattgcgctatttttcgacgattatttgagcttttaaatcttttttaacatttatctgaacattttctgagaaaaattttaggtgccagaaattttggcatcagtgaaaaattaaagaaaattaaagtgaaacattcaatttgccaaagcatgcgaaaacaaaacgtaaagcaagcataattaatccaaactatgttgttttttaatttattatgcatcaaattgtacaaaatttatccgtttttaaatcaaaaataggattatggaatttcccgactaatttttcatttgtttaatgaaa

SEQ ID NO: 28176 - DNA, 1476 bp, Heterodera glycines
  misc_feature (53)..(53): n is a, c, g, or t
tttacagtgtcgtagtgtattttttgtacagtctgttcgtcgagagtgaaccnccttattttcaagtcgaagcaaatttcaccattgtcttccgtgaaagtttaagcccgtagttttgcagccagcgctgatgaatcccaaaatatagtggtccggcttttcatctgtcagctctccgaggtgcccctttcctgtcgggagtgggtcattgtccacgggatgaacgtagatgatgctgtccgtgtaaaagtagagaatttcacatccgggggtgtcggccacttttttaagagcttcgtagaggtagagtcgcgccattgatgtagtgaagagggaaatgacgacatttgagtatttattttcatcgacaaactcctcctttggtttgtaggtgagcatgaatacgtcgttgtcctcatccatcatttccaagtcgattagatcaatctttttatcttctgcatactgatgaattaggctttcgtcgttgtcaattattgatttggagagaaggttccgcatggagaagcggccccagagtgaattgaggcaaagtttggcgatgtagcgcttcccaggctccgaattcatcttttctttgtcgagtttaattgcaaattttttccagcactcctcaatgtattcactcttctgctcttcgctctcgcaccatgatgggaatcctgtggcgtggatcttcagggccatcatttcacttacgtaggacttgaagacattgttactccattggtcgtattggaggacatgaaaaagtttgcgagcagtgtaaccggcttctagtgatgcatttaattcaagatgggtacaggttgatacaaaggcgcggtaaatggggttaaagtggggacaggaatagtcgttgactttgaggccattgggatattttgcggtgatgtgtttggcgcacttctcacagagagggaagagaaggcgttgatcaaattttatgggcataacagtgactttgatgttgttgtttggaggtagaagtagcactttgagaaggcctttgtaggggttgtcggatggagaacgccagttgaccgtctgctcattcactggaaaactgatgatcttagggtggccgaggggatagtctgtcgtaaagttggtaaacgggtagaggctggtgaagtccttgtagctgattttttggcctggtttcgctgtgtgcagtagcttcatttgcccagtccgtcctccatgaaaagcgtctctgatttttattggtgagcggtccttccagttgtcgaaaaactccctcattgcagtgtcattctttagttgctcatttatttcatgctcccataccacctccaagtcgacgtaacggctcagtatatcgtgtttcctcacttccctctctcttaattgtcctagcgtctttccgttcggcattttcgtttcttcgtccaagtgcctcaaaacactcctcgcacccgtgccacagacaac

SEQ ID NO: 28177 - DNA, 1030 bp, Heterodera glycines
gggtctatctttttttgtacatcagcgaataaaaaacaaatatttcagtggttttgaatttttgtgtcttaccgaaaaatagttttaggcattccactgtcctttatcggagcggtctttgtgcagtataattggtctaacttttttttgtacatcagagaataaaaacaaattccaatttcagtggttttgaatttttgtgtcttgccgaaaaatagttttaggcattccactgtcctttatcggagcggtctttgtgcagtataattggtctaactttttttgtacatcagcgaataaaaaacaaattccaatttcagtggttttgaatttttgtgtcttgccgaaaaatagttttaggcattccactgtcctttatcggagcggtctttgtgcagtatgattgggtctaactttttttgtacatcagcgaataaaaaacaaattccaatttcagtggttttgaatttttgtgtcttgccgaaaaatagttttaggcattccactgtcctttatcggagcggtctttgtgcagtataattggtctaactttttttgtacatcagcgaataaaaaacaaattccaatttcagtggttttgaatttttgtgtcttgcctgaaaaatagttttaggcattccactgtcctttatcggagcggtctttgtgcagtatgattgggtctaactttttttgtacatcagcgaataaaaaacaaacaaattccaatttcagtggttttgaatttttgtgtcttgcctaaaaatagttttaggcattccactgtcctttatcggagcggtctttgtgtgggtctaactttttttgtacatcagcgaataaaaaacaaattccaatttcattggttttgaatttttgtgtcttgccaaaaaatagttttaggcattccactgtcctttatcggagcggtctttgtgcagtatgattggtctaactttttttgtacatcaacgaaaaaaaaaccaattccaatttcagtggttttgaatttttgtgtcttgcccaaaaa

SEQ ID NO: 28178 - DNA, 880 bp, Heterodera glycines
taaagccaaaagaacacattgttacaattgttgtcccaatttccgtctttccaatgaaccgccgctgtctccccaataattttgcatcgtttcattatccaaccgatgccccattcattttccttggccaatgtcagcttttcctttgtgcattcgttcaccaattcaaatggcaccattggcattgacggcgcacgaacagaaaaatgaatttcgtaactgacggaagaaatggcattggcacgaagaaaatgctaaacaatttgagtggggtcggaattccaatttccgaaattttgggcctcattttttcgaattttatagaatatttttttcgaaggctagagttgggttcaaggggtaaaccaaaaatacgtttaatggtcttaaatggcgtataattaaaaggtataatcattttttggcgtaaaacgggccgagacctcggaggaccgggaattcccgccccggtccgtacaaccctacttttaattgttaatttctttcattattttttggtacagaactgtctatattcaatgggactcagttgtccctgtgcttaggtggctcccgttttgacatttttctttgatttttagacttaactcaccaagagctttcgaatgatactaaatttggtaatactacccgatggtaccacaacttttttgaaaaaaaaaatttttgttttcaaaagccgtgaaaacatgttccctggggtttttggggttgctgatcaccaatatgacatccatttcgactaatttcgaaccccggacccgaactcgaacaaaatttcgtaagttcaaattttgcatttttcgtctaaaaatgggtaatcacatggaaacattctgaagtggtaccatcggtagta

SEQ ID NO: 28179 - DNA, 1065 bp, Heterodera glycines
tggaaaaaaaaaatcgccaattcggggttttcagaaatcatatttaattccccaatgggggccccattttggttcctcagccacagccccatgcttctcccaattttaagtcttggatttgtcaaataaattaacgatttcgaattaataataaaaaattctattttaattttttttttgtagagggaaaaattctgaaccaaactactattttaaaacccaatcaaaactgggaaaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccttgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggattaagaccgggataaaccatggtaatataaagttcgagctttacaagaagatatggaaagaaaaaatcgactatttcagggactttttcagaaatctgggaaaccaatttggccccaaaaaattattcgaatttctcccaattttaagtccataatttccaaatactattcggtatcataatgccaaaccaaaaccgaaattccgtttaagatattcttttcctggacttgacttgggtttctcaatatcgaagcttttttttccccgcaatttcctaaaaacgcttataccaaacccctagattttttggttccaatgggtttcagaaaaaa

SEQ ID NO: 28180 - DNA, 1108 bp, Heterodera glycines
tccccactaattcaatcagttcatcgactcggatcgaagatggttcgcggcttgcgctgtctgctcgatcgtctgagctcctcttgatcattcgtcggcacattttgtggttcgtcttgcgcatcaatatccggctgattctcacagtctgtttccatctcagcttgttctgccattgacgaatttgaatcggtttcggcactttcgctgtccgtttccgtttcgttggatttaagctgatctaagtgccttttccaaattcctcttttggttctgacgagaaaaagtgatggtgaaatttggcgcacgatttcgccttccatccacttagttccgtcgcggaaattcctagcgaagattttctggccaatgtcgaatgacctttcccaagtgcctcgatcaaaattctttttgactcggtttcagtaattgtccacaactttttgcttttcctccttttcttcccttttctttgggttgaaaaccggttggaccaaatcgagttttgtccttagttctctgttgaacatcattttggccggtgattgtcctgttgccgaatgcggtgtgatccgatatttcagcagaaattggtttttcgcgagttcgttttcccaaaaggggaggaagtaggtgcgtaatcgaatttcggcactgaaaagtcgagccaagttcccatcaaaagatggtgtggtagatttatgaattcgtttgtgactgagtgctcagttcagagctaaaaacttgaagttccttcaaattttccggcgccggcattttttgaatcgcttccaccttctctggcgaagtccgaattccttgccggtcgataatgtgtcccaaataaacaatgctttcttgcatgaacgagcatttttccttttttactcgtagtcctgccttttgaagtctttggagaacggcatccaatctcttcaaatgttcagcatcgtttgcagcagtgacgacaatgtcgtccaaatacactgccactccgtcaattccacagagaatttcttccatcacctgctggaatatcgctggtgccgatgccaccccgtagggcatgcgtgaaaatcggtacagccctttatgggtgcagattgtg

SEQ ID NO: 28181 - DNA, 1379 bp, Heterodera glycines
  misc_feature (36)..(36): n is a, c, g, or t
  misc_feature (144)..(144): n is a, c, g, or t
  misc_feature (297)..(297): n is a, c, g, or t
cagaaaatgtgtcttccatatattccctatgaccancggctccattttttaaatagctactctgaaaaacgagaaaaatttttgacctcctaactactacaaatttttacatggttttacacatttggacccaaattctctgtntaaaagaactaacataaatactcgaaataagtcatttttccggttaaatgttaaattacaatctaaaaaatcgtccaaatcttttgttaacagatcagtcaaggcctggaatgcccttgataaaacgttaatgtctagctccttaaacacctntaaaaaattattagaattgactcttgattctcaaagcaccaatgtataaagcaattattaacttttgaggcatttttttgactttgacttccattttattttttcattattgtttgttttaacctgtgatctcactcgatatttattcacttactctgagactattttattgtgatcagtcatcagagtaagtggtctccgcccttctgatggcaatttttctttatcgataaataaataaattaaaaattccggtctctagtatttagtgattaattcaatgacagacgaccgtatctagacatgatcaaattttgagtaaaacatatagtctcaaattgtacagatgaatgaacacagtgagaacccagaggctatttttgtgtgtccgcggagtttcaaaagcaaatttgggtagagcatattttagtccttactaaattgggtagtactgccgacggtaggaacatggtttaaatgattttttattgaagcactaatgactcatggaccaaaaagtaaagatttttgttcgaatttgggttcggaatgggtgcggattcgtgaccaacgatcccgaaaacccttggaaaatgtttttgaattttgaaagcaaattttttttcgaaaaagagggcataaactttactattacccatattttctgtgacttctaagttaaattttgtcaaaagaggttctaccatcagcaattttcttttttcgaaataagcaagtttttggaaatagtttgtccttttgcatgaatttgatttttttaggcgccccttaattttttggtttcttcctatatgggcgtaatcttaaaaaaccacaagagaaatcgaccctgctttgttcgcgcccttcccttgtaaggaaaatcaatgtgaatgtaaaataaatcaaaatttaacgggataactccaaaaacaacaacaattgatgatcgaacgacgatcacccagcttctcagctccgtcctgggtccgttcattcttcgggtatttctatctacggagaccagcccgtctttcgttcataccgttcttcactttcttgcggtctcttggcggttcacg

SEQ ID NO: 28182 - DNA, 1253 bp, Heterodera glycines
aggaaaaaatatatgtatttacatagaattagcagccgtaatgatgaattaaaaaatgtcaatcagaccttttttggcatttttaattcaatttttgcgcactttaaaacagttttaaatcgtttatgtttaaattcccggacaaatcgtatttctggagctaattgtatctggacaaatcgtcagaagcctaaaatttattttcttatgcattgtcgtgagaatcagtttattttcttcctgcatttcttaaaggtggtataaaacggcggaacaaatcaaaataataacaatgaaaaaaacaaaaaaaaaatgatgaaaagccaattaaaaaaataaatacaaaaatgaggacaaaacattttgagtttgaaaaatgaaaatgccgcataaataggaaggaaacgtgccaaaaatcgaagtttggcaaataaatttttaaaattttcgaggcatttttccgtcttttttaacaacaaattattatggtaaagctcggcataaaatttggtacataaaaagtggtgggtaattataataattacacattaattgtacggaaagatcagttgaacaatttgaaagaaagttttctgtgacaaatttgaatgataaaaaaacaaaaaaaatgatttaaaagtaatttttttagacagaaatttctgagaaaaatgcataaaaatttctcaattaatctcctcatctttacaaattctgctgctgaagattgaagctgcccgttgtgttgtgtttgttctgattgatttttgaaaaatgaaaataaattaagaaatgcgttaaatgaaagattttagttgagaagggaggcgacaaaacgaataacaatcaatagaattagagaaaaataaaatcaataattaaaagaaaaatcaataaatttcagtgataggacggcagtgaaattaatggacatcattatgatacataattatataaataacaataggtaattagcaattgatgggcatcttaattaagggtgattaattagacaattagtgcttttgggtatcattttgacggagaattgaacaaattaataatattaatatgcaatattatcagaaaatatgccacgagcgcaatttgctgaggtgtgtttgtgtgggtgagtgatgagtttagtggttaagcggctggcactgaaattgtgacacccgccgtcggcgacgattggcgcttccgtcgacgccggggcgctccgaaagtgttgcgcgaggtaagctgattgt

SEQ ID NO: 28183 - DNA, 1044 bp, Heterodera glycines
cggcatttttttcattaactgcaggtcggcccaatacttttgatgaagtgatttttgtattgatgctgttggattacaattggttgttgtttcatttctgaagtgttgaacctgtcggtcggccactcaactttttgctcactttcgagaaaatcactacatcaactttgagcggtgacttttgtaggtgaaaggaaaaggagagacaaaaagggaaattcgtatggctcccggtaaattggacaccgaaaattggacaccaatggaaaaatggacaccagaaaattggacactgttgtaaataaaaatgaaaataaacaaaataaattactaaacaaaaattttggtttggcctaaaagatctttatcttaatctgccatatgttgtttataagcgtaaataatatggaaatgaatttgttattatttttgtaacttcaggagaagaaaaacatcatatcattcataaagaaataagttttattactcatttttggttcattttttggcccattgatcaatcatccctcatttaacccatttattctactcaaatttattttcacctaattcttgattttttttttaaaaaggaaatcttagtgtccaattttccggtgtccaattttcctttagtgtccaaaattccggcggtgtccatttttccgcttggtgtccaattttctggtgtccaattttcttgtgtccaattttccggtgtccaatttaccggtcccccacacacacacaattaaataattttaaaataaatattaaacataaaaaaatcgttaactatggagattttaataagaattaagtaaaatacacaaaaagataaaataattaataaaacttttataaagtctacatgaaattaaaactaacaaaatataatcaaaaaaatatttaaaaatttaattgtaaaggaattttttattaatttggaaattaaatttactttattaattatcaaagcgctctgtagactactacaaaataatcagagtccgtcacaagataaaaaatataaaggaatttaaa

SEQ ID NO: 28184 - DNA, 955 bp, Heterodera glycines
tgttcgacccgtcttgaaacacggaccaaggagtttagcgtatgcgcaagtcattggggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggtccacgtgaacagcagttgaatgtgggtcagccgatcct

SEQ ID NO: 28185 - DNA, 1410 bp, Heterodera glycines
gctttgcatggcctggcaggtcctcaacaagctttctatcggcttcccaaaaacacatatgtcattaagataaattaaaatatggtaaaattctgactttttgatagtattcatgttgcaactttttttaagttgttcaatcgcttataaatagcttatcaaaagcttctaaacagactaacccgacccacacccaagactgaaggttcagccacaaggatacagtaaataaattcaaataaaaccgtttttacggtatttgaacccccgggggttctatttttcaaccccctcaaaagggaaaaaataaaataaataataaaattaaaaataactaggttagtttaactattcattgggaccaatggaaaagaaaagtgaccaaaatggtcgagcaaattgggcagctagcgaaatggttttcaattatttcagcaccgaagtgcatgcagttaattgttatttactcttcttcaaatattttttccgtgccgacatgacaaagtgatgttttgaatttggtgaggttttcgaactttaaaatgaattgaaaaggtttcactgttttgatggagcggctctttctcagctttggtcttacgtaaaactgacaaatgagcaagaaaaaaacattcaaacaatccgttaattaaattattattattatatttttaaataaaataattaattagatttattgcatttttgtaacggttaatgcatcttttgtttgcctttttttggcgattttcttttttgcttgtataatccgatacgtttggacgattaatctatgatatatgtctacaaagtaagtggctttgtcctttttgtggacttttctttatagaataataaatacataaaagaataaaagtgcgacaaatgcacactgctgtaatcaattaagaacaacaattgggcagggaaatttactaattattactcctcgtgtctttgctgcacatcattcgggtcaaacgcggccaaatgccgcgagggttccgctggctcttcggcttctgctgcgctcgtggccaactctttgtcgaagtctgaacattgctggtaattcggtttcgactcaatattggtctcgagtcttgggtaaaatattctcaattgctttgtttactttaactttgatcaaatatcccattttattcattttgatgatcaattttccggtgctatgacgaagcgaaaaaagtatgggtgcaggcggggtgaccggaagaggcgggtcatttcactacgaaaaagttattcgaataattaatgatttaaactgataattgaataattatccaataataataaatatatttggatcaatttacacgaccacaaaaaaagacacgaatcgtgtcttcaagatgttttatacaaaagttaatggcggcattaaat

SEQ ID NO: 28186 - DNA, 2054 bp, Heterodera glycines
cccccaatttccaacagaccgtaaactcccacaacctttttcgcttggccctttcgaccaccattcggtcgaactgttcagtttcggtccctttttctccatggtgtttcagtttcctcccaatttcccacttttcccttcccttgccttaattacttggccattcattgccttttgaagtgacattaaaccaattcccccatggcattactttttccatttcttccctttttttctttcctttggcatttttcggttgcccaattttattaagttaataagtgtccgtccatcttctcatcagtccataattctttctgttcgccgctttttccaaaagtgtcccccgccatttgataattggaaaagcattttcgactttccccgtccattttaatcgctgaaacttttcataaacaaacagaagcattaaaaagcgtcaaaaagagcgaaattatttaaaagagcggaagcagctcaaagggaaaggtcagcaaataattaggcaaattaaaaggatagggtttgttttaattaaacccaataaacttgatacttcgcgcgccaaatgaacaactgataaaaaagttaagaagcctaatctgtggatattagcggaatgacaataaataatattgttgatctaaaagatttaattcgacaggctaatagagaataattaggactattggacaatactcaagaatattaaatttggttgattatgaaaaaatttttatggggcaaaaagcaattttggcccgttaaagccccctaccgttaggctttgttttttgaaatttcgaaacatttaaactttaatttgattggttcgcctttcattccgttttgacttagtttctttcacctgcactgcctcccatctccgccggatgcttttcctttaatttggccaattagtgctgcccttggccctttctcatcagctgccccgctttacccccccccccccccttccattgcttatttttgttttgaacttctttctttcccagtccaatcaattttttctgacttcctttaatgaatttcgtttgtgttctttccttagtgtttgttcattctttctttcatgatcactaattattaataattagccatacataattaataattagttaattaaggatggacgccaacgccacaaatgcgacgggtgcaatgtgtctaacggaggtgcaaatgaaaatgcatggtcggtcagtgcgtgtaaaaacagccaaatttttctgaattctgttccccctttggcacttttttcctcccgtttcgttttcatgcctttcttttttggcctctttttcgttttccgttcatttgccaaaaccaaaaggttcccatgtccaagtggaacctgcagcggtaatctggtcctgggcctggtcctctttcggattttttgggcaattccctcaatttgaaaggggcccccctaacccccaaaaatgaactcgccggggccaaaatttttccgggccaaggttgcgatttttccccaaatttgctttcccttttcctgggggagttttttcccccccaattcgccttaggaacacttcccccttttttccccttccccgtgaagaccccaaattttttttgccaaaatattttccccggttctcttttccccccccccccctttctcccccccttttttttttttttaatagcgcaaaaaagccctttttttggcggacccccccccccaacttttgtggaccctccccctttgggggccccttttttattgggggcccccccccccccccccccacatattttttttaaataaaaagaagaaacttttttatatggggggggggggaaacacccccccgcggggggtttaaaaaaaattttaaactaaaaaaaaaaaaaaaaaaaaccacaccaccccccccttttttttttttctcgccggggggcgccccccccccccccctcccccagaaaaaaaaaaaaaaaaacaccccaacaaaaaaaagaatttttttttttttttttttttttttgggggggagggggggggg

SEQ ID NO: 28187 - DNA, 1307 bp, Heterodera glycines
gtcccagtgattggaatgcaagagaattgaccagtgattgaaatgcaggagaatgagtcccggtgattggaatgcataaaaactgagtccgggtgattgaaacgcaggagaatagagtcccagtgattgaagtcctggagaattgagtcccggtgattgaaatgctggtgtcttgagtcccagtgattgaaatgcaagagaattgagtcccagtgattgaaatgcaggagaatgagtcccggtgattggaatgcataaaaactgagtccgggtgatttaaacgcaggagaatagagtcccagtgattgaagtcctggagaattgagtcccggtgattgaaatgctggtgtgttgagtcccagtgactggaatgctggagggttgagtcccagtgattgaaatgcaagagaattgagtcccagtgattgaaatgctggagggttgagtcccagtgattgaaatgcaggagaatgagtcccggtgattggaatgcaagagaattgagtcccagtgattgaaatgctggagggttgagtcccagtgattgaaatgcaggagaattgagtcccagtgattggaatgccgaaggaccaggtgaggttaggtcccagtgattggaatgcaagagaattgagtcccagtgattgaaatgcaagagaattgagtcccagtgattgaaatgctggagggttgagtcccagtgattgaaatgcaagagaattgagtcccagtgattgaaatgctggagggttgagtcccagtgattgaaatgcaggagaatgagtcccggtgattggaatgcataaaaactgagtccgggtgattgaaacgcaggagaatagagtcccagtggttggaatgcgtggttaattgagtcccagttattggaatggcgcagaattgagtcccggtgattggaatatcgcagaattgagtcccagtgattggaatggcgaaagaccaagtgaggttaagtcccagtgattggaatggaagagaattgagtcccagtggttgaaatggaagagaattgagtcccagtgattgaaatggtggagagttgagtcccagtgatgtcccagtgattgaaatgctggagggttgagtcccagtgatgtcccagtgattgaaatggtggagggttgagtcccagttattggaatggcgcagaattgagttccggtgattggaatttcgcagaattgagtctcgatgattgcgatggcgaaagaccaggtgagggtaagtcccagtgattggaatggaagagaattgaccagtgattgaaatgcaagagaatgagtccc

SEQ ID NO: 28188 - DNA, 2285 bp, Heterodera glycines
  misc_feature (522)..(522): n is a, c, g, or t
aattttagcgttcataatgggaggtataaaggcgattgtagaaggaattggaagcgctaaaatttttgaggagctttttgagcgtaattacgatttttacttacaccattttttgctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgttcataatgggatgtataaagtcgattgtagaaggaattggatgcgctaaaattggttgagaagcttttagaccgtagttgaagttaatctttactccagtaatttttactcgtagatcacatgtgatattcgtctctcggcataatcgaatgcagaataatgtgatgcattaaggcatttttcgcagaagcattttccactgaccngattttccggttacgggcagttgtaccgtcgaaaaatcttttttgaagcagctgctgacggaaaaaatcgaaatgggtcgaaatgcgtattatattcgttatcactgatcagcgacttcgaaaacctctaaaaaacttctttttgatgagtttaaaaatttttgaatttttttacaaaaaatggggggcgaattttaacaacaatacttgtaaacaaataaccctccaaaccagagatggcacggacttccgatttgcgaaaaaatagtcagtccctttcccaaaaatgttctaaaataatgttgtaaaatgacataaaaaagatttgatgaaatcatttaataatttttcaagcaaataggtattcaaatatgtaaaccaaaacatttttgaatcaccttttacttggttaagaattttaaaattttgcccattaaaatatttttaaaaaatctttggttttgtatgttgacacagacaaaagtcggtacgattcaacaggtcacccaatccgatttttaagcatacgggtagaacagatatgcaattgacatatgaaatatacaattgaatgcaagtttatgacgaattgtttaactgatttatcttatatgtaagtatatcatgcatccatcacatcgtcgtttcatcgcattgattatgtttatttggcatcgttctacttgtctctgcttaaagtcatttcgatggcactttccgttcttcctctgggtgctgatgaaaagatcatattgggcacattttcgtgtccgtcatcatttcagcacgaattttgtgaaagaataaatctcgaagacggacaaacacaaacaagacaatgctgggcacttttaaaagtggttaaattttggaaaatgtaggaatcaatggtaaatgtgacaacaacacaaactcaccaaagtgacgaacggcacatctgtgtgatccgcttggaagttgaagcaagtccaaaagtccgtccaattgagcaccaatgtggatgaatgctcagcacatgtataccagcagaagacagaacataaggcaccgacatagaaggtgaacttaaaaaacaatacaaattaagcgacgcaatggtcaatgatttttgatacttaacgaacacatgaactaaactcattccccacgacacaaccgcattacatatcatttcatcggataaaacatcttttatggcccagactaaaatttttcgtgttttccgtccaaatccgatttttttttttgttcaattatgagtcctccgatttctatgattgtcccttaattcgagtgccatttctcagaaaaccgcctccccctcctctgcaccctacaacaaagtgtcgggactcaaattgcccaagccgacacggctgatgtacacgcgcacgtcgtagaccatttcagtgctcctctccggtggcattggctattacatgttccaaatattgcggggccgacgagcgcttacatagggaatgggtgagccatacaaaaaaacggggcctttttattcgacaaatgactctctccgaaggaagggagtcacgaattggggaataaatagatagaaaattctccaaaaaatcttgcacgcattttaccggcgtggcgaaaaacgacctgcatccgtatgaactgaaaatttgcatatgttttccatataaaatatagaacaaaggtcttttttaaccacgattatttgcgattctttttgtaaatttacaaatttaccgagagcttctttcccatgttttttt

SEQ ID NO: 28189 - DNA, 1761 bp, Heterodera glycines
aagtttagacttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgctccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaacttttgcagggatactgaaaggaaaagaattaacctgttttatcacattagcttgtcatcagtttttataaaaaattttcaaaattctgagtctcctattattttttttttttcaaaattttgaagggcgggggggggggggggtcgaagggccccccacgagggccggaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcataagcgtaccaaactttgcagggatactccccggtaaaggactaacttacactgaaatgagcgccgagctagctggctttaaaaattttcgaaaatctgactttttcgtttttatttattttttgcaaaattaattcttaagtattttttcagaaagtgctctgaaacgcaccaaattttaattaaaagttaaataaggctctctgatgctttttctatcaaaagggagatgaataaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagtgaaataaggctctctgatgctttcactatcaaaaagg

SEQ ID NO: 28190 - DNA, 507 bp, Heterodera glycines
ttgcttacaaatatccctttatataggcaaaagggagaatgtcgcctgcatcccctctcccgtccatttttgactcttgcgacactttttttactacataactgacaaatatcctttttcggatgattatgttcctcggtcaattggttgtgcgttggatttgacctcttgggttcgaatccccctcccattggtgaattatttaatcgattttaaattatatatatatatatatatatatatatatatatatatatatatatatatatatatatataattgctaattatcctttttcggataactgtatcgctgacccagtggtagtgctttggattaagacctcttgggttcgagtccctctgcctctggatgaattaatttaattaatcctctcatggatttggaccccggcacctgggacaaaatcatgaaaagcaaaaatgggtgtttttttaagcaggggcaggggtctggaccccgctccctgggatcttatactactag

SEQ ID NO: 28191 - DNA, 1641 bp, Heterodera glycines
tctagagtcatgtgtcaaaaataaaagtgaaacaataaattgcacgttaatgtgttgccaatttgttgattttttgctgcattaaataaatgcaaactaagtgactcacgattttaaatttaggaaggtagactttaaaatgcaattggataaaaatgaaaataatgcataaataagtcgcggacatacaatgcatccttgacgcaaaaaaagattacgctgttttccggaactcaacgcggtagttacaacaaaatgaatattttactaacaaaccaaaaccccaagaaatcaaatagcattgaatttatatattgaaaattgttaagaactcatcatcaccttttttacggaagtaacttttaagttgcacaagatttatcagcttgttgccgaaaaagagtctttattatagaaaaataatttttatatttaaaatttatagatttgttattattatatttccgtcaagaatttaaatatcaattaaattaattttaatcatgggtccgacaataaaaaaatccattaaagactcacgccgtattattgatttttcacgtaatcgatttgaacctttttggtctctttttcgagacgatttcttgtaagattattttttataaaatgaatttttttctatttttatttaaagaaaatatatacatttgtttaaattcttatttctttagcaatttaaaaatgtccatctgcattggagacacaacaaaaagccgaagttgaagtgaatgaatatttacgggaccaaaaaatcaaatccagggccgatccatcattatactgggaagttaattcacaaaaatggccaatgattggtgccgttgtacggaaatttctttccccgcctgcaacaagttcagaaagtgagaggcttttctcaacggccggcctgatttcagatgacttgagaaagagtttacaggcggaaaatctggcaaagcttttgtttcttcaccataacttgcttctaaccggattttcaattgaatgattttgcttttataaatttgctttttaatatgctttaaaatgctttaaaagatttataggattttttaaaataaaatttaaaattattttaaaaaaattttttttaattgcggattgcggattacggaaattacggaaattgcggggtttttggacccccgtaattgcggattgcggatttccgcaactgagaaaatcgccgcaattgcggattgcggatttccgtaattgtaaatccacttgcgtccagccctggtgccatacctggtgcctatcgatatctgcgagaaattttataaaatttaatgcgatttgttagcagattttgtctaaaattgaccaaatgacgcagtttttgactcaatttctacaggattattaagtaaaagcctatccggcggtgtccggcggtgccgataggcgctgccgggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggatcccgctgcgggattggaactcaaaattctttgc

SEQ ID NO: 28192 - DNA, 1185 bp, Heterodera glycines
tgaaatgccaaaaggatgcgccaaagggcctttcgtaaaaagaaatgccattttgaatatttagtcgacaaaaaatttcaaaaaccaaatttttaaaaagtggaaaaatatttcttttttcttttgaaaattttttgaacgtaaaaataaatcgaaaaaaatcaaagggttttaggaaaggacaaattgccagcacgaaaagaaaaagaaatgacaattccttccctcagctaaaggtcactccgatttaatgccaaaaaagcactaaaattccttttttatttctcggagtgttaaaaaacggtgaataaggaaatgttaaggaattaacgaaggggggaaaagaaaaaaggaaatgggcaaaaaagggggggagagggggcattttacaacggaaagggatgccatggcattttcggagagaaattgcaacaattgttcaaagataattatatacaaagtaaatcaattgattctctgtcaaaattcaaagatgacaatgaaacaggcaaaattcgtcggtgtcccttcgcttttggcatttcgtcgctctttcgttggcatcgaaagaaaagcagtgaatttattaatataaattaattaaattgaagaaaatgtctgaaaatgattgtttttgttttttgcaattagactttattcggaagcaggtgcattctgtggagtgttttggcatattccgaaatgactccgtccaaatgggcgggggggggggcatttgagaagcattcatttcccttccgtttccatttttatcaccttcatacaaaggctcattggaattgccttcctttattaaatgcttttggctaataaatggacaaatttatcgaatgcccaaaacaacggcgactgtcaaaaggaaaatcgccgatgatttcgagattcgtcacactctcgcctcctctccttgctttttatccccaccactcccgctccctcgtttatttctttcctctctttcgtccctctttcccctgctccctccctctccccctccctctctcctttcccttcttccctccctctccttcttcttctcccccccccgccctccttctgacccttcctcttctttctctctctctcccctctctttctcgctttccgtttccttatgcccctcacacttcgatctcttggtctggctcgcccctccctctttca

SEQ ID NO: 28193 - DNA, 1105 bp, Heterodera glycines
ctgtgccgtgttgttgttggtgccaccaccgctggtcactgccagcagttcctcctccttcaacttgtacagcagcggctgttggtggtggagggacagtcgaccaccacaaaattggtgctgcagctgatgttgtcctcctccaatttgttgtagttggtcatggttactgttgctgccaatgccgtgccgagcgcgcaacagtcggccaacgccggcagatgacgcggtgccgttgaaggagccgaaagtgttgttgttgccgttggtggtgatgccattgacgttggtcggcaaatgccgcagttggggcaacaaaatggcattctgtgtgaaataacgggaatagagaaaaatgccaaatgtttgaggtcggcgatgcgacagagacaaaaattgttttatgatttcttttttggaaaattggccgtccctcgtttcgatacaataatttaaatcagtaattagagttcggctttaaggcaattaatgatgaagttgaaattgcagcgaaaaaatgaaaacattaaaaaaaggatttattcattcaattccaagaaagccgagactctcgaccattgtgttttctttcgagtttttgttaaaaatttcgaagtgggacaaaccgaacggaggtgcactccaaaatttcccaaattatccacagctcatggctccgtgccaatctcgtacaattacataatcgtgacttaattattaccgagtgctgttgtcctcctccccccgccgctgccgtgccaccgaaagcgacggtcgcagcggcagccgagccgacgctgatttcgctgcccgccgaactgctcggcgacgacccgttggcggtgcattcgccgcctccgccgttgtgctgccttttcgtcaccggcttcgccgtcatggcagcaccacgtttgccaagtgataatctaaaatgaagggaaagcatggacatgagtatgtgtggccatggaatgagcagtgccgtggggaaaggtcgtttcggcgccagcccaagttttggattaaacttttcgaattttcaaccaaagtaaatagttttggttgctccattagctttacaaaacggtggggggattttcttcta

SEQ ID NO: 28194 - DNA, 1222 bp, Heterodera glycines
tgcgaaaaatggggtttgacaagtttattgggggaaaacatgactttacaaaataatacccctgggagaagggagtgggaaacatgatttcaaaattttcaatgttttctagtctaatctactcaaaacggttcagaattcaataaaaataacattcacggtgcgaaaaatggggtttgacaattattggggaaaaaaagactttacaaaataataccccttggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaaaaatacccctgggaaaagggagggggaaacatgattttcaaaattttcaattttttctagtctaatctactcaaaacggttcaaaattcaataaaaaaaaaattcacggtgcgaaaaatggggggtttaaaaagttttttggggaaaaaaaaacttttaaaaaaaaaatacccctggggaaaaggggggggaaaaatgatttcaaaattttcaatttttttttaatttaacctactcaaaacgggttaaaaattcaaaaaaaaaaaactttcccggggggaaaaaaaggggggtttgaaaaattttttttgggaaaaaaaaaaattttaacaaaaaaaaacccccgggggaaaaaaggggggggggaaaaa

SEQ ID NO: 28195 - DNA, 1619 bp, Heterodera glycines
  misc_feature (732)..(732): n is a, c, g, or t
  misc_feature (1598)..(1598): n is a, c, g, or t
ccgatgatctaaaaacaggacatgtacaaacacaacagatattcctccgcccatctccacccattgttggcaattgtgctcgactgcagcacttcatgatagagcaaacacagcaaattccaccgattgattttgggggtttcgtctttcattgaaggcatggcactgcctcctccatcggccaccagttgaaagtgctgctgggcagccttagtgccgagaaaccgggaaatccgtattgccgccgttgcctaagtgtggtattcagaacaattatttacccccccccccccccccttaaaaaaataatttaaaagtttcggcgattttttgaaaaattttttgagataataattcctcattcatttttgaaaaaattgctagaaagaatttccaaattttttaaataaaatttctaataaaattttgatgttttgaaacctttttgaaattaaaaatatattggcaacccaccagatagaaagagacttttcgctttctattgccagccataaagtaaagacgtgcagcatgttcgagtagtatagcgtcaaacaaatcggaattcaactgaagagatgccccaacactaatcatttgctgagccgcctcctcaaagagttcgagccgacataaaatctgcgaaaagaatggaattaattattgtaaaaagaggtcacgaaacttgagaactgttcatcaatgctcggagagcgagaaaaggaaccctanaaataaacattaacaattgtggttattcctattctgtgcatataatttttcttatctgtccctataaaacttccaaaaaatatcttggtggagcgtatctgcaccgccggatcccaatgaaccaaattttttaaaaatttgacctcaaaataggaattttatttcaatttaacgaataatcgctataaatcctgcgctttcgcctttctgcttaaaatttaaatttattttttttcgttgcgaagaacaacaaaaaaaaggctctttgggtgccttccccgaatttttttttctggatacgaactgttcataatcccagtttttaagcaacaaaagggccacaagtattaaaatcagttccctaatgcagcaaattaacatttgaaagtttatccgtcaaaattggaattcactttttaatttgtacctgcagacatttgcgtagtaatgaattgcgttgtctgcgtaccgttgcgggtactgcttcctcagccagacaattgattttgaggtggaactgtcaggctgatccgaaaacagtttccaatcgctcataaagctggacaacgcggccatttccaaagcaccggcatggtgcagctgcaacccgaaaggagaagcactggtcgaacatttcgataacatacccaagcctggtcgttagcgaattccttcttcagcgattgatacgtttggtaagcaaaaccgtacaagccgaacagaaaggcgaggtcggccatccttcgcatttgcaactcaatgctatcggaagcatagcttaatcaggaaaatgaaccaaaccaaaacccaatcgtggatttatttaaattttggtttattgttagccgacaaatggggaatttttncaaaatcattgtaattattga

SEQ ID NO: 28196 - DNA, 1018 bp, Heterodera glycines
gaattgagtgaagaatggccggatttgtgtcccgggtcgtggcaccaaaaagtttgtcggaaaaagggaggggacaaactggggggttgggaacggagggggggagattcgagactcgctcacacgagcggcgatgcagattggcgatggagaaggcgagaggaagggtgtgccgattggacgtttttggggagcttcctcgccgtctgtacccccatttcccgtgcttcccgacccttacccaaaaaaggcgaccctttttaaccacaatttattcgaagcaacaaagggaggacgccgttgggattaaagattggcgcagagtaaaaccaaggtcaaaaaatgattatatcgaagtgtgtgaatatatgagagtataggaacttaagtagccaaaaaaaggggagggacgacggccgacatacgataaaaaagggggaatgtcattatgcaaaaaggcaaagggagatgagatgggccaaaagcaaaacaaagggagaaaggggagagaggcacgatttgaaaaatagaaaattggcgggccattgacacaaaaagggggagaaggaaaggaagaaaatgtgttgacagcaatttgtgagaaaagtggagcagaaaaatggaggacaaagagaggggtaatcggtgagcatttgttagcaaaagtgaacttccaacacaaaatgggaaaattggatgaccaatggcttacatagagaaaaggaaaagcgaaggaggaaaagagggggaggggataaaaaatagatccttttttcttccgtccctcgtcgctttcgcgacaattgacaacataaaatttgtcgaaaatgttttcatgtgaaagttggatttttgacttgtgtcattcgtctcgaacaactattccagctacatacatattgatggaatttatttttgtgaatgaataacagtaaaagtggaaatccttcaaaaaatttttttggacgtatcacttgatgaaaaatcatagattaaaaggatttatttgataatctga

SEQ ID NO: 28197 - DNA, 1495 bp, Heterodera glycines
ggtctcggaaaagtgaaggccctacaaaaaattagaaaccaatttaaagttgatgaaaaaaacgcaccaaacaaaagaaacacaagaaaaagggtgctaacggcggagtgaacgcggacactccctaaaattgggaagcattgaaagaaaacagggttttaaaataaggtaagttttttggtctgaccgtcgggcatttcgtatttgaagagggggccgaaattggcctcgacaatgtccccggggttacgcaacgacacggccgggaacaagtcgaaagagtggacgagcatattggtggtgtctgaagaagcctaattgttttcaaaatccctttttggcattttctcgattaaaatggcgcaatttgtgccgccttttctccgcctcccccacccactcagtctctcgccgttcttcgtgtaaatgatttggtgccgtgccaagtcaatgccgcatccgatcacatcgccggcccggaaattggcattgcccccgtagccgccgatgttatggccaaaaatgaagccgtcgtcaaagaaggcgtaggtgtcgttgagtttgccaatgcccgtgcggtttaacggcatcgatttgggcgcgaggccaatgccaatgtcactaattgagtttgaaaagagtggattgaggggatggtcaccgtgaaaagcctttcaaaaccaaaaatattcttagaaatgttcaggtaaataaatgtctgttctttggcgaaatccccggcttttcccaaggattccatgcaaattattaatggtaaaaataattattatacaataacttcatgagaattaaattttataattaatacataatttcatttaaatattattttgtttccttttcctttttaccgggtgttatttcgctgcagcataacaattttcacttcaaaataaatgattccgagtttttcggactgagcaaatttggcacggacagagcgataaactgaaaaaatcaaaaaataaataaaataattaaaaataatattcatgtaatttacattcgtcctttccacggcaaacaatcttcaccaatttgggcatcaaaaggaaaagttcgtggtgacaatcttcggggttccaatggttcttagaattggaaaagtccccaattttaaaaatgaaaattaaataaaaaattaaaaaacgaataaaacacattttcgcattttgaggagttttccttcagctgctcaatttggttctccatttgcttaatctttcttctcaattcattcatttcgccttgcgtttcaaaattgtccgtccattcttaaaaattacaaaatgaaattttattaattaaaattattgcgttaagcatttaaaaattcaaatttacatacctccagtcccatttccgctttcttcactaattgcagtggtcaattccgattgaagggacaattgttcagcaaaagataaattaataaataattagcaatatattgcaattactattattcccggta

SEQ ID NO: 28198 - DNA, 888 bp, Heterodera glycines
taaacatcatttatggtttgactttgattcaaaattccacgccatgtttgctagggaaagaacgaacagaaaaggctcggaaaaatgatgtagccatcagccaagaacaaaaagtcgcagatgataatgttgccaaaattccgaaaagtcagcaaaagtcgtcgcaacaaaagaatcgatcgaagtggcaagcaaaaaacgggaaaaattcggcacagaaaggaggaaaattggagaaaaaatatgtgtatgaggaacgtaaatttggggaaaaagggagtgaaaagagtaggaaagatgtagaatgcaaaacagaaaagtcgattttagaggttcaaaaaaatggaaaagtctgccgaaatgttagaggacggagttctcaattggggacaattgaatttttggagggcgggaaggaattggacccgaaaaagtcgaccactggtaaaaagaatggcaaaacgaacccgatcttcagaaattttggtggatcgtacaaggaattaggaaaagctgggcatcgaatttcggcaaattttcgacaaattggcaatgtaaacgaaaatcgagagaaaggaggcggatggaagagaaaaccatctattatgcgactccatcggagccaatccctaaatttgttggatcgtcgacggcggacggcaatgtgtcagctgagaacccttcctttcgggccgaatcgaggaaattttgacggcagagacgccttttttgttgggggcgggatgtgataatgacgaatatttattttagttttaaatttattgggcgttttgttcttattattgtttgtgaattgttttagttcttcttttttcagactttatgtttttgattcatgagaaatttttatgtttattatcgtctctc

SEQ ID NO: 28199 - DNA, 1779 bp, Heterodera glycines
  misc_feature (22)..(23): n is a, c, g, or t
  misc_feature (47)..(47): n is a, c, g, or t
  misc_feature (59)..(59): n is a, c, g, or t
  misc_feature (965)..(965): n is a, c, g, or t
  misc_feature (1768)..(1768): n is a, c, g, or t
atgttcaatgaaaatgccaatnngatcaaattccaagtaaatagttncagcaacatctntaatgccatattcttccaatcttttactgtcctcaagaatatgcccatttccttttttgtagtaagccagagattgttcttcgggcgaagaaatgtcggtctgctttttgggggttttttgctgtttgtggtcggtctgctttttgggatcggtctgatttttgagaatttccttcaattcttccgagtaacgcagagataattcttcctgaggaatgccgtccttatttttgaaaatttccttcaatttttccgtaatatttgccttcagtgttgccacagtgtccgttttttgcacctctatggtcaataattttgcatgacgatgcatatcactaatcactttaatttccatgccattagtgaatgacaacagaatgctcagcatcagcattgtttgaacagcaaaaatgccagcgggaaataagccaaaataattcattttggcataaatttggtggcaataagaaagaatggagagggggttaatttactttgcttaaagcggaatgaggtgatctgaaagcgagatacaccgcaattagactggctgatcaacagtgttatgatttgaaaaggtaataaaataggaatgatcggattagaggtcacttatattgacatcccctttcaaatttaggcattttccaaaatgatttctggtgatcagattgggtgatcctcagacatttcatcctcattcaatagtccaattcgaataaattttgtgaaaatgaggctttttgacccaaaatgaggcttttttgcttgccaaatgagacttttgaaaatttcatctgcgagccctggctttattttaataattcaagcaataatattaataataaaaaataaaaaattaatcaaatttttgcctttttgcttcttctcaaacccaacattatntaagggcattaagccaacgcattaatgtgaatgtgaatgggcatgaattaataaagaaatgcttccaattttataagaaaaatgacatgcgttgaatatgcaaaaattataaattgaattgatcaataaaagtaataaatgacaataaaatgaaaataattgtataaaaattattaatccgtaatcacttgggaacagggctgggcgaaatttcggtttttagcttcgaaaacgcaggaatttgtagccgtttttcgcccaaagtgctaattttggtgatttttgggtcaaattttcaaaaaaatattaataaaatttgaaaaaggtaaaaaatgaatttaagcgctaaatctgaattggaatgttgataatctgaaaaaaatgaatcgaactttgaggtatttttccagattttggtatttttcataaaaagaaaactttttttttcatttgaattatatctttgattttttcaacaattctgatttgcttaaacttataaattaggtgaaatattgaagggtaatctattgaattttttgctattggtcacggtttcttaattttcgaagttttgcgaaaagtggaaaaaaggacgaaaggaaaacgaaatgaaatgaaaattcctatctttgaacacggtctttttagggacaatatgtttacacatttttggttggaaaaataactctcttttttaggtctatctcataacaatcaattttatgtttaccaaaaacgttacataaaatttttgcacctccaaccatattatctacatatttgagttaaaaacgaatganttaatccataa

SEQ ID NO: 28200 - DNA, 1631 bp, Heterodera glycines
  misc_feature (59)..(59): n is a, c, g, or t
  misc_feature (119)..(119): n is a, c, g, or t
  misc_feature (1618)..(1618): n is a, c, g, or t
tttcgatagtaagtttattatttgtttcttgatttttatgtgtccaaatggcgagaaanagcttatattgtgtcactcggaagcttaaagtctctggaatttatcaaacacactaaaantaataaatagtctttaggcttagaaaatccaaagagataaaaaaaagaataggagcttctttattcaaaattttctgaattttcatagatttatatttttttgcaaaaaaactattttcaaattaggcggtcacagtcactaaattttaaaacttgcaaatttttgctgagtaaaaatatttgagttttgaacgaagatagcactttaaattttttaatatttaaatttaataaattcatttataatttatttaagaaccgttatgtttggattcttttcacgcaaataacgcccaacgcctgtcatcttaataatgaaaaaacaacaaataatttattaaaatattttcatttattaccgttcctccggtgccaattccaaatacgcaaatgtccacttttccctgcgtttgatgccaaatttcaggccccgttgtccgatagtgaatttcggggttcgcctcattgcaaaacttgaataaatttaattgagtaatgaatttatttaattatttgaatttttaaaacttgtgcctgcatgggattgaaagaattgggaattgctcgtgccaattgtttcgttcgctctacggcgccgttgaagcccaattttgggtctagcagtaccaattcggcaccaagcgcacgtaacactgttctctgttttcataataattaacccatttttatcgaaaatagttttaattaaataaaaatgtattaaaaatttaaatattttatcttctcacacgttcaattgtttgtgacgaggatatcacagcaatgaaacgatagccgcgaatggccgccactgaggcgagtgcttcaattaatcggattaattaattgttagcataaattggttaatgatcaattaatgattgggaagattatagaataattacgttgatgattaattaatcattagcacaaattgatggctgatcaattaatgattttgataattaattaattagtcattataacaattgctcgattattaattaattaattattattgattgaccaatgcccgtgtttcctgccgtttgttcaattattgtgctgatccccggcttaattcggccttctttttccgctgcgtcgatcatagcgacgccaattctgtccttcactgagcccgaggggtttagccattccaattttactgctaaacattcggattgaattggatatccattttttggacaaatttcactttttctgatttaatgcgctttggccacttcaatatgaaaaatgttttttttataatttttagtaataagtgatgccgaatttaaatttcggtttaaaaacaaaaatttacaattggtaaaatttttcataaatttgttcaccaattttagcggcgcacccttttgacactttgttcaaataaaccattggcgtattgccaatcaatgcgcaaccatcggacccaattccatctcgtgaagccatgcaaattcagcgtgttgtgtgtgtattaattctanattccgcaaaaaa

SEQ ID NO: 28201 - DNA, 1163 bp, Heterodera glycines
  misc_feature (1040)..(1040): n is a, c, g, or t
  misc_feature (1068)..(1068): n is a, c, g, or t
  misc_feature (1126)..(1127): n is a, c, g, or t
gctgctgttattgcgtttggcatggattttacgctttttcaatgctaattattatttggcttctgttactgtatcagataggacacgcaaacaacatgatgttaattttttgtcggtcttccgccactcactaattagttaaacagtggatttgattgttttcaaaaacgaataaaaaattcacaacatctcatttgtccaccatttcattggtatatttaagaatatcccaattatgtgccaaaaatctctctttttgtttggaaaacaatttgccaattttgtgatgtttattatatagatcattatgaatgttatttacctatgtttaaagtaacttgtgcaaaacttaaccaattgtggggaccaccgataaatcagtgcgctccaaagtttgcttatttcttaagatatgtgctttttttgagggaccgaatcttccaaatttataatgtgcttatttctaaaattatgttaatttttagtatggagagattttgaagttaaaaatttaaatttttcctgtttaaaattttctcggtgcggcgcctgtcggaaccgcatgtttttaagaccattgcaattaaatcagcacaaaagattgaatcatttttatagatttagtaggagaaaatgaaaaatacaattaattaattaatttgtttttccatgtcaacgtgtgtttgctctcatcagaaacaaattatttttgaaattgaaattattttaaattaattattttgctcgagtttgcaaaattagtaaagagtcagtcgttcgaaagttttgactcgaaaaatatctctgtgtcaatccaagattttttggcaccgaacgttcacacggcacaaacggaggcattggcagaggagcgaatgttgcgattgcgctcaaatatttcattaaattaatcaaattgcgttaaattatcgtataattaagattaatatattaacaaatatacttaacgttttttggttgttttatttaacaaacaaaacttctttagattttgatccttttttgcagaatatccctanatcagtaaaaaataaataaaatttgaanagaaaagctcacaaaagcaaaagcgaaggaaaatggagacgaaaaagaaaatgattannaaacaaaaataaattttccatttattttttgacgat

SEQ ID NO: 28202 - DNA, 1492 bp, Heterodera glycines
  misc_feature (1444)..(1444): n is a, c, g, or t
aattatacccctaaattttgaacgttttcgtccttattttcgcccttatttctcgattttttcgcccttatttacggccttattttggactttttcgcccttaaaaatcctcgccctactgatatatcagttattggtattttggtttgacaaggcttactacctatatttaaaatattgactcgaataaaggaatacataggacatttaattctcaacagaattataacgatatttgactgcatgtatatgaatatcatataacgacgtcaaagaataataatggggatacatagaccattgggacaaatgcctaaacaaatatacaatacaacactgggcttgactttgtccataaacacatgggaacattttcctcattcattgagcggttgtctccgcacgatagagtttcgtaccattttcgtcaatccaatccacgagcgggtccacatagctgacgtacacattgtgtgccccgtacgtctgcggaagtgccaaatacagcagagcagcagtcttcagaagcagataaagtggtatcatgttggatatcaataaggtgttcacaacgaagtcgaacaagatgaacagagcgaaagagcaccagtagatcagccattgggtgtcatcatctgaaattgcatcgcaaaatgaaaattgcgtattggcgagggaatgtctcaacttttgtctgcgtacgaacagccaacacactctgataggctgggtaaacgatacctaaaaaaggacaagcgaattagcatctgctgatgatcgttgctcaagcagttagtgactgaccgatcaaattgcagaggaattggttgccaggacccatgaccaaccagcagatcacgaaagcgcagaaaacgtagaaaagctgaaaagcatggcgaattacaaaaaagaatgcattaaatgttttcttcgtgccttcacacggtccattcccgtaacatcctccagctttttgagcatcggttgctgccattctctgagtgaaatacgaagcaccggaaggatgtccttgtggcttttgatcgacgattgacgctttctcggacgcactctgtggccatgtctacgggtatgagcagtcgctgattgttggtcattggcactcgctgtcgctatcggttctctgtcgtcagtcattttaatactatgccggagatttgtaatattttgtggtaaatgaaaaatgaataacggaaatattgcttttatacataatttttggacgcaaatattttaaaagcatttaacctatacaatattttcaagtgaattaaaagcacagtggcacgtcatccacaggcaactcatccacattttcctcggattaaaataaatggaagcaaaatataaattaaaataaaaaaacttgatgaaaatcttcggttcgagttggtgatggcgcatagttgtgttgtttcacaantgtaaaagtatacatcattaaacccattggtttttgcgtacccttgac

SEQ ID NO: 28203 - DNA, 1297 bp, Heterodera glycines
ttgtttgttgttttttttgtttctattgcgtaattactaattagatggaatgaaaaagagtggtgcattatttagctaccagtaatagtaaataatttaacgcataaccaattagtgatgggagctgttggttcactatgaaccacacattcgttctcatcggaaggtgtaaagtcatgtgctttacacaatgacgacaaatgtttctgctgctttccattggaaagcactctttggacggggaaagggtaaataaaaaatccaagtgaaaaagtgccctttcgcgggaggccttccctttccccattcgtttttgttagctgtctcgtgatccaaatttaatttcattttgtcgtgttatagtgcataaattcatgctttggatttcaaatagctgtctgccaaaaagttttcttttttcatataattttttcgaaaatggctctcattattacgccattatttttagttttagtcgagtacgatttaattttagaaaacacaataacattaaataagatgcgttctcatcagtttaatttacgccaactccgtaagcctttccgaaatgtcgcctcaactaacagtgaaggccttcgtcatcggaacagcatcgtcgggccaccggtagttccatggacatcgttggccttgttggcaacagcacctccaattgttgcgcctgaagatgacatcctgaacagtctttttgctcaggttggaggaatgccaactttgaaatccaccggcaccactgttgaacttgtgcggcgccgttccttttcttgtggttcaaattgtgcaaaatgcggttggtcctcttttatgagtgcatttgaacaaggcatttgtaattcatccaacttcaggcaaaccattgcgaaggactccgaccaccaacggttggtttcattttttgtaaattttaattattattttgtttgcagacaactcaaagttgctctactgcaaagactgcaacattatcttcagcagttcttcttcgaatgacgcgtcgtccaagaaattcaacattttgaagaacggtcccatccaatcgccgccgtatccgaccgaaatttcggcatatttggacaaatatgtggttggccaacaacaggcaaaaaaggcgttgtctgtcggcatttaccagcattacaagtgggtgctggtaaaatgcttttattacccatttatagttgctcaaaatttttgtcccttaatgttggagtaattcatttgtattacccgtttcagacgcttggaaacaatcagcgttttctggatcagttttttg

SEQ ID NO: 28204 - DNA, 2209 bp, Heterodera glycines
actcgatttaacattttccaaaaatttctattgaatttggagatttgaaaaatataatccaaaaatttttgaaacggaaccagctttttaaagtactaagacagaattggccagacggaactgacacgcttcagggggagggggtgtggaatacaccaaccaaaaattaaaattaatcaaaaatttcctaaagataattaattcctttttcaattttataggaagttaattatttttgaaaatatagtatttaaaattaaaaatcatagaaaatttcaaaaaacaatattcaaaaatgtgtttcttttagaaaattattcgagaaaaatccttcacagaattattcaaattaaaattttcggtttttaatggtcgggtgagagaaatgcctcgtgttgccaaattgccattttcgtgccacttttttcttccccttcaccgtgccttgttcaatttgccgtccttgtccttgtcccggtgctccctgaacatttcccgttccgactccacccattccggttctttgcccttcagtcccggatagtcgtctggtctgtacatgtcgccgaagtactcggccatgtccacgaaaccgtccttgtccttgtcaatgtcttcgacggtttcctgtacagaaatttttaaggatttttaaggaaaggacatcaataacaattaattatttattaagcaattaggaataattaggtaaaattatatgggtaaatatgagaattagggtgagggtttgtttaccattagggaaatttagtgaatttgccctaaatccccgatatttcaaccaagttaagacaagtgaaaaatatataaagtgaaaatcattgaaaaagggactttaataagcaataatctaatttgatttttttttaataaataaatttgctaatccacctgcaccacaatgtctctcatatggtcacagtcctccgggtgcatgaaacagccgtattccgtgcggtccattttaccgtccgaattgtagtcagccacctgtaaatcaatttttgagtttactgtatggaaagcatttaaaaatttgatataagaatttaattttgggagttagccactcgaatttaaaatgtaaattagcaggtctttggcatgtttttgaccttccaccgccgttcaacaaaaaccattatagttttaaggattagtcagatataagaaaattaattgaaaaaattaaaaaaaaaatgaaatttatagcgaatcgaagattagaaaatcgatcaaaagataagtaaaccaacgaaggccgtcaaaattgtcaaaaagaagctttataaaattctcaaaaaaccaaatgaaagattatgagaaatgtaaaaagaatgtgaaaattaaaaaatttcaaattaaaaaatttcagcgaaattacttaaaataaaaaattataaattagccactcgaatttaaaatgtaaattagcaggtctttggcctgcttctgaccttccaccgtcgttcaacaaaaagcgtttagattttagggattagcagaacttatggaaaaatacatttaaaaaacgaaactaattaaaccgaagcttagaaaatcgatgaaaagatataagcacaatgcagtcatttcaaaaaatgtaaattaaattttaccaaaaataaaattctcagaaaaccaaatgaggaataatgggaaagctaaaaagaatggcaaagtcaaaaatgttcgaaataaaaaaactttcaacaaaagttacattaaaaaaatactattcttaaatcaaagaaatttttgaatatttttattaaatattacgcaccacataaaaagctttaaaaaattctcaaaaaacaaatgaagggattatgagaaatataaaaaaaaagtgaaaatcaaaaatttcaaattaaaaaatttcaccgaaattaattaaaataaaaaaattataaacccaagaagacagtcaaatttttcaaaaaaaaaaattaaaatctttcagctaagttaaaaaaataaattccctcaagtaattaattttttttttcttaaatatacgcaccacataacgcttctgcatgaaattgatgtgctcccgtagttccaactcatccacttgaccgtccgagtttaggtccatttttggcactaattttctgtaaaatatttaatacttttttttgttgtaaattttcgaaaatacgcgagtcgtttcttgctcttc

SEQ ID NO: 28205 - DNA, 1004 bp, Heterodera glycines
gatgttttttcaagttttcgaaaacagattaaataaattaaaaacacattattattattaattagatatttttagatgcttctaagcaaataattaattttttcaaacatatttttgatttttaaaataaatttcaaaaaatccaggtccaggcctggatccaggtcccgaggagcctggatttttcctggacctggatttttgtccaggaaatcaaggtccaggtccaacatggaatctaggtccaggtccaggcttttttcaaaatgtcgatctctaataattttcatgcaaacaaaaatggttttttggtacttttccattttgctggcataaatgccacagtctgaatctaaatttcagcaaaggtttatgaccaaaatgaaaagggtaatatgtaaattgccgatggtccccactttttggaagaatttattattattatttttatgggatgttttcagagttctgacatttattttgccaatttcgagtctctgaccctaattccaacaaacaatctaaaattaaaaatgtcaaaatctcacttttgttctaaaattgactgaaacaagctataattaatcaaaaaccattgcatgcaaggccaaaaaatggtcattctatacagaaacgaacataaaagtgattttaaaatcttgaattttcgactttttgtcgaaaaaattgagaatttaaaaggtatggaggctgagtgaatgcctctattttatttgtacagcgactgttggctgccggagagcagcagcaggccaaagaaggattaaaagtgtgttaagtgctaaaggcaagcagatttatttttctctttaagcaaagtgccatgccataaaagggtggattatttgaaaggtgaagcggagggatgaggatgaaagtcacgcaaatccgtcgtctgtcactattagcgatttgccgaaggcaaaaaaaggattatgatgaaatatttcaatctaattggcacttatccacttttatgtata

SEQ ID NO: 28206 - DNA, 723 bp, Heterodera glycines
  misc_feature (672)..(672): n is a, c, g, or t
gcatgttgacgggtcggcgtgccgtccggctttgctgacgacggtgagcagctcataataaccccacaggggataaatggacaaaatatctggcaccaaaattataggggataattacagcataaaaggagcgacaattgtggtgtcattctccctgacaaaatgagtcgttaatgcgatatcatattttgatttctgagtttgaaaggaatcaattttgtaaatgcgggattctgaaaatgcttatgcgcggatttgaggggattaagggtgattagcgaagggaggggggcgggggaaggcgtggtacggggatggaattaaaataattaattagattgaaaatgatgaattagatgtacagaaattaggagagaaaggagggtgggggaggtgcaatggcaatgccattatcgctaatggaagagagtgacagccggtgaaactgatgccttcggggaagctcaaaacgccgtaaaaaaaggacctcgaacggctgggctttttgaagtgatgccaccgacagcccatcctaattacctaattaaaggggttaattggttgtgaagtaaagaggttgatcgccaaatgaaggtcaccccatacatatcattttggttgtgttcggttttctaacacagagaggtaagcaccccgtgggtcgcctggcgncccaccccccgaagaagcaacaaactaaaaaaatgctgaagaatgtacgct

SEQ ID NO: 28207 - DNA, 1123 bp, Heterodera glycines
atcccgaaacatgtataaaaacccaaaagatgtaccacttaagtaaataaaattttttaaacaattatttttcggaaacaaaaaattcttcgtaaagcgtgaaataggtaggctaaaaatgagctacataggttaagagaatcaaattttagtattttaaaaattaatttttggtatttatagaggtatattttcaaaattttttattttttttacaagaaataaattttgaaattctcaaaatatgtaaaaaaaaataaaataaaaatatgtacgaaaatttgttaaattttgggttttttttttgaggataaccaaaaatttccgtaaaaatcctcaaaacatgtaaaaaattcgtcatgaataaaatgggccccagtttccagctttttaccaatttttgctcatagcatttttcgagagaagcacaaacaaattttctctattaaatttaaaatttgatttggggttaaacacacaaaaaaatacccattttggggtttggaaactaaaaaaaacattttcgggcttttaacatgtatttttttagctacttccacattttcgaataatttagggaaataaaactcaaaagtttttcctcgcgaacgaaaaaaccctttcaataactgactaaaaatttcagaaaaatgcacaatttaataacctttttgacccaatttcgcccttttcggccatatttggcagttatttggtcattaaaattgcttccttaatgagatgaatgacccccgtagggaagtttaattacctaatttgtttgtaattgttttcttttgttgtagtccgtaaatggtggccaaacaaatgtgatcagaaagaaaaagccgaatgggtgcttgaagtggagcgcgtttccttacggcaacaaaaccgtggatgttgttaccctgggtttatggtggtatggcgacaaatggtcaaagtgcgcggtgcgccgacgcggctgttcaaattattgcaaatgtccgagtgggaaatcgaattagagtggtggaaaaacgaaaaacagtgctctgacgaaaacggtaaaataaacggtagtaggaggatactctaaaaaggatacaaaaaatacagtaattatgaagcagaaaaataa

SEQ ID NO: 28208 - DNA, 1163 bp, Heterodera glycines
  misc_feature (9)..(9): n is a, c, g, or t
  misc_feature (63)..(63): n is a, c, g, or t
atagaattnttattattaattcgaaatcgttaatttatttgacaatccaaagacttaaaatgnggagaagcatggggctgtggctgaggaccccaaatgggggccccattggggaattaaacatgatttctgaaaaagtccctggaatgtctattttttctttccatatcttcttgtaaagctcgagctgttctttccaatggtcttatcccggtctcgatccctgccgaactcaaaaagttatgaagtgaaatgtgaaatattgttttcgccacaattgggagaagcatggggctatggctggggacccaaaatggggccccattggggaattaaatatgatttctgaaaaagtccctgaaatgtcgattttttctttccatagcttcttgtagagctcgagctgctctttccaatggtcttatcccggtctcgatccgtgcagaactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaatttttcccagttttgattgggttttcaaatagtagtttggttcagaattttcccctctacaaaaaaaatttataatagaattttttattattaattcgaaatcgttaatttatttgacaaatccaagacttaaaattgggagaagcatggggctgtggctgaggacccaaaatggggccccattggggaattaaatatgatttctgaaaaagtccctgaaatgtcgatttttttctttccatagcttcttgtagagctcgagctgctctttccaatggtcttatcccggtctcgatccgtgacgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttct

SEQ ID NO: 28209 - DNA, 1000 bp, Heterodera glycines
tctgttcaaaatgcatttgccaaagtttgattagctttacgatgggaaatcttcacataattatctatctgtaacagtcaaaatctatcccacaattgcaagagctacatttattgaagaattaagccaccttattgtaggaaagaattttgggaatatttgttgataaatagaaaattccctaaacttatatctagagttgagcgggaccgggacctgaacacgtacaactgagtaccgaagtcccggttttgaccgggaccgggactagtcccggttttttcccggttttctcagccaaaaattcccggtttttcaacccgaaaaggtcccggtcccgggtttgcccaaaattcccggtcccgctcaactctacttatatctaatagtccaactgatcagcatattgcgcgttccaatcagttccaaataaagagccatgcatttgcatttgagcactgactgaattgcgcaattcaatatgatcaatctggtaatgattaagctaacgcataatgccgaattttggcactttgtaattcaatgcaaatgctgggctattccactgttccataaaaaaagtttattattattatatgcgcatcctgaaagagcacttttacagtatattttaacaactcatagttcgctattttggaaatgtctatatctctattgtattatagaactgtatctatttttctgtataaaaatacacggaaaaatcttttaataaattccacttataacttctaattttctcgccttcggcaccgccggaccaaataatgaaattcttttgttttggcatcataatctcaaaatcaaaatcataattgacgctaactaggtacagtaatctgatttaagttttcttacggtatcgcataattaacaaaaggaaacttaagtgaaaattctgcgtgtaaatgaacgttcaaaaaattgaaaaattttaagtttgcttttaaaaattaatttctaattattttttttatta

SEQ ID NO: 28210 - DNA, 1995 bp, Heterodera glycines
  misc_feature (25)..(25): n is a, c, g, or t
  misc_feature (38)..(38): n is a, c, g, or t
  misc_feature (48)..(48): n is a, c, g, or t
  misc_feature (63)..(63): n is a, c, g, or t
  misc_feature (70)..(70): n is a, c, g, or t
  misc_feature (141)..(141): n is a, c, g, or t
gatttgtttatttgacactgtgcangcactcttccccntttctcattngatttgtttattttntcatctntaagggtactgtaattattttggattaaaataatgttgcaaaaaaaatattcaaaaatcataaattacatntagataaaaaaaacattcaaaagccaaagggttagaaaaaataaatgtgcatcaaatataaaaattcattgagtaaataaataattactacataaatacaaacatcaaaacaaatgaaatagtacaaacgaattcccgcacaacttttatgcttcagctggcgttgttaatagattagaacatataaaattccaatattcaaatttgataataattattcaatttcactaagaaattgaaataatataaacaccaaataaccataagaaaataaattattgataaaattttgaacaataaagatgacaaaaattagaataattagcataattttcttggctaattatttataaacgcaaaatctatataataagtcttctgattagaaaaaaatctttatttgaaacatcatggcggaagaagcggcagccacagcacaggcgggagcggatgaggaggacgcaaatgggtggtcgaacttgaaattgggtccaaagttcgcctcaattttgtgccggcactcaccactttttcacaagcctcatgctgcaccatcttctgtcgcgaaataggtgctccacaaaaacgacactggacaggcatttaatatcaaaatagtatataaatatatattaattaattaaatagcataaaatttattccacaatccattatttatgtactatctcttcatttttaataatgtaaagaacaacatttcgcttaataaaactttttttccgccttactgattttctttaaattttgcatatcgatggagaaaaaaatactaaatcgattaataggtcaagttaaaattaaaatgggtcaaattaaagtttttgctgttaatctatgcattttctcaattttttatatttagtaaataatttgccgtcaaattataataaatgtttagttttgctctcaaaaactatgttttataatgagttttgacgttttaaacttttgatcagattaaatatactttgtttttcctttgaattcattggaattttgttttttacgcaatttttttttggcaatttttttcgttttttaccgtccatgtattattttatttgttcattttttaaaaaccttgttgaaaagccataaaatcgtattcaaaatattatcccttgtcattatccccgaaaataaagaatcacctttgggcctttagcattacgatgaaggctcatgtggcgcttcaagtgagctttttgatgcgttctatgtggacacaattcacactttaaaaatcaattgttatatttgaacgtatttattgttagctacttttacctcgaatgctttgaagtcagaatgtgtacggtaatgccgtttgaaattccacaatttcggaaattccatcgggcatttgtcacaacggtggggctgaaaaacaatgaaaattttctcgggacgtaattttattgcgatttattaatagtttttgtccaataactgaccaatttttgcgatttttgggcgtatttttttaaaagaaaaattaggatttttacgcaccgctggggaaattttttttgaaattttaaatgaattttgctaaggggttttgctcaaattttaaaattttttctttcccgcttcgaccccccccctcacgacgaacgaatgggaaaaatatattttttgataaattttttggaagaaaattgttttgctggtttctcaccacttttggcactttgcgtcttctcccgtcgggccgtctgttccccttctcctcgtcatccactttgatgtccgcgtgcgatctgagctggcgaaggttaattgccttggccactatccttggctttttttggggcggcgcagacagcgaaa

SEQ ID NO: 28211 - DNA, 1424 bp, Heterodera glycines
atttttgatcatcaaaattatttcatgccaaatgaaaagatttacgttataaattgttaagattttttggtttcttgatatcattcgctagccctacgtttcctcgattagcctgcaaaatttcaaaaaatttcgttcagtttcaaaaagttatgaccaaaaatgtctgaaaaactggttctttgactacttttggccataactttgctcaaacttgaccaaattttttgaaattaaagtgagctaatagagaacccataggctatcgaatgattccaagaatgtttaatttggttgactttgacaaaagttatgagtagttttttaacaaatttgtactggaattgaaaattaaaattcttttgctgaacgcggtgctggcgcgtttcttaaaaactgccacccatgcgcgtttcttaaaactgccagcgcgtttcttaaaactgccaatgggtttgaaaacaaaaatgggtaaaataattaaattaatagcttggctcaaattcaaccaaattaatatttcgtggtatcattcaatagccttaattgtactctattagaatatgatttttcaaaaatttttacttaagtataaaagaagttataaagcattgaacaggctatgttttttgcaatggtaatgcatatataataataaacatttaaaattttaaagtctttaaaatgcaattgagccaaattaatttataaattcgatagccctaagaattctctatttacctttaaaattttagaaaatttcattgagttttttctctcctaatggcattttgccactggcagtttctctcccattgacactttgccattggcactttacctgacatggtccctcctttaaataccggcgctggacggagttttggctaaaaaggcattttttgaattgtattcagcgggtaaaaacatacgggtcattttgatggattgtctgcttttcctgctgatcgctgggctgatcttcgccattcctttgctcgcaatcacccaaaaatgaatgagacgggaatagagcgaccatccttcaaaacggggagcggaaacagtgaaaaactattctggcacaattattctctgttttcccttttcccttttctctctctctctctctctctctctctctcttatgcctttcattctttctcctccctgtcaattcatccacttttgcccctgtctctcctattctttcccctcctctctgctgctgtctctctccatttccctcgctcttactccgctttctctcccactcactcagtctcttccacttcttcttccgcttctgttccctcttctccccttttctgctgttgttgctggcgttcattgccaaaacggatggaacggcgccggaggcgaattgttcggaactaatggtcggtcaaagaactttttaaatt

SEQ ID NO: 28212 - DNA, 1606 bp, Heterodera glycines
  misc_feature (37)..(37): n is a, c, g, or t
  misc_feature (55)..(55): n is a, c, g, or t
  misc_feature (81)..(81): n is a, c, g, or t
tctttaaaattttttttataatttttccatttttttnttgtaaaaacctagatanattgaatatattaaattatttttttntagaatcttttctcaattttcttttcaaaatgataactcttcaatatttaattggatttttgttcgccgctcttctggcccattacgtcaattcatgttggtaggaggaggaattaattgggatttgataagtgctaatgaccattcaaattaaaataattcgccaactttaatgacaaataaggcccaagattagacaaaatgattctgacccaaaaaataaccaaaaaaatttgtttgttcgtgggtttatcttggctagccaaaaacccgaagatattacaaggctgaaagctcgggaaaacccgtaattcagttcttggcacatgattacagtcaactacgtattagtgactgataatgactaaaaattcatgagagatacggaaactacgagaattttctgtggtcgtgattaagaatttcgatataaataagatttaagcgataattaggcaattattatttttttaaatctttattaatttaataggttggttaatggacaaaaatgtcgcttggtggtgctgcaattgttgggacagtggaaaaagtgttgacgaagatgttgttggtgtacagcaacaacatctacaactaccacagcagcagatgttgctaagcggggcaaaacttggacaaaagcgctcattacaaatacaaattgagtttaaaaaattaattttaataagagtaaataattcataaattttaattaatgatacttcaaattataaaaataattttaaaatttaaaaaaatattttgacaatgttaaattaattattattatttttaaatttgataactcattacgaatagaaattgagtttttaaaaattaaactttaaaaatataatgaattcaaaaattttaattggtgatccgccaaacgaaaaaaaaatattttaaaatgcataaaaaatatagtgttaaaattattattatcatttaatcgaataaaattatgcctagattagcgaaaaataaatttcaaaattaaatttcagagccaaatttattccaaagggacaacagaatttacgcgcttcaagacaatgccatatttgatgaccaagaccaacaacagttgtataacagcagaatgtaagaatttttagtaaaaaatgtggcgaaaaataattttaaaaaactttcacttattctaatatttataacctaaatataattaattaataaatgaaaaaatgatgtcaattgtagcaaagtctctaaaaaaataatttattttgtctaaatttatttgtttttcgctttttaatttcgagcgccacaacagaatataagaatttttttggtaataataaatgtgtttgaaaatatattaaaatggtttataactaatataagttaattaagaaaattaataatgtttattttcgtttgatttaattttcggattattttttcaaacatttttttgttttttactcgatactttaaaaaaaaataaaccccaaacaatttattttaggattacttcctccaaatttaactttttttt

SEQ ID NO: 28213 - DNA, 681 bp, Heterodera glycines
cttcccttcccttcccttcgtctgatggctctttcccctcctttggatggccaaatgagagaagaccacccccttcacattccatcgttgaatctgctgctgatttgatccttcatcatgaagatggccgcttcccattttaactgccgaatttcttcttttcgtctttggcattgccaatggccaaatattctctaatcgatctgatggggtcatccgccagggtttgtttgtcctttcctttttcttccaccaattcaccgtttgtcccccccccccgtttatccctcctctgtcccattgtgtcctgtcctatccgtcctaaaatgtcctaaatgaatgctcccccgccgggggatgttctctctgccattaatcccttcgtctgtttcggcattcgtccccttccctcaggcttatatattccgcccgcgttgttgccccgagccgaaatccgatctgtcccttctctctgtttccctcccctcggggaagggtcactttccctccgcccaaaacgcgtcgtttcgtttcatcgaaattggcaaagggattcatttattcattcattcgtttgttccttcgttcgttctttttatgaattttgcctttccattcgttggcatttttctcccttttttttgccggtttaatttattttcctttgtctcttttcatttt

SEQ ID NO: 28214 - DNA, 1365 bp, Heterodera glycines
tcaaatactttcatcttacaaaaaattaaaaattattattttaataaaaaaatatatttcaatttctattatttatttgaaataataaaaatatttagtaataaccttgataaatatataaagaaatatttatataaatagttcttttaacattatcgagaacgagttaatataaataaataatgaaaatataatttaatttcaaaaataataaaacaaaataaaataaaaattaatacttgaaggacaaaaatttggatttaaaaaaatcttaaaagacttttacaaaaaaaaggagtattgcttataggataaaacgaaacttaaagctttaaattggcaaaagaaaattataataaaaatgtaaaataaataatctgtggaacataatttattagcaatgataaaaatgatataatggatcctacaatgacatcaaattccgtttcagaacatgaaattagaagggaaacaaaataataaactaaaacattctttattctctttaaataaattaaataaaattaaatcaaaaataaggcaacataaaataaaaattaaatgttttcaaaaatagaataaagaaaattgtatttcgaagattctgactgcgactatttttttcattgtcacctttccttttattgttaaaaaatatttttatgtaaaataaatgaagatgtgatgtttttttaattttgaaaaaatcatttttacagctaaaaacctaagaaatttattttagcctttgctttttgcagatttacaatattcaacatgttatgtttttaaaatgtaatttaaaactcacgatattcacaatataaaattttaaatatcgtaacactaaattttatataaatcaatgtattcataaatatttaatttgtataaatgaaaactttaaaacgacatgatttaatatttagttgaaggagaaaatggataaaaaatattttatttgttaaaaatgattaatcacttattttacaaaaaaataaaaaatatatttataaataaccaaatattcattcacaactaatagcttattcagcactatgtacaaatcaccgaaaatgatgcaaatacacaaataaacccattagcaaaattacttggttttttataaaatttacttaatttagtttactaaagacaaataatcaacaaattatttttttcaagcaatatttgtaatatgtatttaaaataatttaaaaatatataaataaagaataagctacaaataatttttaattgttatagaaaataaagtgtttgtaataatataatacgaaagataatattcaaaaataggacaattaaatcataaatttaacatcatttaatagtcacaaaaacatt

SEQ ID NO: 28215 - DNA, 1212 bp, Heterodera glycines
gatcactcccaacgaaatgtgcctggcacggacagtgtgatttctatgcccggattgaccggctcacacaaacaatgaaaatgagtcaatgagatcatttggagttcattttgttatttgtccgtcaattaatttgaaagtttcttgaattaactaaaaggatttagagcataattttgtgccattttaaaattattattaatattcaattaaaaaatagctttaaaataattcaatttaaatatttttattgacactgatttttgagactattttcaaaatatgcacataaaaagtaaaaaatatgcacataaatttttccaaattgggcaacattttcacaaattcttcaaattcgttaaatttaagctaaaaatctcgaaaatagctaaatgcaaaaatatagctaaaatttattaattttgaagaatctgagtaaaaatagaaaatttttaatttttggacatattttccattttttaaaaagttacattttttattaatatttttgaaaaaccccaaaaaatgaaatttttgaaaatttttcggtccttagagatcaaaagtttctgttccttgtttatgaattttgcaagctcttctcgtcatttttgtaccagtgttatcctcgggggttatcgatggcgctgatcacgaatctgacatcagattatcatataaatcatctaatctatgatttttcatcaagtgataacgtcaaaaaaattttttgatggattttcacttttactgttattcattcacaaacataaattccatcaatatgtatgtagctggaataattgttctagactaatgaaactatttcaaaaatccgaatttcttatgaaaacattttcaacacattttgtgattgcttataattttaaggaaaataaagtctgtacgttctgatgaaatgatagagaatgtatattaattagtaggcaataatttttcgaccaatttttctctcccggatgaacacattccgactggtagcctcatcatatttaaaaacagaaccagatcagtagataccacgtcatgttctttctcactgctagtttctgaagaaaatccagtggaactttgctgattggcataggcatttttgtccatgcttaccgcatagctgcgatatataaatgctcaatttttctgagtgttttaactccatattatgtattaatagcattttatttgcttact

SEQ ID NO: 28216 - DNA, 805 bp, Heterodera glycines
tgcgcaggattttgcaggatcccagtccgcaatcctgcatattttggaaaatacaggatttacaggatttgcaggattaatcctgccggatcctgtcctgtaaaaaattttgaattccaatcctgcaacaggacccgcaaatttgatttctatgcaggattcagcaggatcatgcattgattttttgaaaattctcaaaaatagaatgacaaatattcagaaacattcttctttcaaaaattctcctcttaataaaaatttggtcgtatacattaatctccttatccgggcaaagtttatactcgtaaacggtcattggttatattccctgaaaagcgatttatatttctaatacataaaattgaatttgtttagctaaaaatgaataaagcgtttgtcaaagcagcactctgctccaaatcgacgaatgtttgcctcttcaaacgcctcgtcagacccgtcgtccaaattggctcccgtccaatcaccggcgccggttttggccatccgatgaccaggcaaaagatgcaaatgtacagcccggaaatgagggcagtcaattaccaacagaagcgcacccacatgcatgtgaggcaatttttaaatttaggggtcacaaaaaaattcaagaaattttggcacttttagaaattttacggaggcattttgatattttatgggaaaattacgcacgaattaccaagttgcaatgcaacatttcccatcttttgaaaatagacacctataactggcattagggttattaattgaaacaataaacgggaattaaggcaatcctagaaat

SEQ ID NO: 28217 - DNA, 1017 bp, Heterodera glycines
ccacacgcatacttttttcgcttcgtcatagcacctatttttgtgcatatttggtctttattttggaatttttgtgcatatttcatgactttatttcagatgtattgaaaaataaatatctgatttaatttaaataaatttgataagcataactcttaataaaaataataattttatcaaaataaaatgcgtttcattttaaaagagaatttgataaaaaattgaaataccattaaacgagggaaatattaaacacagacatacaagttattaaaaacaaattaaaaaaagaaaaaaagaaaaatatttaaaataaataaattaaataatgaaatattagtacaaaaacatagataatttttgaatgattatgacctttttacaagctattttattattgtagctataataaacaacaatattatattaatataagaacttcattacttttataaaaaaatgattgacatgaaaattggacaaagaataaaattttttaaatattttatttgaagttaaaagaatagagcccattttttgtgtgttaaacctactgtataattaaaaaaaaatattaaaatcgtttgattaaaatttaaaataataataaatgattcgactttttaaatgattttctataaaaaatgtatggattttaataaatatttaatattattcctaaaaaacaaaattaatgagttttataacgacaatgatgtttactagagttgagcggtaatcggtaattgcaaaaaaaccggtaccggtactgaccggtactgcaaaaaccggtaccggtatcggtaccaactttttccaccggtaccggtaccggtaccggtaaaaaccggtaattttagaacataaaaatttttggacaaaattttccaaatacaaaatttttattcagttttcgcgcgagtgcctgttttttagcattagaattgttcagaagtatatgtatattgagggtgaccaattttttttttcaaattcaggacatagaacactaaaatt

SEQ ID NO: 28218 - DNA, 633 bp, Heterodera glycines
ccgccccccccccgcccttcaaaattttgaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttc

SEQ ID NO: 28219 - DNA, 1273 bp, Heterodera glycines
ctctctctcatcttccctctccctctctctctcccattccctctcccattcccctctctctcatcttccctctcccatcgcctcctctctctctcagcttccctctccctctctctctcaccttccctctccctctctctctcaccttccctctcccattcccctctctctcatcttccctctccctctctctctcccattccctctcccattcccctctctctcatcttccctctcccatcgcctcctctctctctcagcttccctctccctctctctctcaccttccctctctctctctctcaccttccctctcccgttcctcctcctccccattcgtcgtttcctcgtcgtattctcccgcctctttccctccgttctttgccctttcttcgttcggactttcgtaatttgggtaaatgtcctcctcgtcttaattggtgtgctttgtctttcccttttttgctgtgatttgctcactttgtcctttctctctcctattttctcgtccgtttggcctttcccccgcctttaaatggccaattttcaaatttgaattttgctgtccatttccttcgtttggctttgtgttttgaattgtctttggcgtcgtcgtcgttttcgttgtcactatgtcttctgaagttgtgccgttcgtcgtcccttctccgagtgcgtaatttgtcgtccttttcgctgttgtctcataaactgtcgttgtctttgcccccttttgcgtcgtcggtgcgttttctttctctgtggcctttggtttttctgccaatttaaaattgttcactgtgacggccaaaggagaaaagttttgaggcgaaggcggcaaaggggcgaatgctttcagctgctggtcgactttggaattgggcagaagaaaggaagcgattggcttaagaaggcattcttttgttggtcagatgtgagtgattgtcttaatggtcgtttgtttgcctttgcctctcctccgactgaattcaattcggacggacaaggacagaatttggcgtcggcgccgtcctcgcccggggggcccttctctccgcgctgccccggctttccctccaatccgtctaatccttgcttgccgacccttccgtccggtccgggcattccgatgacaaagtttcgttttcctctctcgccttgtttacccgtctgaccgggcggtcccttcaccccgggtaatcctgcaaattcagccctttattttatttaggcgtttttttcagagggttatctttgcactggtggacctgca

SEQ ID NO: 28220 - DNA, 291 bp, Heterodera glycines
ctgcggacatctacatttttgaattgaaaaaaagctcgtttttactctttctttttctccatattgaccatcatactcatactcccccacccttttcttcttccgccacccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 28221 - DNA, 1562 bp, Heterodera glycines
cagcccattccaccttccgactgggcagagatcgtgtccctttgacaaacttccaagcattccacttgagagcttctttgcccgacggattcgtgaagcacaactcatcatcattgatgagatcaccatgcttcacaatacggtgattgaggtcattgaccgtgtgtgcaaagaaatggcaattccccagtacaaggaccttcccttcggaggaaagacggtcattttcagcggtgacttcaaacagtcactgccggtcgtgcctcatgaaggcataaccgcacaagttacggcctgctttcaaacttctccgttgtttcgtcaattcaccacaatgaaactgaccatcaaccagagattaggccaaggccagcaagcgtacttgcaaatgtgccgccaaattgggctcggagagaccggagaacacttctggattcctccgcagttcatcgtaaagagcagggaagagctgataaactttgtttatccaaactttcaacaactccttggcaatgaaaaggagctgctcaaccgtttgatactcgccccgcacattgatacgtgcgacgaagtcaacgaaatgatgatggcgaatgtgccaggtcaagtgcgggaatatttgtccacggacaaacctcttgacgatcgcccattggacatcgatgagatcgagtccgaagtggcagcattgaacggacgcacagactctgggatgcctccacactgtctgcgactaaaggtcggaagcgttgttgtcctccttatcaacaaaagtgatagggaagggctgatcaatggcacacgcattgtcctcgaagaacttggcgatgatcgccttgtcggtcgtgtaatcaatagcaatgctattggtggccaagtgaggtttttccttgaaagatctcgcaatgtcttcgaggacaaaacgcctggtgggctgaaatacgagcgtttgcagttcccaattaagcctgcattcgctatgaccattcaaaaaggtcagggccaaacaatccgcactgtcggcattgacctggaaagggaagtatttacccatggtcaattatatactgccttttcaagggcaacggacggcaacaatgtccgtgtgcatgctccaaaaagggagatcgatgcccaaggtcaagcgaaagtgctgaacattgtggccaaaaacatgctcaaattgcaataaaagagctatccaagccaggttggcatgccaacttcattacacaaagccttgggtctctattgcataaatcaaacgagctatagtccagtgtgtgcggtactgttccgatgccgccccattctcacctgcacttaaatatggatataaagtactgccacctggactaagggagggaggagggatgacgtgcgagttagggcacttccggtttccattgcactgaaatatgcaatgtgtcagctcattactgagtgaaaccaagtgcatgtcggctgacgcaaagaccctaacacaagactaggtagcgaagctcaagaagcgcgcagcgctttaaagcagcagaaacacgcaagcacacacccgctagttt

SEQ ID NO: 28222 - DNA, 394 bp, Heterodera glycines
ttttttgtaaatgtacgaatcttttttaaaaattaacaaaaagtttatcaagaactttcaaactgtaccaacaatgtttaatttggttgaaaaggaaaaaaaattatgattaaaacaacgtccagtgactgtttgtccaactccattaaaaatagagcccctggtggctcaattagaaaaaaattgtatccaaatttccatatatttttttcaccatttgtagagtaagccaattggtatcatggcagttcatacaattttttatattaaaaaaaaataaataaattttactcatttgtcagatgcgttcattggtccgtacgcgcaataattttgaggttgaacgcatcaaactcacttgtgagcaaccacttgcccaatcagtcgccgatgc

SEQ ID NO: 28223 - DNA, 1041 bp, Heterodera glycines
tatctattgcctatttctccatattttgtgtctaaaattgttttgcttattgatttgttcatcaatggatttaatattttctgaaaattgattataaacaatgagtaccaatagtttaaggaaatgtcccggaaatagattatagataattttgcactaatgattttagaactttttcgaaaattgaataccagtaattaagaacctcaaagggcgcccgtgtgattttgaaactcaaaaccataggggggaccccatggttttgcatttcatgaaaaatttttttactcctaaattagctaaaatgcatttttatggcataatttgaggtgctgaatacgtatatacgctttattttgcgtttcagattttttggaaggtgtttaaattttttgaaaaatcgtcaaaatttgagccccggaaaatccagtgaaaatttgaaaattcataacgctcttcgtttttggtcaaatttagtggaataaagtttgaaaaatagcaaaaaattaggagaattttatgagatttatttggaatttctatcttccaaaataaaaaagttattccagaatttctggaaaaattagatttttcagaaaaaaattcctaagtccattctgaaaaagtattttataaaaataatatactcaaaaaatccgcaattttttgctctattttataaattttatttaagcttattatcacttttttgaaaaaagttatagaaataaaagtgattttggcattcgggaccaaaggggtgtgaccatgatttctgagtgaaaaaattttttcaacaaaaatcttccaaaaacatgtctttaggggttatttgggccgctgatcacgaatatgcaatcagattttactttagagatggttaagacctcagaatccccgtgttattggggattctgaggggtgggagcgcccgtcctgaggccgcgaagcggccgaacgtctcccaaaaaaattacaaaacgggcgcgaagcgcctgtcctgaggccgcacagcggccgaatatccccaaaaaattaaaa

SEQ ID NO: 28224 - DNA, 939 bp, Heterodera glycines
attaattgggtgcatccacttccacaaggtgacaaattttccgaagaaattgccaccacttttcgagaggagtgggccggatttgaacccaaacggggaccaagcgagaaaacagaggcacaaccaactgagccatgctcacatttaaacgaggggggaattttaattcttttaaccatcatttaaaaagtatttgcttgagaaaattcaaattttagtttgattgacatttccttgaaaattaaaaacataatcctcgataagccatgcttagcttaaacgatacctttttggcaattttttaaattaatttttttttaaattattacaaaatagagaatttatttcttggaaaatataattatggaataatattttttattttttctttaaattatttccgtcctatcatatgtatcaatttgttcccttgagaaaaatcaattatttatgggtaaaaaatgtaatattccttttgtttcattttgttgccaaaaaattatcctcaacaaatttaattataaaaaaaataatatttatgattgattttttttggtaacaaaacaaagggtcgaaaaaattgtaaattttttatttgacgattaaaaaaatggaaagatatattaataagaaattttataataaaattttttaattctcaattttttataaatttttattttttaattatttcatttgccttcatttctccgtcacaaaacgaaaaatttaaaagaaaatgaaaattttaacgaaacgaacactaaaaaaagaaattttatttaattatttttttgccatttttattttatttaaattaatttttttttttcattgttttcatttgccttttcttttccccacccctacacacttcacgacgctgggcttttcataaaatcactgacaaaaatgagatgagaacagcacagttttcag

SEQ ID NO: 28225 - DNA, 1232 bp, Heterodera glycines
  misc_feature (1182)..(1182): n is a, c, g, or t
ggtattcatttctcgtcatatctcttcccttcccaaacaattagacagccgaaaattggaaataaaaatttacttgattatatcaaagatagatagtgattagtgaatttatcttttagcttcgatactcgcaacactcagataacccaaaaaaaaacagcggtactgatcttttcgagcatcccgactataattatttcactaattggacagacaaattgccaattgttaaatatatcatgtattcaggaatgaatttgactattgatcgataattttaagtaattaaattttttattcatttttgtttcttacattttaaaataaacaatttggtatttaatttacggtgtccaatactcccccccccgtctcccctccccaaaatgcctcgtcgaatgggcttcatcttgatgcgcagcccttggacatgtttgattgggtctttcttgtcttattgcgaatccgtaatcagtttgtacagtttctttaggggggggggattaaaagagcaaatacggtaggtgtcatattagcagaccgtgaggaatcgattggtatctaccgtatttgccctaattatcccccaatctttattaatcccccaatctccaattatcctccagtctaggaggggtttgaaaaataatcccccagtctccatttatcccccagggggataaatagaattttcagaaaattatatgccgtcaatttttttcaaaaaaacaaacaaaatcgacagtaaaagtactacaaatgccaaaatagtggcaaagattattgacattttttaaatccaaaattcttgtcaagaaaaaaatgagggatgaatagcttgcaaaaattttgaaaaaattagttaagtttcttaggggtgtatttttttcttgcattttgttgagaaatttttcaaaaaaatgtcggaatagtgaaaaataggtggcaaaatgctaaatttgtggcaaaaaaaaactattttagtggccaacttccaaaatgttttttgtagtggcaagcccaaaatagtgatttaaaaatgccaaaatgacgacgaaaacccaaaatttttcatatttttggggtgtaatttttaaaaatttccaaaaattgaactttaggtgtatttttcacttttttgcatttttcctgggaaaatttgccaaaaatggccgaaatacngactaaaaacccaaaaatggcgaaatatggatttatccccgaaaaccccc

SEQ ID NO: 28226 - DNA, 1460 bp, Heterodera glycines
tcacttggccattgtgttttgttacgccttctgtgatagttgatccatcaattcggcttccaattgattggcatcactctgcctcgttgtctgctgcttgatttgtttcaacttttacccccgggggaataagtagttggctggtgactgggcaattgttggggacggatggatcattggcccattgggaacggcgacggtgccagctgtgggttttgctggggcgaagggacggccaattgcccccatttcctcctccgtcaaagggttctctcttctcgccattccctcgccttcgattgtttattttcttgtggcccatcattttttggcagagtgtcccaaagtcaatcactcgggatgactttttcctcctctcccctcccgccctctccctccctttttccctcctccttaattaagaatttccgatcaaataattacttctttgtgtcactaattggccctcgggcgttaaacgacgactgacagagtaattaaatttttccgacgccaaaacaatggcagaactcatcaccaaattgtgtacgacaaaactggccattttgaaatggcttcaaatggtgcgtttttcgcactccctaagttcggaaacccttccctttttgtttggtcttttgaattttcgcccattccatgccaaaatttgtccgtccctttgggggtgcttttgtcagatgaatgaatgaatgacttttcgtcccccgcagctttgtgccgtcatcaccgtcctttttctgattgacggtcagcgccagtcgtggttctacactttggtaggcaaaacaaacgcatttttggaattctttaccatgccctccctaattacctaattagcaattaattaatccctttctctccctttttctctcgtggttcaaaattctcaattgctctttcatttggtcaggtttttgtcgtttccattgtgttcggcctcatctcgttgctcactctgatcgccaactttttcctccactcgcgcaatcagtcggtccctctgcccgcctttgtccgttttccgtcctatcgcttccaaatttccaaaatcatttatttctccaggaaattggcttcaatgcgttggctgcctttgtctgtttggcatttgccgttttgctcaccatcgattcagtccgaatgttcggcgacgacttcagccaccaccgctttttggtgggcaatttggaaaaatggcaacaaaatgatttgcccaaaattaaaggatttaacaaaaaaagaaatgctttagccaccagcgaacattggcaaggacgggtggcgcaatcggactttggtggtggcggtaagtgaacaaaacagccaaaatggaggtcgtttcagtctagcgagaatcccgaacacccaatcataaagcaaagggattgggttcgatttttaaagtgagagagggacagtgaattgatgccatggattta

SEQ ID NO: 28227 - DNA, 1312 bp, Heterodera glycines
aattatcttttcatttccctcactgcgacccctgtcctccccgtccactttgttttctcgttcgaactctgtttttgaattaaccccccccccctctccctctggcaattacccatacgccccattaatcgcattaattaggtgccgttttgcactgttcctgttggaccactcgtcgaattgtctcgcaaaaggagggcaaaaaagaccacgtgcgcgagaatccacagctcactttcaacgccaacacaaacattttggagcttggagacccaatgccaattgaggtgaagccctcattagattattaattacaaactttttaaccaaattaattctcagaaattgatgtctgctgacaacggatggtacgacgaggcggacgacacggtgacggtggaagtcgaagtgattgtggacgagccgtacctcagagagtcgcggtggcgcgccgtccccgtagatgatgccattgacgcggaaggctttgggaacggcggttttgcccagcccgttggatttggcgatggttgggcggcataagctgatcaatgcttcaaaatgccttttcttacctttgatcattcctttgtttaatcctgttattttaattaacatcaacatttcggctcttatatggcttcgcctgctactctttgctgtcctcattttgaactgcttcgactgttgccatgggtaagctttcggatttggaagcattttgcctcacttttttgcttatttctcggtcaattattttcccatttttcagcagatttcatcctaagtccagcacagttccaacgactacgacgaagtcgcctccacctccaaaaaaagaaaaagaaactggtgtcttcaaactcctcccaatgtgggccaccattgtcatcgccgttttaattgggtgagtttgtctgctgcttttttgccgtgccattttcctccgtctgtccgtcttcaatttgttccccatgttcagcatggtcatcgcaattggcattgtttgctgcgcgtggtggtgctgccttcgtcaacgatatgttcgccgttctgcaactgatgggccctcctcgtcactgagcgacaccgaaaagtcaaagggcggcggatattcgtcgaagccgagcggattgatgtccaagctgcctttatggaagtcgtcgtcctcttcgaccaaaaccaaaatgccggacagtctcaaatcggacatacaaccaccaagggcatcatcatcaaaaacgaaagacaagtcttcgtcaacaatcccggacagcaaatataccatgctgacgcagaagcatgaacggaa

SEQ ID NO: 28228 - DNA, 1840 bp, Heterodera glycines
ttgaaaaaatataatttatttcttgttgtatttttttggtctattggttaatttccggaaattttttgtctgcaagatttataaatttgtaaacaatatttcttcttaagcatttattattttccaagagtaaataaaaattgtttgaagcaaataaatataataaataaatattattgaaacaaattattattatttttattgaaaaaggattatattaaagaaatgctaaaatttggcatttttgtaagaaatgaaacgaaatgtaaaaataaaatggcaatttgaaagatgacgtcaaaatggaatcattgttacataaatgcatacatgtaagcataaaatcgctaaaaatattaaaataaaaatgtgtaaagcagaaaaatttcgataaaattgatgaatcgaatcaatcaatcaaataatatagttgcaaaaatttccatttgctaaattcttatattctactgatattataggattgactgatatgcatatgaaaaaacatttttaattttgtttgagatgagtagaaaaataataaaataagataattttgtgcaaaattaaattattatttatattttaaatttgtcaaaaaatttgttatttaaaaattagttaatcaattatattacttatcaattaaaattggaaaattaataaaataagataattttgtgcaaaattattatttatattttaaattcgccaaaataaatttattgttaaaaatttttgataattaactcaaattttcatccccaattaattggttgaaaaattgatgagaaaatgtaaataaaaattaattgtaatggaaaaatgaattgaaaaagtaaaaaaaaataataatttttttatatttatttattaattcaataattttcattttaaaatattttattttttctaagactgcttggacatgtgcctggaagccgtttgtgtatctgcgcttgctcggcgccattgtgcccccatgtgccgtgttgtggattagcattgagcgcttctttgccatctttgcgtcggcaatatatcggaacaggatttcgccaaagtattattttatatttttaataattaaaaatacaattttttcgggttttaaaagtgtagtcctaaaaaagaagagtgaaccctaaaaataattccaatttagctgtaaatttggtgtgaaaaataaattttaaatttttaaatttgttgttattattattataattgttttaatttgtccatcaatttcaccaaatattatcaaacaataattaatacacttgttacagcaaaattctcggtcaattttctaaaaatttcatataaaaatacaacaaaatcaaaaactctctaaaaatttacttttagaaatttaattataaataaatggcccaagaaaattcgaattaatttaagttttaaggaaagaattttttttgcagttgatttgttatatttgcattttcacatcattacacttttggattatttcccattttttggcagttttaagggaatattttagtgcgaatttacaatttttcgaatttaggctttttttttggcctctttagtgcatacatcttaaaatttagtaatttaatttgaattactaaaaaatggccttaatgccaaaataaataaaatattatatattttttgtgattttatgatccaaaaaatagaatatctcgtatgctatgcctataaattatacattttgaagcaaaaatatcccgtccatttgcattcttgtatacaccgctgtggctgtgcttattgcatacacactatcgtggtacaaccgttgtgttcatgtggaggcatactgtggcag

SEQ ID NO: 28229 - DNA, 1874 bp, Heterodera glycines
aaaaaatcgattttttcaagggttcggttgggggttctcaaacaattatggggagcaaaaatcccacggcagaataaaagtacaggctatagggaagctattccgggaggatttcggtctccccataaatctgggcgcatcgttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaaatcgattttttcaagtgttcgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaataccacacaagtattatttttttaaaattatttttttcatttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattattttttttaaattatttttttcattttatcacccaacgttaaagactgatcagaagctcaccaaatttgcagggaaactg

SEQ ID NO: 28230 - DNA, 1050 bp, Heterodera glycines
ggggggacgcccccggaaaccaaaaaattcgaattttccagtttcctttggggtactcaaacaattatggggatcaaacatccaacgcaaaattaaactacagcctatagggaagctactcccgaagggattcggtctccccataaatctaggcgcatcgtctcggggggactgcccagaaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaatcgattttttcaagtgtccggttggggtactcaaacaattat

SEQ ID NO: 28231 - DNA, 1859 bp, Heterodera glycines
ttagcttctaaacatgttacgctttcgaatgttcctttgatttaacatgtttttttcggaaaatgcccaaattggtcaaccaagatttcgaatatgtaagcactgtttttgataatcaaatgcagaattggcgcaattgaatgacattaaattttgaattttagcccagcataatttttcgggtttcccggtttcgctcccggaaaattttggactctcgcgcttccgccaattttctcactaaaagcggaagtaaaaaattcaatgctaattgtaagaatgttggtaaagaaattgacctcagaacgcaaaatttacctatttttatgacaaaattcatttaaaaaaaggccactcaattttctatttccccgccgcgacgccctataaaaggaggcattttccaccgaccgacccacaaatttctctcatttgtcacaagtacatttattgtgcctaattttatttgtgtcgtcggcatttgtacatattacgacagttcgtcgtcattatttgtgtcttcaccacacactcgtcaagctgctggttgagcgcaatgtccaagagacggcttcgacaggtgtcactcatttggggatgacgttgtttttcaatttgaaaaagtcattcttggcggcatctcatgaatccaatcaaaatttgcgaatccgatcaaatccaatcaaaatttatgagtctgatcgcattttgagtcaaaaattaatgaacagttccgaattcattgaacatttctttccaaatgcaaattttttcggagtttaggcaactgccaaaaagcgaaatttttcggaaattgtaattccgatgtccaaaaattccctggaaatctgttcttccagggcaggactgtttgtcatcaaatgctgatttcttttttccttttccaggaactcaaggacatggcgaagaacccattgcctgagggatgcactgcacggccacttgatcaacggaacatgaccagctggacggtaaccatccgaggccgggccggcacaccgtacgcaaacggcaacttccaactgagcatggcatttccgagggactacccgttcaaagcgccgcaagtcacgttcaccacgcgcatcttccacccgaacatcgacacacggggcaaaggtgtctggacattctgcaaacgcactgggcaccgacgttgaccatcgaaaaaggtggcgtggatttggtggtggatttgatcatgttttaaatggattgatcactttaatgctcttaactttttcaggggaattaaaatccgctaagtgtgtttgattagcaaattcaaaagatttcattgcgtttcatcagagttagcgaaaaagcgagcgaatttttggaatttatggtcttaatcgggcatgaatttgatggcgttggttttgtgtggtatttgtgaagtttgagtgatcaattttttcacatacaatttttggctgcagaaatcgttaatttgtttctctgtctttacagttgtgctctccatcatcgttctgctgaatgacccgaacccggacaactcgcctgtcaatgcgcaagctgccagtttgtaccggactgaccgtgcggagttcaacagacgcgcccgtgagatgacgctcgcctatgcacgatgagatgatcagcacgtctttctgattccactaccaattatgtattactcattcattgtatatattattgtactgtatgttgtaccatatttatttgtgtgccactactgtgtgtctatttgtgtattgtatttgtttgcgtgtatgttcaaatccggtaaagaattttgtgctttttctaggggggtatccaaccttcaggaattttttttcgaaaactttcct

SEQ ID NO: 28232 - DNA, 1490 bp, Heterodera glycines
  misc_feature (570)..(570): n is a, c, g, or t
ttgacaaaaaattattcttgtatatatgcgaaaaatgatcaatttaggattttctcgttgtaattgttattattgttataagtatttgcttttttcttacattcatgaattcccgggactttaagcattcgtttgataccaagaatgtagatattgaacaagtaaaaatttatggccaaagacctaaaagttcattggacgtctaaagtgtgtttgctatatctttttttgtgatagcatttgaatttatttattattcatttttatttaatttatttttcattttttaattttgtattaatgcgctgctattaactgctttttcaccaatttttgttttggcgctaccaaaggaaggtctggaggtgtccgtggagtttcggaatgaaatttagtgggtggatagagcacccatgggttcttaagaaaaatgtttttattttctgcgaaatgagtctgagtgccgagttatgacgtgccaaagtttttagttttttactattaaagaaaaggaataattatttcgttcctttgcaactgtgtaatggtgtagaggtagtgcgttagtcnaaaattttttgtgtcccaggttcgaatcctctacatgcaaattcattttagacttttattttttgttttttttgagcaaggtcaattataaaaaaatttttaatgaatcatctttatttttaattttattaattaaaaaaattcattaaagataatgtttcaataaactttcagttaaaaacaaataaatttttgtcgaaaactttatgagtaaaacttatttttcaaaatgaataaaaaacagaatttttatcattaaatttttcgtgataatgaaaattgactttggcataaaaagcaaaaataaaaattaaaaaaatgaatttgcaagtaggggatccgaaccgggggtttagaaaacgctgactagcgcactaccgctgcaccactgtacacggcaaagcttcacaaacaattatttaatttgtttattcattaaaaaagtttggcacgtcataactcggcactcgtactcatttcgcagaaaataaaaccacttttcttaagaacccatgggtgctctatgcacccaccaaatttcattccgaaactccacggacacctccagaccttcctttgttagtatcatcgagtgactcactgctgcagaaatcctacctgcttagaatgattaaaatctttgattccaaaccatttgagttttagtcataaaaattaataaaattatctttttattacctttacgctatatttttttgctggtgttcttgtgatcactaaaggataaagataggtccattaaaaaaatcaattctttagctaattttttaaagaaagtatgattggggagacataagcgcaaaaataaaatgtcaagaatttattttttataatgagcaaaatttcgaatttttcttgaaaatatgcaaaaccaatcataattttgggtgaatccgaat

SEQ ID NO: 28233 - DNA, 820 bp, Heterodera glycines
catcacattgcacacgtatcatcacattatactcgttccatcacatattacgcgtcccatcacattttacgcgtcccatcacattttacgcgtcccatcacattttacgcgacccatcacattttacgcgtcccatcacattttacacgtcccatcacattttacgcgtcccatcacattttacgcgtcccatcacattttacgcgtcccatcacattttacgcgtcccatcacattttacgcgtcccatcacattttacgcgtcccatcacattttacgcgtcccatcacattttacacgtcccatcacattttacgcgtcccatcacattttacgcgtcccgtcacattttacgcgtcccatcacattttacgcgtcccatcacattttacgcgacccatcacattttacgcgtcccatcacattttacgcgtcccatcacattttacacgtcccatcacattttacgcgtcccatcacattttacgcgtcccatcacattttacgcgtcccatcacattttacgcgtcccatcacattttacgcgtcccatcacattttacacgtcccatcacattttacgcgtcccatcacattttacgcgccccatcacattttacgcgccccatcacattttacgcgtcccatcacattttacgcgtcccatcacattttacgcgccacatcacattttacgcgtcccatcacattttacgcgtcccatcacaatttacgcggcccatcaaattttacgcgtcccatcacattttacgcgtccccatccattttaaccgtccccacacattttacgcggcccat

SEQ ID NO: 28234 - DNA, 1223 bp, Heterodera glycines
gccgggtttttgaaaatttttgccgggtttttcaactggtttgccgggtttttgagttttggcgatagcacccctgtgcgggattcgtgatcagcgaccccggaaaccctatggaaggtattctacccgactctttaaaaattgtattttttttaaatcgtcagacaattcagtcccttcaaagtgaacattttattacttgatttttttggaaaaaaaagcatgaggacgcaaagggaaaatacggcaattcaatggaatatggtaatagaggaataccaagggaaacatggtaatggaggaaggggaaatacaataatagagggaatatcaagggaaatatggtaatggaggaagagagaatacggtaatgggccctataaaaagcggattgttctcgtggcgatgtcatcggacttggcattaatttggccactcgacgtctcatttttcacgaaaatgtaagtgttgcaattaataacacgatacaaaaagagcaaaatagccgttccatcatcggattggccatcaaacatcagtcctcattagctggaaggatcacaatttgccgtggcactttttcttatgagagcgacggcgattgctcaacggaagcccgcaatagaggcaatcgaagaaggaaacggttgacggggacacggtcggatgtggcatcaatttggcaaatcgccatttgttcttcaccaaaaatggacagcgaatgggtcaataaaaaacaataaattatttattatttaaaactaattgccaattttgtgtgtaattaagatctcacttttgtggtggattcgttgccttctgatccgccgttattcccttttgtttctttgggtgattctggcgacaaaattgaggcaaactttgggccgaacttcaaattcgacctcgccacccttctctgatctgataaaaaaagaaatttgttggaagatggcgtattttgtgttttaattgacattttacaaatatttatttttcttttttttaaatttattcgatttttatatttttttaaatttatgcacattcgaaaagataaacaatttttatttttgaatacaaccaaaacatgcatccatctttccaaatacggtcgaagttaagcgattctgctgttggtcggttttacgtgttccatatttatgccatctcgtcggatttattagatttttaactgttttttagcggatagcattttaact

SEQ ID NO: 28235 - DNA, 646 bp, Heterodera glycines
ctggcggtgccggtggcggacaaattgaatttgcctgcgggtgttgtgccaatatatgaattatctttcatcaacacacccccgctttatctctcccctccctgaaaacacttctggattatccaatgaataatctgtccaaagattaacctgagtgaaaaatgtttgcactggttaatatgtcaaaccgtaaaaacgcacaaagcaaattcaactcaaaattaacggaaagcctttacttgaaaaaaaatttaaacccataaaacagttagactcggtaaaaaaatcaaaattttttttttttaattcaaacaataaatttcttgaaaatttgtgttatttttatttatgccacttgtataaaatcatcccccccccccctctccactgctgaggcaggtcgtggcacggaaaacatttttaattccattttctcaccaacggtccagccatggttccgccaattgcttaatcaaactaaacgatgttgggtttgccgtgaattaaaggcaaccaacagcaattcgccagtgccgatgccggtaaattaatgataataataggtggtggtaatctgtgcgcgaccaatgggctttggcccgtgggaaaatcaccccccccccctccgtaccacccccctccctcc

SEQ ID NO: 28236 - DNA, 1629 bp, Heterodera glycines
  misc_feature (40)..(40): n is a, c, g, or t
  misc_feature (1542)..(1542): n is a, c, g, or t
  misc_feature (1588)..(1588): n is a, c, g, or t
atcaatcgggaggtttatcagtgactctgctgttatcaanaaagataatttttgttctaataagaaaggatgctttgtaagctgatcaatcggctgatcactgatcagttaaactgatttcaaatcaaccaaattttaaattgtgtttaaatttgcaggtattacaacggctgatcaaaacgcggggaaagtcgcagatgcgcaatatgaatgtgcaaatggtggcagctgagaaattggcacaatgtcctccggtgaaaaaattgttttgcttattgtctatatgcccccacggaggagatgattagaaaattgaagctaattagtatgatcagtcgagaatagaacttttccgaggctcgaaaaccgagaccgttagtcaagagcagccccaacccgcctaattagttctcgggattctgttcgttcgttttttttggcattaccacagtactgacaataattaaaatcgccgcccatttaaggacgcgttcgacgtcattctcgacgagaatcagctggaggacgcgtgcgaacacctcgcggactatttggagtcctattggcgtgccactcatccgcccgtccgctcgccgccgcgcataaaacgcggcccaatggccaaccgcggaccggtggctgccgcctttacgcccgcccaaatgatgcaggtgggagaagaagctgccttccagcattttcgttcttatcaatcaatgccatggcatttttgatagcactagctgatcatttgctcgtagaacatttatcccactgatcactgaccagggctcatttccttgacatttataaaatgcttaatattatattaacaaaactacaattcttaaattgatcaatcaattaattgggttgatcagtagctctgaacattgcttttcaaaatgttgatcagtgatttgtatcagggatgttacgaaatttttttcctgttcttagtactgagtcgacaatttatctgtaagtcaacaaattcccaaggaaaaaatctgaaaaaatactaaaaatttcctttcttacaataatgaactgagataaaaacaaaatgccgattttcgattgctgacatggccctcaaatggaataattagtaaaaaaacaaagtcgaaatgatgtatgtatgctattgctcgtcggtgttcaatcccaatttagttatttagccaaaaagcgctgaaaattaataaattttgatttttttataccgatcaattaattaattaatcgagttgatcactgctgatattgctttacaaaacatcgatcagttgtgatttatttattcattaaataaccaattggttccttgaataatcgtttcttgagtaatcagcagctgattagcttatgtgtaactctattatttctctttttcagggtgcccatttcggctcgcccttttaccattcgtccgccgctgctcagaattcgtccgccaataacactccgccccaatcgcaacgtgtgccaaccatcgcagtacagcaggtaaaagcgactcgaaaaagcccaattagcagncaagtggccaaaacaacgaaagcaccccgagtctatgctttttggnaccatctcccattttttgggtaattctcatattcattttgg

SEQ ID NO: 28237 - DNA, 1375 bp, Heterodera glycines
  misc_feature (11)..(11): n is a, c, g, or t
cttctgacacnagctgaactccaacagcaaagtcggcgaagtgtcttcaaccgtcccaccaatcattccttctcacaatgcgtccactttcgctccgtctgcggatgaagaagagcatcagcgagttcgctgctcttcagtagttccgttcatcacttcaccaacagaggatgatggaaattgtgagcaggaggaggaagagaatgaggcgaacgaagaggaggaggaccaattcgacagcgaagtgttcaccattcaattgtgccgttgcccgtacacgaaaagcttcggtttttcggtttgcgatggcacagccgacgaaacggcaaggggagagagggaacagcagagacagggcggcatttacgtgaaatcagtggtaaaagacggaccggccgataaaagtggacgattgcagccaggggaccgaattctgaacgtagggcaagcggaagcagcctctggccagcaattttggcattttattttcagataaacaggagaagcatccaatttctcacgtgcgatttggcacttccgttgttggccaccgatcgcgtggaattgcttttgtcgaggaaaagaacgaaaaaaggcggattatttaaaaaaataaatggctgattaattggccatatttatgtgaagagaaaaattcattgtgaaagaacgggaaatgctttgtattgtacaacaaaatcaaatttaagcataaattctgctactttaaattatcatttctagagcccggtagtaaaaaaacacctgaacaatgaaaatgggaattcaaaaatgccgggaacgattcccgcccttttccccgctcccctgaaaatgattttaccgagttattctcgagaaaaagaaaaatttaaacctcacttcaaactttttctgttttatcctgttctaaattcaattgcgaaatccaaattatccagataaatggagcaaaaagattaagaatagctctactttacagaccaccaaacacttctgctagtctcactaaaaagattctgaacctcattggtaattatttagaagaaaattttatcattatgggagattttaacctaaatgcaaaagatataacctggaccagtggaacgaacaccttttgctaaatcggaaaagggaaacattttttgtgaattttttaataagtatggcttatttcttatgacgaacggaccaactcgaggcagtgcttggcttgatctgattttctcctctagtcctgattttgttaataatgttttaattgaggatatttttagttctgatcatcttaccactaacttttcattatcttttcccagtaatagaactaaaacaaatacattactgtacgcaattataattctacaaaact

SEQ ID NO: 28238 - DNA, 1240 bp, Heterodera glycines
cttacgagacaactccatttgctccaggctgtccgggttggcctggtgctccagaacgtccgggctgtccagaaggtccttggggtccgggcgcgccaggcggtccctgtcctccgcctggagcgggtgaaccaggttggccgggggctccttgttgtccgggcggtccctgtcctccgggacggccaggcgggccagccgggcagcgcgggcatgggatgtgctggggcgcgcatggagcagctgcaatcaatgtaggagtgtgaagcaattaccaatcaatcattcaatcctaccaggttgtccaggtgctcccggctgtccgggctgtcctgcgcctccgggctgaccgggttgacctggcgctccggccggaccaggtgggcccggggggcagcttggctgttgcagcggaccgcattggcaatggccgggcagttgacgcttggcacggaagatggagctgaaggggttggcacggggcttcgacggcggtgacacggccacttgcacgtccatcagatcagtccaggccgagtcggtgttgacgcggaaagcctggcaaagcatatatttttaaattttaattgttgttacctcaactccagcgtgcactttggtgctcatttcgttcatctccgagtacagcgatggcaaagtgacgacggtggcgatgatcgccaacagagagcacaccgtgccaatgcccaggacaatgtgagtctcttgcatattttacgctaaattttgcgaattttcaattttgagttaaaattttcaaatttaaaatgctttttggttggatacaattttgtataaataaatcgaaatgtgcattttatggaataaaatattttgagttgatgagtaaaatggaattttttggttccttttaaaaattaaattattttttcggtagaaacaaataaataaattttagaaatataatttatgtttaagtaaaaaccgaaatgttgttaagagaatgaagaaatgctggctgctgataaggcgagaatgtgtccccttttatattggcacatttcttacttttttgcccattcgtcccgcggcgcttcctttgtccctgctgattgggccgttccccctgagggcatattctctcctttccgctcttacgttgcgatttggccgtttttcgtccgctgtgcgaaagtgcctttttttgtgccccccccacctccaccattcattccctttcatttctccattttattca

SEQ ID NO: 28239 - DNA, 1446 bp, Heterodera glycines
atttgactatgtcttctcgctgtttttcttcgattcattccattttccttttgagttatacgattgattggttggtaaattgattttttatggacgaaaagatagaaatggtacttattccttttgtgagcccctgaataaattttaaatattctaaggtacagtaaagccgtgaagtcccatacccagtgcttaatgagggatttagtccagaggagccctcttacgcgtccgtaattaggccccgcagggcttggaagggaagggatgatgatggagcgctgggggatgaggggaaggcggggatcgattggccgttccactgagatgactctcgactgatccgactgacccctttgactggctctccaatgccttttaagcgcccctcgggatgggaggagtctatcggagaaataaatggccgtgggaaattgccatttccggtccaggccttacacctccgaccctccaaaagaccgtccctggtcgttaaaataatttccaaaatttgaatgaagtcctcagaccttttttaaacttattttaagatgaaattttttttttttgagttgagcctaaacgaaatgatgaataatttgataatttatttaattatttaaaattagaaatggaaaatgccgtgcccctgattggaacgaactcattcctccaaccaacccacggcagctctaccattgagctaccaaaacaaatccacctcttttttaaccttctttttttttgaccatgtttctgaaattctgattaaatttaatttgaattaaattggttactgattttcgaaatatgagactgataaaatttgccaaaatttgaaagtttaaaaattagtttaataattataaatttaatgtttcgcgtccaaacgactgaagtttagatttggatatatttcgcggtgttgagtccgagttccataccacggagtgatttgaccaagcgtgaccgtatgattatacctccccttcatatcagcggatcgtccctgatccaaaaacttaaatcccacgggattcatgtaccaatccttcatttctttaattaaaaaaaagttatatttttttttgagcattttagctttgagttatcaattctcacttctttttttaattcattaattagctccgcagggcttagacagaagtgtgtgagtaatatgagagtctgttccaaaaattgcaaagacttagcttttatatttaaataaaattaagatgtgttaaagttcctcagaactgataaaagagagataaagcgacaaatagtcccgcgggacttattgttttttaacaatttatcattaattccggaactgatcaatttctgttggcatttttcaagttggtgtggcttctcatggttggtccacatacttaaaatatagggtgattaaggtgtgagaaaatggaagtgtgctttaaa

SEQ ID NO: 28240 - DNA, 1217 bp, Heterodera glycines
accaaaatcatgtgactttacgaaaatataaaccaaaatcatataactttccggaaaatacaaaccgctgcgaaataaaccaaaatcagatgactttccggaaaatacaaaaggcttaggaattttaaccaaaatcatgtgactttacgaaaatacaaaccaaaatcatataactttccgtaaaacacaatcaattataatcaaaatcttgacttttcataaaacctaaaccgcttcagaattaaaaattacatttatagacagcaatgaaaacagaaaaccggaagcacaaggttaacgaaaatacaacggaaccgggaccgttttacaaaccagaatcatgtgaactttccgtaaatacaaaccgctacatataaacttcggaaaatataacccgccaaggaatgtaaaccaaaaagcatatgactttccggaaaacaaaaacctctacgaatttataataaactagaaataaataatttaccgaaaaacccattaatggaatataaaatttttttgagaaaattttcttcatatattcaactatttttaattattattcccattttgtagccatatttagtgtttatatatatatccgatcaaattcagaatttatattcatcgaatttctgaagataattttttttaaaaaatttcaagccatagataataatgaaaaaagaaaaaatttttttgaaattatgcaacaatttttagaaaaaaataaaaattcatccaattaaaatttcaagttcagccaagcagtccatcatccaactgctcaatttttgttttgacaaatttgttcaacacttcccatgccacaatcactgatttgttatcatcatcattatcattttcatcggtcgcgtggttcacgcccaatttaaaaaattccgccaaatttttgaagaacaatttgtacattttggcatccgaaagcaatttgagttcatctggttggcgttgtgccacaacaaaattaatcaacgcattaattcgtgggacaattggtaatctgtgattttaaaaaatggaattaaaaaggtaggaaaaatggaaaaaacggtacaaaaagtaagaaaaagtcttaaataattgataaaacaggttaggctaattaaaacttttagagaaaaaaattaattgttaaaactttgataaaaaacagtaaaagtaagaaaatgggaaaaataaatttaaaaaaaattcaa

SEQ ID NO: 28241 - DNA, 699 bp, Heterodera glycines
tcttaaatttcccaaattttgagaccattgtgatgaacctgactcctgctccatataattcactggcacacggcggcggaagttgtaatgtcgttgattattatgaccactgtccattcattttactgcaaaatggaacaaaaacctgaaaaatttgagtcaagactttccaaaattaacacccagtcaaatgcttttgtccgcgtcagcgccttaaaaacgctgtccaaaaggatgggtttacgtcgtaacccaggagcgccaagtcgtacctctccgggtgcgggataagaaaaggggtgggactgactgtattttggacgattggggaaggaaatgggggtggtcaggtaattaaaactcagaaacacaattacggggacaagattgaatgcttagtcaagatttaacggagttgaagagaagcggagagaagacgaagagaattgttgccttacaaattggcagcacctcgtagtcaaaaagtcgtctgatgacaaacactttgtgatcagaacaaattaaggcgatttgaagaacaatttatttttaaaacacggagaaaaaaagacaaaatcggagaatatcaagaagtaactaaagacgaataaaaaacctcaaaacgaatatgaaatttaaacacaaaataaacgcgaaaagtcatcgttttaaaataattaaattgtcattcccagtacg

SEQ ID NO: 28242 - DNA, 1566 bp, Heterodera glycines
ttttgagttaaaaattggaaatttcttcagcgatgccatttgatcagctgagacattctctcccaatcgccaaattcgtcgcctttttctttcgccccttgcaaaatgcttctgaattttgaatttattccaacatatttcacgtaaatgaacggctttttcgttcccatttttgccttttcttgtcattcaattgcattttgcctcggccgacccttttgctcagggcaatttggcattggtattcgatgccaaatccggaaggagctcggaaaacagcgcacagatagcaaatttgagcgctctttggagtcaggccacttccgacggaagtgatcagcttccgatcaaaagtgcccgattcagtaagcatcaaaactgaactctttaacaattaatcggttgcttttcaaagtttgtaatgcttccattaagtccaattgcaccctccgccgctccgacaccaccaggccaggtccgtcttctcatccccaaccgatcagtggtgatcacccatcctcgcctctccctttcagactcagtcccgaagggaatcgcgcttttctcgactttggcctcgtgcccatttccgtcattggcaaataccgatgtgaaatcacaacggaggacgacaaactcgtcacgggcaatttgtttgtgtacagtaagcgaatccgaccattgcttaaaagtggaagcaaatccaatttgaagtgcgacccgttttggtcgcaaatgcatcgatgagattgacccaagcggacgaagccaatgcattcgcatgggtcggaccgacaaacaaagcgacggccggcgaaactgcgactgttcagtgccccgtggcgggttacccaaagccgacactttcgtggtcgaaagacggaacgccaatcagtgagaaaaagggacagaagcagtagcaaaggaaggaatgatggaaatgttgacagatttgagtgccattgtggaggacggagaacggccgcagctcaaatatttgttggaaggacaaaatttgcgaattcgaagagtttgtgggaaggacgagggcatttacaagtgaataggggcacaatcaccggaggggggcgggggtgccgaaggcgcctcgggcattgccaatggcacaggccaacatttcgggaggacggggctctcccccgagcattctttgctcacttgccaatcgcatttcctcaatcaatccatcaggttttttgttgttcagatgcgttgcgcacaatgaattttcctcaaaggttgacttgccgaaggaacggcacgaactcagtttggagcagaatctgcgcgttggcagtgagttgcccacgtcgctttcctccgcaaatgcctttctcccctccaaaggttccctctcgtggctgcccccgcttttggtgatcgtcgtttgtttgctcttgctgatcatcattatctttgggtgttcagcctggaagaagcacaaacagaagcggtacaatgtggcagaaaaagagtgagtggaaagttaagagagagagagacacagagaaagagagagttaaggaaaaatatgggcaagagaga

SEQ ID NO: 28243 - DNA, 1614 bp, Heterodera glycines
  misc_feature (1209)..(1209): n is a, c, g, or t
cacgaattaaaaaaggcttttccatgtctgacgtttgcttgataaatatgtaatttaagcaacaaaaaaagaggaaaaatttcttaggaaaagcctcaaaaaatgaatttaaattataaagagttataatattttgaaaaaatctcgagtttcggctcgagaaaagtcttggatcttttttttgctgaggtcaagtctttttctcgtgaatttccatctagaacattatacatattaaagactaaatcattcatttatatttttctgtatcaaattagagagttgaaacccggatccttggaagccccagtattttgctcgagtcgagaaggttcgagaccaagactctcgacttcactaccgccaccaaccccttcccccttcctctcttttcccacctgctgaagtgccgttttacttggcattgcttcaccctcgttttggcattaataccttctttttatacaataactttgttgatgttcgaacaaaccctatgtttttggtatcattcgaaagcacaaaggaaagaagcaaaaatatataaaatctcagcgtttaggcaattgccaaaaagatttgattaattaattaattgttgtttggtcgattggactcataaagtgcaatagagccgaacttttctgtatcgaatttagaattgaaacgctcatcccgaaaagtattttgctcgagtcgagaaggttcgagaccaagactctcgaacttgactactagcgccaaccccttcccccttcctctctctccccacctgaagtgccgttttgcttagcattgcttcgccctcgttttggcattgctccgtcagctgctgctgttcgttctgttccgtctccaaaaacaggtcaatgaagtcgactttcgctctctgctgctgctgttgttctccgctttccctcagctttttgcgtgcctttaattcgtccattagctgcttcctcagtataattagcgggtctttgcgcaatattccgctccaactgatgaacggttccaaaaaatgaatgccgaaccacgggaaagcgaagccgacgtaatcgaacggagtgttattgtatttttgcatcgactcaatcgccaggtgtgccatttcagtctcaaactgtcgcgactcgcgctgccccaacgccacacgggcgatcacatcgaaactcatttctacgaaatgcctacaaaaacggggggggnggggtaaataaattttgactcaaaacattgatggatttaattgatataatatccgaataacttggaactgaggcacccaatcaaagcacagtttgtccctaccgtaaccgtagggtcgtgaggcaaaaaggtatggtatacggtatgttaaggttggcgactttagaaaaagttacagctaatagagaacatttatttgttagtgcaattgaatgatttcaaaaattaaaaatttagttactcttctctttagcaaaataatgtttggcaaattttctatttgatgggtttgagaaacgtccgtcccatggcacctccgaaacggtgcgttatcaggggatggttgcaaaagaaaaaataaaaagcgaaaaaagcgaaaaccaaataaaaaaagcgaaagcgaaa

SEQ ID NO: 28244 - DNA, 1559 bp, Heterodera glycines
tgtcaatatcccatatatagtaactatcgggcgcgtggcacaatgcgacccagtcccaattcactgggccataactttatcatttctaactgaaatccctcccaccataaaaattggcactttcataaaattaaaatttctctaatgacaaatgcttgagttgcgtgtcgtcatatcggtaataagcaatgtgcaaattctggtttttgtggttcatcttgcgcatggagtgacgctgccaatgcttgttgttgcgtggggcgaactgtaaacaaccaaccaaccattaaacaaaaatattttgaaaattatattattaattaaacattattatttattaatagggttgtaaattatatggactaaaaacgctaaatttggacataaaatatggactataaaaaagcccaaaatatggactaaaaatctcaaaaatggccaaatatggaccaaaatatgggctaaaaacttctaaaatttacattttaaaacctcatccaaaaatgtgtatatttcaatatttgctttaaaaaataccctataaactaccaaaactcagaaaatgcccaattttggaatgcattttttaaaaatttcgaaaaaagtctatccttagggctttatttttcacttttttgcatttttcttgtaaaaattttccagaatggccgaaatatggacgaaaaacgcaaaaatggcgaaatatggatttttcccaaaacccccaaaatatggatttattatgtactaaaaacctgcattaaatcaaaaattttaacgtagaaagaaaatttttgaggccctttctttatagcatatgcgcagaaaaatatgttaatccatacaatttactaccatatttatttatataaattatttaatttcaataattttgttaaagagcgattatcaatcctactaattacatctaattaattagatcttttaaaaaatttttagccaactgcatgagaagcaggacacgtacaaacgggacgaatgaagcgatttcaatcgtactaagacaaaccgaaaaaaactcattgtggccgacccggaataacccaatgtaaattccgcttgttaggccttaagcaagccgtataaccatgatttattcaattctctaatttttctggttcacgcataacattgaagtaaataaaaattttattaattttttaaaataacttcaaaatacttccatacaaataatgagtgtaataattatatggatttagttgatcgcataattaaatttaattatttatcgatcagtgagactatttctgaactcccaacactaagtttttttttcggttacaccgatcactaatttgaatgccgtggagcagatagaaaattacataagaaatttccataattaaatagtgataaaatgataagttcgaaaaaagttttgttcaatagcttatatattcaagagtggcaattgatctagagcaattaagataattaatgttggagtcagatatcattttttggcccttttacatattaaattgtattatgtattaatgaaaaacaacgcaaatttg

SEQ ID NO: 28245 - DNA, 300 bp, Heterodera glycines
cattttgtcagaatgtccagcagacgaaaaggggcgccggcccgtcgactgaccaccccctcagttttggcatcgccttcgtcccccaaaagcattagcccaatttccctctcacatccttcctcttcttgttctacagcatttgcagctgattctaatactcttctgcttgaacaacaggtgcatttggacaaactctaaaaaatagcttataatttcaccccaatttaaaggcttcgacgagcggagaaacacaagaaatgatggactgctcgacattgttggcccaaatggcggctg

SEQ ID NO: 28246 - DNA, 1475 bp, Heterodera glycines
  misc_feature (16)..(17): n is a, c, g, or t
  misc_feature (28)..(28): n is a, c, g, or t
  misc_feature (80)..(80): n is a, c, g, or t
  misc_feature (108)..(108): n is a, c, g, or t
acaaaaattttatttnnaatacattttntaatgtaactcttttttttattgtattcgtcgctagtttaatgcaatttttntattatttttactttacccattaatttntatgagtccttatttcgaaacatcttttagctcttttttttaatacacataaacttatcttattgattaaaatgttttttgacttttattttttaaatcagaatttctgaagagtctactcaatgctcgggttttgtattaaaagctttttgaaaaacaatgcaattttgaaattttaaatcattttaaagaaaagaaattaattttttgattaattttgtttttaatatattttaccaatataatcacatttgccacggtaattttttatatatttatatattaatttttatttaaaataaaaaacgtgaactttcaatttagtttttattctgatatttaagatttattaaattactaaaatttatgcgcatcgcagtgcacctcacggggtaggtaggccctcttgacttagaccaaatctcgcaacgtcaccttcgtaagtcatgccgcgagccgcattataatacttaaataattcattatttccaattaaattttaaaaaaagctcatagcaagatgttggcacggctataattttataaaatcatttttttaattgagtgccttacctgccgcttagcaaattttggtagccagtccgcttgcactagagagtaaatagctcaaacaagaaatcaagggagaatgcgcgaaaccaaaaagatattttaaaataaaaaagcaaatgagaattgcccgaatatatatatatatatatatatatcaggggtgtgacttgtctcagaaaagacgagagcgagagtttggcgagaggcgagagtccccaaaaagacgagagcgagagtttggcgagagacgagagtccccaaaaacacgagagttggcgagaggacgagaggcgagagtttttcaattttttctgtagccttatttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtccattttttccaccttttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgtttttccaaaaaaaaattttttggaacattgggtgcgggggtcc

SEQ ID NO: 28247 - DNA, 962 bp, Heterodera glycines
tgttcacgtctgagttctggtagaaaaatcaaagcaggaatgccagtaattcaggctctcctccacagcatgtgaagcaatggaacgcccgagttacggtctgtaaaatgtgtattagaatctcaagttcgtgcttgcacaacaaaactacgcagccgagccgagctagtaacgtaagaacacgtcacaagtacatgatccctcgaagcaacgcacaaccagtgcattttattgtatggaccctgcaccaggcgtgtcaatggatgtaaattcaatggtgcaatgagcattggaatggttcgtgtataaggcttctgcagttcgcaattattattgcagttggcgaagttgatcctagattcgagagtcgagagatacaaggataacattatataatgatttttcgaggtcgctgaaaacggttataacatccattttgaccaattaaataaccttaactcgagaaatcggagttttttttcagcaaacacaaaatcatcaaaatattggccaaactgccgagaaatgcgtaataaaatttgcgctaatttggtggcatgtatctaggcttaggcttcagcttgcctaggcttagggttcagcttaggcctaggcttaggcttcagcttgcttaggcctaggcttcagcttaggcataggcccagtacgtattcagcgacctcgaaaacccataaaaatatgttttccttgtaatttatgaatttcaaatttatgttcgaattcgggtttcggaattttgaaaaataaatgccatattcgtgatcagcgccccaaattaccctagaaatgactttttatttgaaaatttcaggggggggtcacaaaacagaaaagtacccattctgctaaccatcccattattaacattgttcttttactagtatctccccgcccacccggcaaaaggatgagtcatttttggccaatactttttagcctaa

SEQ ID NO: 28248 - DNA, 828 bp, Heterodera glycines
tttaggcttttacctatttttttctgagctctctaccctcttgaaacgcaagaaaaacatttatttttttggttgtcgcctaggctacttctcgtttagtctctccggataaatatgagatattaaaatccaccaaatcaaaatggaaagactttaaaaagacaaagaaatgagaatatatttgaaatcccaaaaattcttcagcacatataaacatctattgttttcaaacattctcagctgatgatgccatattttcaggcttcttgattaatgatgtatcttcgcggcgaatctgaaaattgtgaatatcaaacagcagggccccgatttgatttatttattaaaagatcccaaaatatggtttaaaccttaaaagtgcctaatatgtgctaaaaaattggaagaaaaaagttgtttaaaacagcccatttttttcagaatgcttaattttaaatattgtttatttattaaaaaaaattttctaaaataatttttatgtgccaaacccccaaaatattttgtacagtaaaaaaaattatttttttggaaaattacacgaaatgcttttggaatttctttttccatcgtttccaattgttcaattccgatcatttgtttcaagaatttggtaattgcatttttcagctcattttcaataaaggttgttgtgagctcgggcatatcttcctcattttccaaaacggataaaaattctaaaaagaatgggaagaaataattaaaataattattgtacattgaacagaatactgtcggtccaatagggaataggtacataatccaagataactctaaatttttcttgat

SEQ ID NO: 28249 - DNA, 1507 bp, Heterodera glycines
  misc_feature (1484)..(1484): n is a, c, g, or t
tttttttttatttaaaaaaaaaaaataaaaaaaaaaaaaaaacccccccccccccccccgaaaaaaaaaaaaaaaaaaaaaacccccccccccccccccccctcttttttttttttttttttttttaaaaaaaaaaaaaaaaaaaaaaaaaaatttttttttttttttttttttgggggggggggggggggggagaaaaaaaaactccccccccccccccccccccaacaaaaaatttttttttttttttttttttttgggggggggaaaaaaaaaaaaaaatatgttttttttttttttttttttttacatccccaaaaaaaaaaaaaaaaaaaaaaaaaaaaaaaaaccccccccccccccttttttttttttttttttttttttttttaaaaaaaaaaaaaaaaaaaaaagaaaaagggggggggggggggggggggggggggggggtgtttttttttttttttttttcaaaaaaaaaaaaaaaaaaaaaaaaaaaaaaaaaaaaaaaaaaaaaaaggggggggggcggggggaaaaaaatggaaatattagatttcattagcattctggtttggaaatttttatggatttctcatgaccttcaatacgagggagtatcttagaaccatattagagcccctcttttcctcgatcttcaaagagaaagtttcaggagaaatattatatttttccccctagaaagccccccatattctgaatgggaattaaaaaaggactggaaaaaattcaaatatttatccctagatgctagagcatttccctcagctcatactccctggctaacatttctttatactcttttctgaaaccccctccaatcacctttcgaaatggtgtgtcgggggaataagatcattgaagcggggggagtgagggagaaagaggggagggggaggggcaatagagagaggcaaggggaatgacgaaagagagggtggccatctgctgaaggacttcggacattaaattgggagggggtggacactgacactgactgccgtttcgtacgcattgcgtccgctgatccgcttgatccccccccccccgcctaattattgctgctgatcacagctgtcctccacccgaatgtaatttaatgcctttaaaagacaataaaataatactaatttcactactgcgatttaatagcatttgaaaatttaacattttttgccccttaaattagggtagggcccaagatcccgtaaaattattgccaataatttacaagtaaatatatttggaaagctttttgactgtctgacataaggcaaaaattgagaactccgaagcctgaccccgatttagctaaccccgactttctcacccgccgaagggtcgggtccctaatcctcctttaattttatatttacattcaattatttctctctgttggtcaaccaatgagcccaatttcaagtctcaaatgcttcttccggcaggcctatttgtctcttccngttgcctaattgtcccttttccg

SEQ ID NO: 28250 - DNA, 1139 bp, Heterodera glycines
cccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctaatgatgaccaaggacaattattgcgcttttgcggatctgctgctgttgcaccaatctgagtcaactttccgtcgatggattggacaaagttcgcccgcttcacaccgaaatttgtcgctgagaattgagcttaagtgggaaaattgggggaggataaaacggagacttgaaaaagcagcggagggaatgagacacataagaaggagaaaagaaaggggcgaaggacatggaaaagtcagcaaaaacgggacgaaatatttgaggcaaaaatgggttggggggagtaagttaaaaagcaaaggaaaagtgccgggaaagggactcatttggcaagaaatgaaatgccaaaattaaaaagaaaatccgaaacaatgctaatagagcaaaagcaaatgcatcgccgcgcaagcgattttgtgctttatttggcgatgaatgagaaagagaaatgaacagaagaaaggcgaaacagagagaaaaaagaaag

SEQ ID NO: 28251 - DNA, 1041 bp, Heterodera glycines
  misc_feature (1032)..(1032): n is a, c, g, or t
tttatttatttttatcataaatatttttgtatagaattatttaaaatgataaggaatttttaaaatgaacaattttcagtgaaaatctaaaaattgtcgaaaagttcaaatttgtcctccggctccgggtcccaaaaacttattttttcttacaaaaaatttggggtaatactttagatggtgggcccctttttggaaaaatttttttctgttataaagttcgtgcaatcacgttctatggggtccttaggctcgctgatcgagaatatgtcactcagaatgatcaatttcgaatccctgatccgaacccgagaaaaagttgaaattaaaaattctcacttttgttccaaaattgaccaaaacaagctaaatccaggcaaaaacggtctgcctcagttgggcgcgcacggttgggcgccagcatgtttttccattataactttctacaacttttttctttgtcaactaaatccaatcttgttggtatcgtttgaaagcttaatgtatttagaaactttttctaagctattgctttgcgattagacaaaaccaaaaaagttatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtgatcaaaagtgttgtcccatttcatttttaaaatattgcttctctggatcagcattaaaaaaatctaaaaaaattcaggtaagcataactttggatgctgatcaaaaaaggtagcaacaccaagttgatcagatcactccttcatggtgatctgatcagcccattttggctgggaacgaggggcaaatttcaaaaaaaatttctagggggttgggaaaatttttctggaaattttgagtaggcccattttatagagcacaaaatntctctacaa

SEQ ID NO: 28252 - DNA, 1087 bp, Heterodera glycines
gctaccattcactacaagagctgtacaaggacaaagaatttataggcttcctgtaccaataataccctcattggcaagatgcccatgaggatatcatccatacaaattttcttattttatttttgttcgagtccgggtcaggggttcgaaagtggcaaaaatggacgctgtattcgtgatcagcgacccccaataccccttaaaacttattttcactaatttctaaaacacatttattggcatctgaaaatgtatgtgaaaagtacccggtaaactagacaagtacccatttctcaacaaaaaaacaccttttttccgtccgggttttcggctcgtgtcaaaggacaaccggcatttccgttggatttgaaatcgcataacaaaatgggagacgacttggacgcaattgcgccgctactgttcgacttttgaaactgttggtcctcagtaatcggtaaattcgtcccgtttttgggcggtgtcggacgttgccaacgatccaagaagcgttccgtttctaaaattgaaagaatcgtcaaaatcggcaattttcacaaacaaattaccggtcaacatggcagcctaaaattgccacgggttcagttagagctgttccaaaatgaagtcacaatcaatcagccaaagaaataaagaaaatatccttaggaattataaacaatagaacattgaaaaaaggtaatcaaacagataaaactgaattgttgagactatacaaatataaaagtaaatttatatttatcacagggtaaaaaaaaagaatttattttatagagataatttagaggatgatttatgaccaaggcaaggaaatgatacaaaaacataattgcctggaatggtttcgatatgtgtcactggtgatgagcagctgtggtggtggtgatatttttatgaagcagcgcaaaataaagaaaagccccgagaagagaccctcccaaaacatcggtcgggaaatgccaagcatccgtaatgcgggaaatacaacaaaccagagtgaaggcgatataagcgatagaaacaaaaatgaacagaaatctcaaaaaaagagtagggaatcgactctgaa

SEQ ID NO: 28253 - DNA, 891 bp, Heterodera glycines
ctaaattgatttgattgagatatttttaggaaataccccaacccgcccgcaacgtcctattttttacatttaattcccccccgattgtccaatgtcttattgtccacttctgtcggattgtcctcactgtcggattgtccaactgtcgccccctccactgtcggattgtccactgtcggattgtccgggagccctttaatttggtaactgaagcaaagcaaagcaagaaaataagatgactactttttgactctttaaattcaggtttttgccaaaatctaaatttatcagcttttttcattaatatgaaactcgcttggattgttaaaattttagaaatttatcccaaaatcgtcaaactttcatttctttcggcattctttgcaaaaactttcacccgagctaaaaatccttggatctaaacaattcggattcggaccaaaattcctatccgggagggaaccgcccacttcgccgccgtttccaacaacttttctcattataaatcgctttttacagcatttcataggctttcttacaggccgcgtccggttcccggtccatttaacaataaaataaaagtgtaactgaatgaagtgtgaaaggtgaatttgggtttggggtttaatgcactttaaaaattgtttaaaatcaatttcgactaatatttaaaaaaataataaataaattattcaaatgatttacctcggactgaaaacggccctttcttgcaaatccaccacatcttttttcgcttcagatcaccacgttttcaacaattttcttgtttctcccttcgccaccgtttaaatttctctcttaaaagttcgtcagaaaaaaaattgaacgtttttcgtaaaaattttgtcatctgaggggtgggtggggggg

SEQ ID NO: 28254 - DNA, 697 bp, Heterodera glycines
attttttctagtctaatctactcaaaacggttcagaattcaataaacataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaatacggttcagaattctaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattca

SEQ ID NO: 28255 - DNA, 1491 bp, Heterodera glycines
tgaacgaccttttgaggggagaaaagggaaaaaagaaaaaggaaaatgaccacccattcactccgaattataataatacaaaaggggcactgatcgaacgaacgaaagaacaaaaaaaaggaaaagcattgaaaggggcgattaaattgtgaataaaaacaataaaatttctttccctttttatgggttttaaaatgcgtttgaatttttcattgttttcttttatgcgtttcctttttcgcccattttcccatttttctcccaaaacttttcaaaaaagtgaccgattggcggcggacatgcgccaatggaactgatgaaaggaaaataacaaaaatgcgccgaattatttattttgaggattcccaaattaatttcatgaaaaaggcgaccatttgtcagccaatggataattaattaattaattgcccaatttgcgtttgtttgccttttgattgattaattggacggcaaaacgatgggtggcaaaaacaaaaagcaaaaaacaaagacaaatgatgggaaaatgacggggaaataaatggagggggggggggggggggtttgaaggcatttatttattaattgcttttctgccgtaaagaaaaaaggaagtaaaaatgattgaaaaatttataaaaacaaataaataaataatcgattggttttattaattaataatgttcagcgttcccatttgcctttgtctgatcactcgtgccttctcggcgtcggcggatcgttggaggctgctgcgccggcgatccgcgtgttcgaccgggggactgtgatcactgcgattggcacggcacgggtggacggacatggactggtgacactcggcacggcacggggagaactcatccaggcaaattggacaaatgggaatgaaatcggaacaggcatttttaagaggttggggaatcaatcccgatcattcaaatcaaattatttcctccccatttccaatggtaaaatccttcacaattttctgtgccaatgccaatgcgttgttttggcgttgcgccaatgtttctcactttcgccacccaaccaaatgataaataaatatgaataacatccgtacaacacattttgcccacttcccgtgccattctcctctcattaattttgtttgtcttgtgccttttgctttcatgttatgttggacaggaagggcctcggggaagggtcacttcggcactcattcgcctcgggggagggcaaatgtctcacggcggtcactccctccccccatcgccctcccacccatttttgccttgtcaatttccgttcccgaagagactgaggtgtgaatttgtgagcattgagccccaagtcgagatgggttttgatggtttacgatggttctgatgggataagccaagccaatggaaaaaatgggaggatgccaaaattgacatgattaatgcgagtaatatggtcatacagtgactcgatatggaccaaaaaacaatctgagaattcctc

SEQ ID NO: 28256 - DNA, 536 bp, Heterodera glycines
tttctttctctcttttccctcctttctttctctctctctctccccccttctctcacttcccttctctctttctctttctctaactccctctttctctctctctcccttttcctctttttttctctctccctttccgtttcacctgaagcggaggccattcgtccaaaagtgcgtaaaattcgctggtatttccgcggtcgcgccacaatagtgcacagtcggcgaggacaggcaacatttgggggaagagagtgcggattttgtggcggaggcgccacagaaagcgctgctcactctcagacaattgggtggagtccaaacaacggcggagggcaaccaaatggtccaagtcggggtttcctaccttaaagaattgtttgactgcagcggcatctatggccggtacaccccaaaacacagccgagacataacacagccgggaataaattttttaaaaattttcaaacagagattttcaagaaaaaatcgctgaaaatttcttgaacaatctctaactttgaaaattttaaaaaatt

SEQ ID NO: 28257 - DNA, 1071 bp, Heterodera glycines
  misc_feature (32)..(32): n is a, c, g, or t
cttcaaatgccctcccaatgggaggcggtgtncggtttgcgctctagttttcaaatggcatctttaatttgccatcatttgccattcggtcattcattcccttaggccatgggtctgttcaaccatgctgatcgggcggtgatcaaaaagcgcatcaaagcgatcaaacagcgaattgaacgcgaacggaagcaattggagaaggaggcgaaacagcgaagcggcggcgtcaaaattgtcagtgtccaatgaaaaaagcaccgacggtttgatcagatggaatgaacaaatgaatggatgaacgatcggatgaatgaatgaatgcccttctctccccccaaaaaagcgttgccataagaaaaacagagagagagagagagagagagagagaatacgatattccaaaacagttcttccattactgtacgttcctcttttcgaaagcattgcttttgcgcctaaaagcttgtctaaaactcacattgctttgattccgtttttgaattgttcaaaattcgctggcgtttttccgtcaaatgaattaattaattaattaaggaattaattaatagattaattctccgtgaaaattcaatcgcaagcaatgcttttcttttttcagcttttttcccatttcaattttcttcgagtgtttctgatcagattcgtgccaatccgtcccccccccctcccccaattctttttgtccctttttgttttcttttgtccctatttattttccttttgtctcccctacagtattctcccataccgtatgccccttttccatccaccgatctttcactgtgtatgacaacaaaattatcacaccaccagcacacaatgtgtaaatgtaaaagttagagcggaacattttcaccgtgcttgttcatttagttaattaaggtaattaacacgaccatttaaaactctgcatttccctaattaatgtttcattgactatttttgtttagtaaaattttaagataaataaatatttatttattcatttattaattcggtcgattgccaaattggcaaaataaaaagcaacaaatgatcaatgaaaga

SEQ ID NO: 28258 - DNA, 2143 bp, Heterodera glycines
caaatatgcacataaatcgcgaaatatgcacaaatatgcaaaacatgcatatggaaagtcatcctagaagcttcaaatcaagctaaaaacatgtttttcgtgcgtttcaggcttcccgcagtccaggaaaaaaatatgcatgtgcatatttttggcatccctagtgatcaaattatgcaatttttaggttttagtctattttttcttgagctccaagtgacctgaaaagcatgaaaacatcttttttcggttgttgtcaagctagttttcgagtttttattaactattctagttttttatttttagcacctaaaatcctaaaaaaagtttttcaaaaatacaccccaataatcggtccgaaaattttcaaaaataaacgggactaacgggactaaatttcaccagtgaaactgccccaaatttaaattcgacactgagtattttcgacactaggtaatttcgacactacgttttcgacatagagaaatttcgacactgaactattcaaaaactttcactgttttccagcattttcgacactggaccatttcgacagtgagtaaattggacactattgagaattttttgaaaattaataagaaattttggtgttagtattaggtatgataaattttcctatttcattttctaattcgtactttttaaaaggttaggttggtataactgagtaaaacgtcaaacccagtgtcagtgttagacaatgactcataatgccaaatagcgatattttggggcgataattcaaaaaaacctgatcagtcagtgatcagtgatcactgatcattgcaatttttaattgatttcaaagcgctttgtagggcttctagggcccgaaaaccgaaaatcaccctaaaacatgttttcatgacttttgaagacggaactggccagacggaactgacccgcttcgacccattccacggtcggggtcgttttcgcgtggccgttttcgcgtgagggccgttttcgcgtggccattttcgcgtgagggccattttcgcaaaattttttaattaatttataaaaatccagaattttgggactcagaaaatccaagattcccccccccccccgaaatgaaaatttttaaaaattttcttcgaattcgtcccccaaaacgaaactacaatatttatgggaacatttttgaatattggcaattttcgtaacaaagtgcactcaaattttcaaaattttttcaaaaaaaattttctcttgaaaaaattcccggttggtcccggctagggatcggatttttagtgataaaaaatcccaaaataattaactaaatagtgagaaaaaaattccaaaatagtggcaaaaatagtggcgaaaaagttccaaatttaggggtgtaattttttaaatagctgttttttaatttgaaaataatttaaaattaaggaaaaagattttattcactgattgctagggctaggatttttatgtgctaaaaatcctgaaatatgtaataaaatatgtgctaaaaaatgctgaaatatgtgctaaaaacccccaaaaatgccaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgatatttcattagtttctacagtcgaagaaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaaccaaaaattgttcggagaaaatgctatttttgggcttctctcgccataactaagccgcaaaaaaaatatgttaaaacataaaaatcctagccctactgattgcagttacaaaatattttcttagaaaatatgaacaagaaaaca

SEQ ID NO: 28259 - DNA, 1415 bp, Heterodera glycines
catgccactcataaacgatttttcgccttttggcgttgctcactttttcgccttttcgttgactttacacaaacgtcgtcatcactctcatccaaaatgctttcatttaacattttcttttgttcttccattccacaaaccaaattttggcataacaaaaaaatggcaatgaatgccgaaaatttgacaacgcccttaattgccaaaacacggttttgattggcatttgcttttaccgtcagttttagacgcccgtcagccctcttggccgaatttttctcttgctcttcctgaaaaaattctgattcggtttcaaattcaattgaatcaccatcagtttccatgaaaaattcgatggttttttctttttcttcatttgcttttattatttttgtttcatccttttggcaatttttagaattttgaatttggtgttttccttttcaatgttccaccaaaattctcgatatttatcgtaaatatcgagtactccttcgagcattattcccgaaatcgggtaaaattttcggtttacgactaaacctggtccgaattttgacaaatttggtcgaaagtcatcatttatttgtttgtttaattcgaccaccgaattggtgcctccaaattcggtgtcaaagggcatgtctaaaacaaattcccaccaattttggttcaaatttacttttggttttgtgtccattttgctccaaatctttacaccattgaagtcagccttcctcagttccatgatcaatttctcgcgtttttcggcacgggtcagtacaatgcactgcacaaattcggtcttgatgttaacaactcggcggcaaatttgatcagactggttcgtggttcgatcattttgaaaggcttaattaaaaatattgaatttaaaattaattttaaaattattttgtttttaatgtgtttaaattttattttatctttgcttttatacataaatattcgtaatctttgttccatattctttaatttatttctcatcttgtttatttgaacacatttcttgtgccataagcattgcttgttcaaatgtcgacataatttagtcagttcatatgacttgaaatgtgccttaataagccttgaataattttttaaattctgatctttaatttttatttgcaaaatgttccttgcaaaaatcttagtcattttatttgtgattttatgaacaataatattttgtgattcattaaattttggcgtttgctgatcagaaatttcatatgaatttttgtcacatttatgtgaccctctcgccgagaaaattttgtcgttaattaataaaaaagaaataataattgtaattaaatttcggcttattaatttgtatcctcttccgattggtgaaaactttatatataaaattgaaataattgtcaaaataatta

SEQ ID NO: 28260 - DNA, 1055 bp, Heterodera glycines
  misc_feature (20)..(20): n is a, c, g, or t
gaattcattatgtttctaanaatttataggcaaaaatgttcgaattttttgaagttttttggtcatcattttttgaaacacaacgaaattctttgaaattttgcataattaaagagggctattttggctgtcaaatgatacaaaatacaaagatgtttaattttgatgctcggtccattaatatatcgaattattttatggtcgtgtaaattgcattagagcaacgcaacaaaaaaaatgtcgtcctaaaatttggccgatacggagacgaaccgcccccgaaaattcaatggcatttctgttaacttttgactttcaaatgattgccaaatgaacccgagacacaaatgagtgttaaaaatttaatgcttttggttaacctctgcccacattccatgcattgcgcctcgtcgcttccgtttcggaattggcggcgttcaaacaaatcgatttcccaaattggcgacttacaaatgtgaaaggaaatttaagagtttattcttcgttctttcaatttcttaccagcttattttgctgtggcatttgtcactgcttctttggtcggataataaaatttattaggtaattaccaaattttttttaaaactggaaatttctgagtaatttcattagcaaaaacagtgaatcaaaaaaaaatgcaactgaaagtttttcgcgtccttttctaaatcaaaaattcttttagagccaaatgtttttctggcataatgttgtttcaaaatgctgacggaactgaattgggtcagaggttacctatcattttgtcactattctcgttttaaaccgtggctaatgatttcctcagtaaaatggaagacatcaaaataaatgaaatagtacactgacgaaaatgtttattgacgaaaatcactgacgaaatagttcattgacgaaatcatacagcaccttttaaacgtaggcttagacgtaaactattttctgtttggactttaacctgaatacccggcttatttgggcccgaaaaatcaagagacccatctttttctttttaaacttaaaaaattttaaatctt

SEQ ID NO: 28261 - DNA, 1438 bp, Heterodera glycines
cgaaaaaaatgtatttattaattcattcaagaaaagtagtaaaagtgaaaaaatattctatttaatgtgaacaacaatttactattatctgaattggattaatatattacgctaaaagttaaaaaacgggttaacagacaatttatatatttaacataaattaattccatgaacagttaaccaaaatgcaaattaattaattaaaatttattcattgcaattcacttaaaaattgtcagaaaatacgaaaaatcaattcacaaaaaatttacttacaattagcattaaaattttaaaattttcattctcttattaaaagattaattgaaaatattgatattattacatccctggattttcacttacaatttatacttgtgagttacgagagattaaaaaaaataaataaggaataataaataattaattacagttacacctttggattattaacaaattcaataaaaattccgaatccttgatcaatttaaaatttttataattttttctgcattttactaccgacaaaagataactaaaacttttttaaatacattttttaattttataagaattaaagacaatttttgaacttttcaaggcaagcgtcgtaaacagttcttgaagtttaattgacttataggctgattttatttaataatttattaatggttttgatacattgtttggagattatatatgaaaattttgataaataccccaaaaaatccaaaattttgcaaattttttcgtacatattttcatttttttaatataaatttatttatttatgtagccgacggttaaacagccaatgcatcatgacatcatcaagactctcggggttatcggaaaattatagaaattaaatttccaataaaatgatcggttaatataaaattaacatttatttgggaaaaaattactaaaaaaataaaaaataaaaattgacgattaacaaaaatcagaagaagttaattaattagtttgcttaaataataaagtaattttaaaaaaacagttctcaaaagttattaatgatgaaaaagaaagtgagtgttagaataaaaatagaaaaattgaataatttttcaaaatgaaaatagactaaataatattttgaattgaaaggaacagaaatgaatttaaaaaataacccataagagaaaattaatgctaaaaactaaataaatgattaataattaatttttgtatatgaattactatttctaaaatataatttaatattttaatgaattttaataactaaggtggaaaaaacctgtcatttacatcagtttcctgatgttagtgtctgaccatcagaaacacggaccgggtcagtttagtacggccggtttagtacggccgttttagtacggcacggtttagtaaagaggggtacggtttagtacgagggtcagtttagtacggcaag

SEQ ID NO: 28262 - DNA, 901 bp, Heterodera glycines
aatcccatgaaaatcccacgcggatgcgcatcgccggttcaaattgtcgcggtcgcggaccacgaattgcgcgcaaaaaaggcgagagtcgagacaggatcttaatcacgccgggattttcccgtgatcccgactcaaaactccgaagctcttttcactggtagttttctctataaaagtaaccggtgattaccatttatgttcgtaacaatgagcgctggtctgcgacggcaaatttgtctcacgcgtagttgtgcattatcgtatagataattcgagctcataatctcgcgaatatcgggtatttcctggtcacggtctcatctgttcaaaaccgggatctcggtattcagttgtccgtgttttgatcccggtcccgacggaacccggccccagcatgtttttggtctataacttttttctttgacatccaaatcaaaccttattggtatcattcgaaagcccttcagatgctctattagcttgcaaattccaaaaaaaaaattcgtccattttgaacaaatttatgtccataaaagttggaaaatctggttttttgaattcttctggccataacttttttgaacctttacataatttttcaaaattttgaaggctaatagaggacatttacaggtttcgaatgataccaacaatgtttgacttggatgacaaagaaaaaagttatagcccaaaaaaccgctggggcccaaacgtgccggggtccaactgacgagtcgggggcgtttgggccccagtttttgggcccccgcgtttgggcccccgtttttgggccctcgtttttgggccccagggtcgtttgggccccaagtacagaaaaatgaaaaatcacagtaaaaacaactttttaaatttcagcataaaaatgtaaaataaacat

SEQ ID NO: 28263 - DNA, 652 bp, Heterodera glycines
ccttgtttttctttcctctccctttccctctccttctttttctttcctctcccttccctctccttctttttcttcactctcccttctctctccttgtttttcttccctctcccttccatctttttctctacattctttctcttctctcccccaacccacccgccttctttttcttccctctcccttccctctccttctttttctctctccttctttctcttccctttccctctccttctttttctctacattctttctctctttctcttctctcccccaacccacccgccttctttttctttcctttcccttccctctccttctttttcttccctctcccttctctctccttgttttttttcctctccctttccctctccttctttttctttcctttcccttccctctccttctttttcttccctctcccttctctctccttgtttttcttccctctcccttccatctccttctttttctctacattctttctcttctctcccccaacccacccgccttctttttctttcctttcccttccctctccttctttttcttccctctcgcttctctctccttgtttttctttcctctccactttccctctccttcgttttctctacattctttctctctttctcttctctccccc

SEQ ID NO: 28264 - DNA, 919 bp, Heterodera glycines
acaccgcaacagcaggtgagaaattggtacctcggacctttaactctaaaatgccatgaaattcacttaaattgccatcggcaaaggatttcggcaattattggtcaaccaacgcccatttcagagaccaatggacactcatcaaacagaagggcatttactgaaattaaaaatgccaatggaagttgacgacgtggaagaggaaaactttgtcagattgagagaaacgaatcaaatcaaaatggacactttaaacaaagaaattgccgaaacagtttcacaggaaaatataaccaaattaggtaaaatcacaaattacacagattaaaaaacaaataaaataaattaattccagaaaaagtcatttggcaaatttttgctctcacttttcaaattgtcggcattgaactcaatcccactgatcaaataacgcgaattcttcaacaaacattgaatttcgatcagttggcattggcactttgcaattccaattccgaattggttctcaatagcattaagactcatttggtcaacaatgagcatttgaaaaagaaagcaatatttgctaacatttttagccgaataaatagtcaggcaaaagacatttttggacaaccactcgggtagtgcttaatattttaattaatttacacaccaattctgtcgtatggggagcattttaggaattaaaataagaaaataaatataaatccaaatttaacggttcgaacgagggtttctatggcgttcaaaaagccggcaaaaacgcggcatggccaccctaatttggacgtttcttaaatcagtcatcatttgaattttgacaattcgaaatattttctaaaaagcaaatcaaattgacattattagtttcaattgatagccatggaccgaagattcacttttcataggcaaaaat

SEQ ID NO: 28265 - DNA, 1779 bp, Heterodera glycines
tttttttatttgattcacccggcctccggatttcttccggtcagatcgattggccctttttcgctgacttttgtttaacggcacactgacattactgtttgaacgtgccctttaacacaaggataattttaaacgtcagaaccaatcagttctaaccgaggtgccctcccgtggctgcttttgtccgtcgcacatacggataactcggacacattgccatcttgtggccctatttcttcattaaatgtcggctcattctccctgacaattggcactgtgcaattctcttcgtagatcaggccggaaatgcgcttgacgcccccacaatgatccaaactgcgaatggccggattattgatgccttgaatgctgccaatgcgcggcttaaaaacggcactttgattaaaataacccttattttcatccgaaaagcaaaaacttaagccacaagacttgaaatgttttcgcgcatctttaccgttttttccggaagtgatccgtcaacaaatatttcaattggtggcaatcgaaatgcaccttgctgaccattttggacagaattggcgaatgagtgatgatcacccatgctaaaattggtgattaatatcatttttaagtaaaaaatggcggcgtgtaaataagaattactattacttttgcatgtgaaaaaataacaattgatcgttttttgatcaaagaaaaaatcgcaaaaaatgttaaatttttgaccacaaaatctaatttttggatttgaaaaatttttgaatccagacccaaataaaaaatcattcgccagatattttaatttaactgaggttacctttccgaattttcttcctcaaggttattgttttccacgtccatgtttaatgccaaagcattttggaattcgtcgtgcagaacgatgttttggtttggcctccaggcatggtccatttcactttcctggtgttctccgttggtatttgcctaaaaatggagtttaatgtaaagaattaaagtttttctcgctgcggcacaacactgttcataaagatttgtgaaaaaatgtttcgcaaaagatgattttttaaataattaaaaatcaccgcctgacttaaaaatcacaaaaatttttaactatttttagtgacaatctattaacaaattatattttttccatcccaaaatctaattttctataaaattttgctaaaattgaagaattcgccttttttgaaggccaatttttaaataatattttaatattactgtagaattttcccttgttgattttgccaaaaaatcgaattgcactttcacaaaaactggtagttgacttaccgaatcgattgtgatgttctcaccaacaacgatatccgaaattgtgtccataaaattttcgagttcttcgttcgctccattgccagtttgttcgcaacgaatatttttataaggtgcaattttcatttttttcgacatattctaaataaaatatttgtaagcatttaaaacgggtaaaaatcccaaaaaatatcgaatcacaatatatgatcgctgcgcagaattaaaaacgaaaaggcaaatagcggggagggtggaggaggggcgaaccaacgccgtatacccaacaaagaaaagattgtgttgtcggctgccagcaaccgacgctgtgcacaacaaaggggggggggggactggcgatttcatgagcgataaaatgaatggaatgcaaccagagggtgggttttggtaaggaagggggggggggattttggggcggaaataatgtgtctgata

SEQ ID NO: 28266 - DNA, 1223 bp, Heterodera glycines
gaaactgtacacctgttcagtagaaaaataatatatataaaggtttttaaagttttaatggtatgggggggataaaagttttacgggaaaatatatcgtataaattaaaaaaattgcaaaatctatgtctttttttgtcagtttttggattgtcgagaatttcacacgcgcatcatcaaatattaattgtaaaataattgtgcattttttacaattctaattttgagtagagtgggtacaaaggagctctcgagcgtcaagaaggtttagtactttgcgcaggtatgatgtgatagatacatttgtcggagcactattaccttctttgatcatgatcatctcggcatctaattggcactgatttcgacacgttcggttgctgtggtggtcatacagtggagcggagctgtcgaattgactctttggagaggtatcatgattgggaagatcattggtgcaaaagcgaaaatgtctgttatgatcggtgcctaatttgtggcatttcctttatccgtcggtgcgctgcgcaccagaatccgctttaaggatcttcacattgagtaaatcaaaaacaatgcagaaatcaatttattgtggagtccctttttctaacaattttcggcaatcttaaagaatgggtgtccttaattctaatttgtttttattttttaaattttgggctcaatccagttgttatggtctttagagagattagtatcttttagaaatcagagcaaattttggtcgttaccttcaatcagagcaaatattataaatcaggacactttaattttatcagatttggaccctccaaatcaggacagatggaagccgttgttaaatccccagccttaaacattagttgagcaaaatgttggattaattaaatggttgtgcctcatttgcgcctccacacttgtgcctccatatttatataaaacaatttaaatatttaaaaatattttttataatacatttgttggacaaaccacaacacatttatttttatatattttctttgtttttgtattatgttcttgttttttattatttcttatttttttaaaagatgctcattcgagccaatgatcaattccttttgtggtgagtctaaatgacggagacccccccctatcaacgcaaattaataattacttgacaagttttaatagtcacagttaagctagatattatcgattagagatgaagaggaataccaaaga

SEQ ID NO: 28267 - DNA, 1068 bp, Heterodera glycines
ttttgcaaaattattcataaatatttttttcagaaaatgctctgaaacgcaccaaattttatttacatgctagtttaggcactctgatgctttttctatcaaaaagggagatgaataaattttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataa

SEQ ID NO: 28268 - DNA, 1808 bp, Heterodera glycines
  misc_feature (828)..(828): n is a, c, g, or t
  misc_feature (1014)..(1014): n is a, c, g, or t
  misc_feature (1362)..(1362): n is a, c, g, or t
  misc_feature (1369)..(1369): n is a, c, g, or t
  misc_feature (1376)..(1377): n is a, c, g, or t
  misc_feature (1384)..(1384): n is a, c, g, or t
  misc_feature (1392)..(1392): n is a, c, g, or t
  misc_feature (1405)..(1405): n is a, c, g, or t
  misc_feature (1408)..(1408): n is a, c, g, or t
  misc_feature (1414)..(1414): n is a, c, g, or t
  misc_feature (1418)..(1418): n is a, c, g, or t
  misc_feature (1427)..(1427): n is a, c, g, or t
  misc_feature (1430)..(1430): n is a, c, g, or t
  misc_feature (1438)..(1438): n is a, c, g, or t
  misc_feature (1440)..(1440): n is a, c, g, or t
  misc_feature (1450)..(1451): n is a, c, g, or t
  misc_feature (1454)..(1454): n is a, c, g, or t
  misc_feature (1463)..(1463): n is a, c, g, or t
  misc_feature (1474)..(1474): n is a, c, g, or t
  misc_feature (1478)..(1479): n is a, c, g, or t
  misc_feature (1481)..(1481): n is a, c, g, or t
  misc_feature (1485)..(1486): n is a, c, g, or t
  misc_feature (1494)..(1494): n is a, c, g, or t
  misc_feature (1497)..(1497): n is a, c, g, or t
  misc_feature (1499)..(1499): n is a, c, g, or t
  misc_feature (1502)..(1502): n is a, c, g, or t
  misc_feature (1511)..(1511): n is a, c, g, or t
  misc_feature (1513)..(1513): n is a, c, g, or t
  misc_feature (1515)..(1515): n is a, c, g, or t
  misc_feature (1522)..(1522): n is a, c, g, or t
  misc_feature (1525)..(1525): n is a, c, g, or t
  misc_feature (1528)..(1528): n is a, c, g, or t
  misc_feature (1530)..(1530): n is a, c, g, or t
  misc_feature (1535)..(1535): n is a, c, g, or t
  misc_feature (1548)..(1548): n is a, c, g, or t
  misc_feature (1551)..(1551): n is a, c, g, or t
  misc_feature (1554)..(1555): n is a, c, g, or t
  misc_feature (1557)..(1557): n is a, c, g, or t
  misc_feature (1560)..(1560): n is a, c, g, or t
  misc_feature (1563)..(1563): n is a, c, g, or t
  misc_feature (1566)..(1566): n is a, c, g, or t
  misc_feature (1569)..(1569): n is a, c, g, or t
  misc_feature (1575)..(1575): n is a, c, g, or t
  misc_feature (1578)..(1578): n is a, c, g, or t
  misc_feature (1581)..(1582): n is a, c, g, or t
  misc_feature (1584)..(1584): n is a, c, g, or t
  misc_feature (1591)..(1591): n is a, c, g, or t
  misc_feature (1594)..(1594): n is a, c, g, or t
  misc_feature (1604)..(1604): n is a, c, g, or t
  misc_feature (1607)..(1607): n is a, c, g, or t
  misc_feature (1610)..(1611): n is a, c, g, or t
  misc_feature (1615)..(1616): n is a, c, g, or t
  misc_feature (1619)..(1619): n is a, c, g, or t
  misc_feature (1629)..(1629): n is a, c, g, or t
  misc_feature (1642)..(1642): n is a, c, g, or t
  misc_feature (1645)..(1645): n is a, c, g, or t
  misc_feature (1647)..(1647): n is a, c, g, or t
  misc_feature (1650)..(1651): n is a, c, g, or t
  misc_feature (1674)..(1674): n is a, c, g, or t
  misc_feature (1680)..(1680): n is a, c, g, or t
  misc_feature (1683)..(1683): n is a, c, g, or t
  misc_feature (1693)..(1693): n is a, c, g, or t
  misc_feature (1696)..(1696): n is a, c, g, or t
  misc_feature (1702)..(1702): n is a, c, g, or t
  misc_feature (1713)..(1713): n is a, c, g, or t
  misc_feature (1715)..(1715): n is a, c, g, or t
aatcaaaaatttttcgagattttccggcttaaagctcatccgattgtctgcaagaatatttttgtatgccgaaaaggaacgctccacttcgcatgattggacgggtgcatatttgaacatcgcgataacgtccggaggcaaatgcgtttgaaagtgttcgccgcgcaacaccataccaatttcctagataaaatatgagtttaaaactttttgcacatccaaccaaaattctgtcaaatcccgggttgtttcgcaaaacagtgttaaatttttcttgaaccaatttgccgacactgcccggtaccagtttcaattcatttccgacatcgcttactatgtccaaacctagaaaataataataaaaattttcgagtttttttcattaactttcaatgagtgtgaggttgcgggattccaattttccaattgctccaggcaaaatattaaaatatgtttttatgaaggccaaatctccgcgaatgccaggagagtcgaaggcaatttgtgattgccgtattgcatcagaatcggatgggttgaagtctcgaataatcgctcccacttggttaaaattttggcagtaataatccgctgcgttgagccaagtcccccaacgcgtgatgattgtacgcggtgggagggggagatcacaaagttcgcggaatttggccacacgcgacggcgcttttgaaaaagttttcttggtactcgcaaccaatttgtcaacactcgggtagaggccacgaatttcctcgcacacacgattgagcccgtgacacaagcatgttagatgaatgaggtttgggtagaaaattttgaggcccttanaaaggtttttcgtactacttttctgtaaattttttatttaacctgtgctgccttaaccatgtaacgcgcagcgtcactgacaagtaaccaaaggtcgtcagccgagatcaactccctcagattatcgttgacaaaccgagcgattgtttcatggttagttttgtccagaaatttgacggcaaccanatgcgggttgtgcaatttcccatccaaaatgccaatgatcaaatttgcgacatatctacctttagaatcagtagtctcgtctactgatgccaagattttttgggttttgaaatcatttttaacctcagccattttctgaattatggccaagtttttgaatatgcagagggggtaaacctgctcaaaacatgctgccaaatagcgttggtgcaacacatcctcatgaggaatcacacgcttgcaatatttttccagaaagcctaaataattttttgggtggcccatcccaaaaacacacctcgaaatctctgattttccaatttgaaaaatggaatgtttgccgaagtnaaaaccnaacacanntccatcntaaattcntccaaatttttcnttncttgantatncaaaaattnttntttttttncncttccacttnnccncataaaaanctcaacatttncttnntntttnncaatttcnttntnttntttaacatncnanaacatcnttnaananacctnaaaatactttttnccnttnntnttntcntcnttnttactnttntanntnacaaatntcnatttaacctnttnttnncacnnctnacaataaatnacctttccatcanttntntanntcacttttccatcaactcttttnatccantcnttcaaccaancanattttnattttattttngncattttcacacaaagttgtagcaattccttaaaatcctgaaaataggtctagttaagccgaaataggtataaaaataggtacctcggtaatag

SEQ ID NO: 28269 - DNA, 813 bp, Heterodera glycines
tgagtaccccaaacggacacttgaaaaaatcgattttcccccctgataaatatttttttcagaaagtcatagcgcacccgctccgtatctaggcaacgttagagcaacagatgtagctgactagccaaaaggttcggtgccgtgatgaaacgaaccagcactgcttaccccgcggcacccggcacggtcccccgaaggaatggatttaattaaattctctccttcggggatttttttccattaggtcatccgatagcggtcgattgctctagtatctttttcaaaatttttgatgaaatatttgtcgggctctgaagggcgtggaagggggggacgaacactgatatgatggaggagaacacataaaaattggaagaaatcactaaaaaattattggaaaacattgagaaaatgaaggaaaatacacgacaaatgaaggaaaacgccaaaaaattgaaattggaggaaaagggtgaaagattggaggaaaatgccaagaaattggaggaagacggtgaaagattagtggaaaatgccaacaaaatagaggaaaacggtgaaagattggtggaaaatgccaacaaaatagaggaagacggcaaaagattgattgaaataaaaataacagaaaaattcaaagaaaccgctgaaagattgatagaaaacaataagaaattgttggaaattcgtgaaaaataggaagaaaacggtaaaaaattgtaggaacaaaatgaaaagatcactaacgaaaaaagggaataactgaaagaaagcattgaaactgataaaaacgccaagaaaaatgtgaagaac

SEQ ID NO: 28270 - DNA, 1340 bp, Heterodera glycines
ttcaaaaaatagatttaccaaaaattcttttaaaattttctgttttattgtacatgatttaagcatctcccgcatcttctcttgtttaaatgatttaatcatcatgctttttggttaccaaaaacttttttcccacacacaaaaaatttattggtgaaaatcaattttttgaaaaatttaaaaagtaaaatagtggtaaagcgtgtgccgaattcaatttattttcccagtttaaactggttcaaaaatcggtttaatgacctttctgcaattggagacctaattttccttgcttaactactcgaatcaacacgtttggtacatatcactggtgccattttttgtgtaggaacttcaagacatcaggcgggagcggtacattggacacctgaaaattggatataaattcctctgttaaagatagtcgggcaacagccgaaaaagaagtttacactgtctaacggcggcggaagactgcgacgaactctttgctccgggaaacgaattccctccgccgacggagagcaaagaaaagagttcatggcccggcaccccaaagaattcgcaatgcgcggcactctctcccaattccgaaatgccatcgcaaatgacataacttttcctttcccgaattgcctctctttccccatttgccattgtcccccccccccctttagccaaactccgtcgccctcccctcgccccaattctctgctcgaagtcctttcccaacggctaaagcgaagacgacgccgatcgctgctgctttcgcccgtctctttccctccttcggtcgccgcttttccatcagttgccgagagccgaaaagatcgccgaaagcaaaggacgcctcggccaagctgcgcattagcggaagaagaggagaagaaagaggcattaaagcggaggaaaacagcgactgaggcggcggaaaaaccgaggcgaggagggacactcgttattaacggggcactcattaattagggagaggacagtgcccttggtactagcatgccataaatgcagagttcccaagtgcgcttatttctatattttgatttttcatttttttctgaagcgaatatttgaattaatttgattttaaaaaaaaattacattttatttcattttttgagtgaaattcccaaaatgccaccaaaacgaaaacatgtttatttggaaagctacgcaaaagaattccggcatataaagaaaaggcgaaaaggcgaagaatttgccccttgtgtcgcctgcatattttttcacaaaaatgggctcaaaatctccaaattggtcctttttctttggtgaaattctgttaacaaatttcttttattttg

SEQ ID NO: 28271 - DNA, 1738 bp, Heterodera glycines
gggggcaaattggggaaaagcggcaatgatctacgtggggtaattattaacgaattaattaattcgactatccacgcaattttttgattgagaatagcttaaaggcatttgtaaagccgggattctgctgggtttgccttcccctcgtcctctgtggtcattcttcgtcccttttggtattcatccgctgacaattggacatcggaggaaaaacactggtccattcacaaatatttgtttacttgagaattgaagggatttttcggatcgatcagccctttttcacctttgtacaacgtgacaatcaactaaaattatattgcaattaataaagtaaaaaaattaaaaaaaaatttttgagaaatatttatttggaagatttaaatcaaaaaaaaaataattttattgaatttcaaaaaagttatggataaaaaatatctgacttaagactttgaaattttacaatcataccttttatatccttttaaaaattaatattaatcaccattattaccatgtaagcaacaaaatatatttaaccgaaaagaaatttacctttaaaaagataaaattaattaaaaacagaataatgaaaaaatattattatatagtttgtgtacataaaatatccattaacagatgataaagtgaattttattaatcatttgaataaattcagtgattaagatcaaaaattagaagaagaaaaatttatggttatttaatttattcaacctaattagataacataataattaaaacaattgaataattatcatacactatctgactaatctattgtggtttctccgactgatgaaaatttctaataaaatatattataataattttttttaattttaaacggatttatttacatttttatattctccgcctgcctttaagcaaacattgtgcatggagttgaaatatagcaaaaaaaaaatgaaatattttttaatttataatcaaaatataattttcacgaagtaatatgtataatactttcgcttcaaataaattgagaaaaatttaaattatgaaaataataaccattgaaataccaaacttataatatgcaagtgataaaaaaaattgtttaaacgttattcaacccaaatttacttatacattttgcgcataataattgctcgaacgtaattttacatttttgttttttaaaacgtataaaaattttattggaaattttactttaacaattcttctacgccgtaatcaaacgcggtagcctttaccatgagaataaatcaagcaaaaatttaaatctcaattaaaaaatattaacaaaataaattaaaaacaaattctaacggcaaaagtataacgaacacaaaaaaatttagtccaaaatgataaatttttgaaataattaaagaaaatttgatttgaaaattttcattaatttaatttagttttaactttttgatttataaaataaaaaacaaaataaaatttaattttgtattattttcacttgaaataaatcaaaatttgaatttttaaaattcccggttcccggtgccggacgaaaagcgaggtcccggtcccggcttctcaggtcccggcaagtcgctgtcccggttttgcccattctcggtcccgctgcactctagtttagatatagtaatataattttattttaaataggttttctaactagttgttttcttttaatatttaatagttatggaaatggtgtttgcttgcatataaaaat

SEQ ID NO: 28272 - DNA, 1025 bp, Heterodera glycines
caacaggaacagcaacaaaagactgctgcaaccgaacaaattgcacttgagcctggcacgttgtacagggtgagccgtaatgatttactaaccagtcaattatggtcttataatcgttcaatgaaaattcaatatttgataggtgttatgtggtgataccctccttcaccttagattttttgtaatttttttctgctgtattgtaaaaaaaaatgaaaatttgaaccttcattatcatcgtcttaaatatcgaagaaaaaaaataggggagccgggtcacaaaagaagcaagagcaagtatgaaaattaaaaaaaaaattttgctttatctcgaaatagaaaaaaattacggggttgctgacctaataaattttcttaaaagatcaattaatgtattcatttggctaaattggccaaatgtgtacggctcggcctttacattttttaaaattagattcgtgttcgggcaatcaattcggtgggctgcagtgcatggtcacagccggtcagcttcaagacttgtgttcccggattcccaggctcgccgacaagcatcaaaatcacaaaatgtgagtctcaacggtgcctgatggattttgttcgttaatttaaaaaaaccatccaaaaattttcaaataaaaaaaaccattcatgcttaatatcattcgataggcctcccttacaaattaatgttctctattaacctgcattaacgaaactttttttgtgctaatagagattattcaaggctatcgaaaggactcagaataaaatttatttgttcttttcagcaattttataaacctttttttaatttaagaattccaattgtgagtaaaacgggtgcactacgtttccccccccgccgtttcccccccgagaaaatttaaaaaaaaaattgctaccttagaaaaacgatgcgaggggggggggaaacggcggagggggggggaaacgagctgctcccgagtaaaacctttgggagattttttttcgactgcctacatatatatatatattctgat

SEQ ID NO: 28273 - DNA, 1216 bp, Heterodera glycines
caaaatcatgccaaaagcatgccaaaagcaatgccaaaagcatgccaaggcaatgccaaaagcaatgccaaaggcactgccaaaagcaatgccaaaagcaatgccaaaggcaatgcatgccgactttgtatcttagcaggtgccgtccacttcgctttcgtcccttcctcccgcgtccgctccctctccctccgctcgtgccgtcgtcgacttggcacgttccgcgcttctcttcggcactgccggttacatggtctacagatttgttcgttcgtggctgctcccgcagcttctcaatgtgccggacccggccgaggagcgtatgcaacgacttgagcaacaggtagagtcattggtcctctcttctgacggattaattcgccattcttcaaaaagtgattttccctctcaggtcgaaaggctgagcgattccacgcgatgcatcgccgaatcggtgacacaaacactcgttgcggtgacggaacagaacgagcagctgagccgaacgatgatgatggtgcagggagggacgaaggggacgggtgagtgatcagaagaggacgaaacgaacaaattgatcgaacagtgatcagggaaaagcaagggcgaaaagagaaacaaaactaaccgattaaaagtgatgtaataatcgaaaataaaaagcggaactgggtccggattttcaacagggacaaaccgggaatatttccaagaaaaaacgaaaattcaaaattttcaaattaattattttttttgtaaaaaaataaactcattttttcacttttcacattaaattgcatctgtatatgagcttagaagtaaattctgagatggaatcgcttaatttttattttccaattattattaattttttagtgatatttaaaagaaattgaggggccgacggtgctcaaaaggcgtcggtaggggaaatttgaaaattttggctggatttaaatctgatttttttctcaaagtttccttccccaatttcctcattaatttgccccccctccccccaatatttgccagtgcctattttcccccgttctcggtggccctttcatggagtgtgagaaagctgtttcgggctcggtcttggtcccgtggaacgcaatttcagattattttaagggattacggaagtttaattagagattacggcttccagtaattgaaaaactctccgtaattatgggttatgattcctgtaatt

SEQ ID NO: 28274 - DNA, 1079 bp, Heterodera glycines
aattgtgcgatatattctgatttggatggtccaaattctgacaaaaaattactgcttttatcataaataaatatgttaaatttgtctattttaaaaattgtttttagaaaaaagtgccatattttcgcaccttctttttttaaattgactcttaaatccgaattctaggtgagtttatttgagaccatgcatacgcatataggcgatataatggaatatacaatacaatggaatacagctgagaaatacatattatgctttatatcatttcatcgcattgaatgtttgttggcaccagcaccatcattcttcatcccactcgtccgtcctctgcttaagtttgcatgatgatggcacttccgttcttctgctgctgctggcgatgaatggcgacattggcacattccgtggcgacatcgttgcgcaatttgcgattagcggcagcgactgaagcattctcgggccgttttttcaccagcgaattgttgaagaacatctcgaagacgaacgaacacaccatgacgatgtcgaacacctgaaaaatccagaaattggaaaatgcagaatcaaatgggcggcaaaactcacaaaagtgaccaacggcacatttgtgtcatccgcacggaagttcatgcaagaccaataaggtgtccaatagagcagcaaatacgatgaggcccaagcagagcaacaccagcaaaagacagaatagagggccatgcaatagtcgaagcacttaaaaatgaaaaacaaaattagtaaccgactcaatggaaaacaagcaaatttttgcaactcgtaacccgacaaaagcaaaactgatttcaatttggtcaaaaaaagcataggatttcgactgaaaagcaatttgttcgcgtaaagcaaaactgatcacaatttggtcaaaattccaccggatttcaactgaaaagcaatttgttcgcgtttttgtcgggctgatgtgctgtctgtgttcacgcattgaactcacttcatattctgccgcagggcgtaacatccgggcgaagccatgcccatggtgagaagcgagcacatgcgagccacagttggccggaaaa

SEQ ID NO: 28275 - DNA, 1854 bp, Heterodera glycines
aaaaatttgggggaaattttgaaatttgccaaaaaattttgtccttaacggccacatcaatttggaggatgaaaatgtgagaatttaaggcgtgaaaaatcattaaaattagaaaaaaatgtcaggaaattgggcctggcatggaatggggacgagtggaggggaggggcgacgaatggcggcgaaaaatgtgccgaaaacgacgacggcaaaaaatttgaattgctttggcccggcctagcaacaacaacggcaccggcaccagaagaagaagaactgctcaaaattgatgccaatgtgatgggaaaactttaaaaaatagcgaaaacgatggaaaatcgagccaaaaaacgaaaaaaaaaattcacggtctttttagaacaaaaaaaatttttttttaaacagtgggcggggaccatcggcagtattaccaagacaatttaacaattagttgaaattttttggcaattttagggttccatcagcctcggcaaggccttcttcaaaaattcggaattttcaaggcgtaattttgagaaaaatttcccacccgaacgtcctgttgagctgctggtccgtgctgcgaattgcgaccaatcgcagcacacgcatttgccggtaaagtgaaaaacgaattttaataatgaggattaattaacgcgaaaattaattttgaaaaataaaaaaataaattgtttaatattaaaaataattgaataaatctcaggtgcgcctttggttgcccaacttggaattgctcagcagtcacagtcacaaagtgccattgccatcatcgcctccggtgccaaaagcgccgttggcagtgccggaaacaatcccgatgggtcattatggaattttatttaaaatttaaattttccaattttccctggcgatatcaccggaccataaaagtccttaattgcataaaaatcgtgctaaaaatctcaaaatttgttcattttggacattctgttaataatattagttagaatttcaaaatttttcgattttttgtttttgacggcgcttttcggccccccccccgccccgcttcgctcagcaaaagttatttgcggcacagtatccgccagcaaaagaaccatgccaaagtgcatactgtcttttttcttttattttttaaattttctacaggttcctatttgcactctgtggactttgcggacacgccgcggctcgacaatttccgactccaaattgagcgacaaaacggcacaatgccaacaacaccagtgttggcgttggcacgccgcgccaattcaattgttgtccgaacggcgcgcccattgaacggaattttggcacgggatcagcccattgaagtgcgaattgtggagcataaaagcaatacggtagtgcagcaaaatgaaatacggtataattaggatattgaattttgtcagcaaattggacacttttcactccaattggagtcagccgctccgtgccaaccgcgctttagcactgatcagctgttgcgcttcagtgttgatcaggtgcggtgctcactgatcaatagggttcgaaaaaataagcgaataaaaagtgaaaaatatggatataaatgtttccaaattgatttctcaaaatttcttcaaatttattaaatttaagcctaaaaatcctgaaagtagctttataagtgtgaaaaatcagtttagaagaaaaaatacaaaataaagctaaaatatattaacattgttgaaaaatgaatttaaaaaatcgaaaattttcacttggacttatttttggcacaatttccaatttttaaaagttatatttttattaatttgttcgagaaaataacgaaaaatgaagttttttcgagaattt

SEQ ID NO: 28276 - DNA, 1070 bp, Heterodera glycines
tttatgagaatgtcaaatggaaatgcggaagaattgccctccctttttattttgaaatggaagccaaaaaattacatagcgaaaagagaagggaaaacaatcgattgagatcggttggcattaaaagttgaagaataaatgccaacaaagaagggaaatggaagcgatttgcacgaaagaatggcatttggcatagcaactgacaaaggaaagcccaaaatggaaattatagcaaagcaaaagaaaggggcaattaaaaagaccaattgaaggcaataaaatatgtgcaaaacccaccgaagggcggagatgtgaaagagcagggcactgtcggaagaaaacaattcccgggcatgggattggcgcgtggcatggaaatggccctctgaaattcaaaaaatgacaattaataaacacaaaaaaagaactctgattaataatgatcagtcgattgttcacaataatattctctccgtccctttgctcaccttcgattcgctcttgggtgatcagcgagaaggacaactcgggcacgtctggcggacgataatagcgcagcaatttgacgagcaattggtcacgctttttctgaaaatgggccaaggttatatatcggcagcagaaggaacagccaattcacagaagggagagagagagagaaagagagtctattggaagttttcatgtgaagggctgcgaaaacaaaaagaaaaaaagggatttttgtggccgataaaaatgtttgctcagaaaattgtggtgtcaaaatgagtggtcaattagtgctctgtgaggcaatccctcgtttcgttcgctctctccgtccctttgccgctcgctctctctatttttctctccctgctgctttctctctcccccccctccgctcgctctctctatttttctctccctgctgctttctctctcccccccccctccgctcgcctctctctctctcgcgtaatatttatttgctttttcccttttgctcccctccgccatttgtctgtttgttgactttgtcatttctctctccggtggttgaaattgatgcgataaatgaacgaatg

SEQ ID NO: 28277 - DNA, 1599 bp, Heterodera glycines
ttgaaaaagtatcgcaaactcgaattacagagactcactcggtattctcgaacatttttgttgttcaattcagcaaacccctcacataaatcgacccatttcagcttggaatcggctctaaaatccccgattctggtgatcagagtagtgacatcacgcgatacttcactttccattgcttcatttgtttctttctcactaaatatttttgcgttaatgataaaatgcataaaaacggcatacggggcatgaaaatgtgcaatttttaacagttttattgcagaaaattgactattttaaatttcagtcccaaaaagtttgttcttttacaaaattcgctataaaaattccaaaagaaactgtgggtaggaaaatatgagttcacgtgaaaaattagtttaaaaaacacctttccattggttgcgagtccgcccttagtcggagtttccgcagtttcttttggtaccgttttttgctttcttcaacagtgaaatgccttaaaaggaaagtaaacgaataacaaatgcttccgattgacctgtaaatgtccaacattgagtcggaaccctaaaatgcactcctttccttttgttaatttactccattaattaccgaccacacagcaaacgattgcttcgtcgctggaaaccgccaattgaagtgcgcgaccttttgcttgtctgatcaatgctccccgcttaatgcagcgcaaaattctctaaaagaatcgttgataattaaaagccaatgatggaattttgctcgttggcaaaacctaatacagaaagaattgtaggagtgagacattaatttatccaaaattaagcataaagattgccctactttaatttaaaagtttcgttatttttcatttattaatgtgtgagggcacaatcactgacattcgcttgctgttccgtgtcaaacgcatcacccttttcgacagagtccaacagcagcaattggtcgtggcccacgagtgtcgttcgtggcctcttttccccttcgtcttcgttctcctcgtttcgctccgttcgttcgtcttcccacccgtcttgtccttgccagcacagttcgaacaccaaaagttcgatctccgcattgcccaccaacagcagacggtcatcgtcaatcagtgcgaatgtgtacacttcggatgaactgctggccaaggtatagaagcaggactttgtcgtcagacaccaaaatttcaattgactgtcctttgaactgaaattttcactgttttcggagggttttcaagtcaaacctggacaccaaaaaacggtcgcgttgtgcaaattgaagatgtgttatggtacttttgtggccacccaaacggcaaatgcccgattcgttgaccaagtcccaaacaacaattgaagagtcttttccaccagaggccaaagttagggagtcagcactgaatgcaatgcaattgacaccagtacgatgtccagcaaaagaagaacggatctctaatatatgaatccaattaaccccattaaaccaaaaatcaatgactcaccatttttgcccctctgatacaaatgcacctccccctcatcataaccaataacgaccaaacatttgtccggg

SEQ ID NO: 28278 - DNA, 1668 bp, Heterodera glycines
  misc_feature (1660)..(1661): n is a, c, g, or t
tttaggagcatatgctttatttcatgatatttttaacgctttattcggctggagatggatttgtttggcgaaccaatttggaactatgcgcgaatgattggcattgactctaacaaatgcattggtgtgttattattttttaaatttaagtataaattattcaaattattaattttatttatttataactgtttgactttttaaacaatgttaagcagtgaaagaattcggagaagcattgagaaaaataattcatgcgaaattaaactcagttgaaatgaacaaacgccaacaaaaacgaattgaaagcccaatccaaatgaatgaattccaaattttgaaaaagattttagagaaaattaaggacaacgaaaattatgggaaaatggaaaattatggacaaaaattcaatagcattctcttagataaacagggaattgctgcgttaaaggaacttttggccattttgaaccaaatcattggccattactccggcactgatgagtcatgcccgatggaaaagagaagaagcatttatttagaaagttttagagagaaaataaaattcagcaaaattttatttgaaactctcagcaaatattcggaaaatgtgaattatgacgaaaagcgtcaattgcttacgtttcccctgtcaacgggcgaacacattatcgcgcgactcagtgcattaattgaactaattggccaacaacggttggttaacgtacaataaatatttaaaaataaatacaaattaagtgtttgaattttgtattatttttgattaatttgctatgaaaaaatttctaaatctgttgatcaaataaatttgaattgcaaattttagtcgcacagttcgaaatgatcatattagtagtcaaattgatgttgtgaaaacaattcaaaacattgcttcaatggagccaattcaattttatgagcgaaaattcactttgtattggcgtgaatgggtacatttcgacttgtttttctccatggcaattcgtttgagtgcacaaattgagcggaacgatcatttgaacgcattattattatccgccagcccaaattatcactcctattgtatgtaagtaaaatagattaattaattggtactttctgctggcttttagggtctaatccgtggcgcagatcccatttgaaaaattcttagctcaaattgtggcatttatctttgcgaaataatttgtaattggcgcgtagttagggctacctaccgccacaccggcgggatgcgctaacggaaaaacttacaaaaaatgttcatttcctgaaattactccagcgaattgttttcgcttatcaccagaattattttagctttttcgattataaaattcaaatcaaaaatggcaatttggtggagataaacaccccgacttggcatgcgccttattatgtgtattggggaaacgacaaagatcagatggtgacacaatctcagcataggaggagcaaagaagcattggtacaacgagaagctatgggtaaaaaaacaattaattaataaggcacacaaatttattaagaggtcgattttcgagaaaatttaatatttatatgctttttaaaaattaatatctcccttttctaacgcgtgtacaaaatataaaatttttttataagaaattggagaccnntgcaggc

SEQ ID NO: 28279 - DNA, 2072 bp, Heterodera glycines
aaaattagagaattagaatgcaatttggttaactggtttcacaaaaaaataatcaattttttcgactttgagccaaatttggtaataatttaattcactttttcattcatatctgtacagaaattatttttcgatgtttcaatgttttttgcccggaacctctcagttgggcgcgcacggttgggcgctcacggttgggcgatcacgtttgggcgcgctcggttgggcgcgcacggttgggcgcgcacggttgggcgatcacgtttgggcgcgcacggttgggcgcgcacggttgggcgcgcacggttgggcgatcacgtttgggcgcgcgcggttgggcgcgcacggttgggcgcgcacggttgggcgatcacgtttgggcatgcacggttgggcacgcacggttggacgcgcacggttgggcgctcacggttggtcgcgcacggttgggtcccagcatgtttttacgcttaatcttcaataatcatcataataatacatcgcagtcaatcgcactcgaaagccagccccagtctcatatggccctctatggattaataacagaaatttcaaacaaatgatagatatattaaataacttaacatctgtaaagattcaatagctcattagaaagctcttttaagctttacaacatctgggtatgagttttttacgctaattaattttcttaaattttttgggaacaaatcaaatacctgataaaaagtcatagacaaaatcaatgatttttcaaaatctgagttcagattcgtgatcagcgtatttttctaccccagaaaaaatgctttttaaaattttactattttttcctatcgggaccacaattctgcacctttgccaagcggtagaaaccaaatgggttaaagggaatttactaatcaagtaatttagtctaatttctcagacagattctggcactgaatgccgaaattgcaacactgcggcataaaatcaaaaggggcgcgggtgttgcgggcattaatcagctcactttttggaaggacgcgctggaaacatttggacggcataatcacaaaaagggacttctgccgaggtgtcaatgcatttgcctaattagcagtccgtcagtcattccccccccccttaattattccttaattgttttcctccgtcctccctttagacaacccgtaataacggcactcaatgcgtttggctctcgtgcggatgtgcctttgctccttcggttggttaacgcgcgtcagcaaacgctcggcgaccgtccgtttgccaatgttcacgctttggagagccattcccgagaattgtacggcacactgatcagtctgcaaatgcgagcattgaatgacgccatttcaaaagtgcggggagtaagcgatgacaaacaaaaagaaaaataccaattggaaatgacggaggaggccaagtccgcagtggacgcgatggcatgcgcaattggcatcctcactttgataaggttggaatggaagtttttgtagggtaagtttaggagaatttagaagatttccaccctctccgaaactataaaaatattgtagattagcatgtttaaagtttgaagcaattttctacaaatttcgaatttccggctgcgcctgagggcatcgtcgaataacttttactttataaatttaaaatatgataatttttggctaaaatttctaatgaaaaagttgaaatctttttctggatgagctcggacctttgaattaatttccgatctctcctcacattgcaagcggagtgattgttgatcagtccaatcattgtaattttgtttttggtgaagtcttcaaatagaattcaatccgttctcacatcacttctgattccaagggcaaccgtgctgctgttgcgtgatggcgttgtgttgctgccccaggacttgacctcaattcacggcgtcactgcgtcgatggccctccgcgagccgaacagtctgaaaggcggtggtgcgcgatttgtgcgaggcatgggacggacaagtcgctttttgtttttacattttaagcattttcagataagtgatcgccatttgagcatcgcgc

SEQ ID NO: 28280 - DNA, 1058 bp, Heterodera glycines
tcgtttggctgcttcacttaggatttgctgtacctgtaccactccttctactgcttccgcttgcccattctgttcggctccgtccttttccctctctattctctgttgcccaattggatgatcggcggattacctttttttatcaccggttacactttccaggccaacaatttagccaccgctttcatccttctcaaccgacttaccgcgattgccgccccattgaaacatgacaaagtacaggacttgtcccaagtctccccggacatacatatcttgctcataactagagcaaagaattttaggagcgacaaagttggggggggaggggggggggtgggagaaatgggcgggagtagcaaaaattgttgaaaatttttgaaaaactgctttgaattaatgaatgcgtcgtcaggcatttctgccctaatatagctgattgtgaggatggcattatcttttttcagttgtggaaatgttgtcttccgctgtttgggttggttgttttcgtcttgccaatttgtactaattggccaatgttcaaaatgacaggtagaaagaatagtgcagaaattcccggttcccgactcggaaaatttttcccgtacttattttggtttcggtttctatgcttttttcgtcgtttggcgacaaatatttattgtttggaaaacacaattaaaataaatgcgaacgaagagagagagagatgaaaaacataaatgaaatgaatgaatgagagcgaacccaaatgggggaaatgcatgcgcttatatgcgaatgaaatggtcagacacaatcaataataaagggtagagaaatgcaataaaatcaaagggagtgaaaatggactttagtcatacccaacacatttaagtcccagttttcattatttcttacaaaagaaattttgaggttctgatcttcttcatcactgctttcaaaataagggaatctggaaccaggcgctggagcagtagtgcgagatatgtgacgattaccggacgtacgcatgggctccattcgacttctacaacaccgaagttgagcgccgcttc

SEQ ID NO: 28281 - DNA, 798 bp, Heterodera glycines
aaaggggtagagagcacaaaaagtgctttgaaaataatggcgaacatttatttatttacactcggcgctggcgctgatcgatggaccgccgctgtggtggagaaataaatataggaaggcacctcattcgctaactgtctagcatagcaaaagtgcaatactctttctctatctctctttatctatatccatttcaattcaccctctcttgctctgtggatataataaatcctagacccatcatttaaaaggcaattcggtatagcactttgtgctctttttggcagatatatttaatttacaaaaaaaaaaaaaaaattccagctccctaagaatttttttcgaaggttttcccgtttccaagccattagaagttttttcagaatttttttcaccaaattgagtaaactgtagaataaatgttttgttcgaaggcctcaggaatttataaatgcaagaaaagagcaaaaatgacaaaagaaaaaaggaaatggtaaagaattgtggtcactaatttaatttaaaattttttttttttatttggtgctcaaaatcagtttcctgaaccggaatgggccaacggcgtctcaggcatgtttaagaagtcataacttttttcacagttgacccaatcgaacaaacttgttatcattcgaaagctcttaacaagctctttcggctatcaaaatcgcaaagatttgctgacatataaaaaagttataaacaaatatatggcaaaaattctgacttttttgcgcttttcgcgttgcagcatttttataaatttgttcatcgctt

SEQ ID NO: 28282 - DNA, 727 bp, Heterodera glycines
tatgatgacaatcaatccaagttttcatattttgcatttacatcaaattgcagatgaatgtgatgggaatgcgccaagaactgaacagattttcatcagtgcccggacaaggaacacatctatcccatatcgcccgactgaggccgcgaagcggcctaacaaactaaaaaacgggcgcgaagcgcccgtagtaaattgtataaaaggcggcgacatttcccactcttcctcacataccaacctaggtacatatcagggatggaattccgaggcaccaaaaaatttcggaagtcggaattccgaggaccaaaaatttttcggaagtcggaattccgaccccaaaaatgtcggaagtcggaatttttcaaaaaatataaaatataataaaaaaaatttttaaatatttaataggctaaattttaaaattcttaaccatgtaaaaggtgatatcaaactgtttttagtatatttctatattaatttaaatttttttaatgattttcaaaatatttttatgtaattttacattatttggaattttttttggacagttacacccttttttgtggcgcgctttatccaaagaaaattttggtaataggcggaggggtccggcggtgccgataggcgccgctggaaaaattttagtgatttttaatgcaatttgttaacagatttgtccatgaaaatggccaaatttagcgatttctagcacattttcaagaaa

SEQ ID NO: 28283 - DNA, 958 bp, Heterodera glycines
  misc_feature (925)..(925): n is a, c, g, or t
cgccggggaatttgatccatgaacaaattagacgtaaattcaaaacgcccatgactgatgaacagagacttcatcagcgttttcctcactgcatatcgtgccggcttcaactcaagttttcgtgcaatgtccaacgccaatccgtccatcagggacaccttcttcacatacattttcagaccgacaacttcgaaatggtagcgagtggctgcagcaacaccgggtggtgtgattaggacaaagtcgttgtcgttgggcaaaatttcaatgtccaactcacaaaagttgatcaagtagagaggctggttaaacaaatcggcgtcaattttggcaatgaattgtgctgttctgctgcctacaaacaggttgcgtcgtgcagtgcatccgtctcccacctcaagcacaccaccagtgtcacggtagtaacctgcagcattcaaatgcgagtccttggccgctgttgaataggagagttcgtgtgaaaaatacgatttgtaggccatcagagaatttgcgttgaacacttcacggccattgatgctcattttgatgttacggatgaatgtgtgtccaaccagttgaatcggagcaacctcatcagctgcaaggtcaaccagttgaccatttgcattttctttgcgaattcgaaactcagatagtaaatagcatttggagagatcaatataattttgactggagtgaagcttgaagtgatagggggtgtcggtcagagggttacttgggagcagttcaaacactttggaggatgagacgctgacgttggttggcgggatgcggaaaaagtccaaggcattggtgatggagttcacactgtcattgtcaattttgtggaatgccatttagtaaagtccaaatgcgtcggatcgaacacgttttcttgctggtttactgattgttcggccanattattgtatggtgacttggtgcatgttttctt

SEQ ID NO: 28284 - DNA, 974 bp, Heterodera glycines
aagcatcaattgcggagcgagcaatccggaatgtgaagcagagattgtataggtattttagcggaaaaggagacactgaattgggtggatacagtacagaaaattgtggacggaattaacagctcgccctcgcgtgttcacgggatgcgtccaatagatattgacttttcaaatgctcaggtgtggaagcgaatgtaccgaccgcaatcatttgacagaaaaactccccgcttccataaagataaatttgtacgcatgagcagagataaagggcaattagagaagggatatttacaaaattacggggatgaaatactggagattgatgaggtgctggaagcggtgcacccaattcggtacaagctactggatgagcatggcgagaaattcaaaggaagctttatgagcaggagctggcgcgcgtaagaaaggatgcagagacaagctaccgtatcgagaaggtgttcagaaagaggaaaagagatgatggatcaaccgagatgcttgttaaatttataggatatcccaatcgggagtggattaatgagtctcagcttgtataaaagcatttacattttcattattaatgcagataaacaatcatgtcaaacagtttctttgtgtttttacccagtgatgtgagtgattacccggccaatcagcccaacaaatttcgtgtccgacttccaaaacctttgcattttaatggaacctgggtgtgcgggttgcacagtatcagttacccctactcgtggtcaacaattggcacattggatgagcaatggattgacattcacttcaccgaccgcagcgctattgatgaggaccgacaaagaattatcagggtgccggtgcccaaggcatcgcatagtagggttgaacagctgcgagactttttgactgcaacattgcggaatcatagtggtgcaaattgttgccactccctcgtgagtggaagagaatcgaaatcggac

SEQ ID NO: 28285 - DNA, 915 bp, Heterodera glycines
  misc_feature (62)..(62): n is a, c, g, or t
  misc_feature (69)..(69): n is a, c, g, or t
tccgcacagcgaagcggaccaacccttctaacaccgcccgtatgcgggcactggccaaaggnaccacgncggcaaaactgctcgtcgagaatcagcgctttgatctgtggataattggcagctgcccacgtggcagcaaatccttaagcggtggacgagggaatgctttttaaagactcggccaatcggtctacatattattaccgactgctggaccagagcaaaccacataatctggtagaggtcgaaaaaaattcctaaaattcaaaaacccgaaaaccgttttttaggcctagctcaaaaaattttgaaaattttcgaaattttaaaaactggaaaaatccagctcattgaactctacaataagtctgctggccaccctgcgctcagctcaaaccctaatgagttattcgcctggtactgaactggccaaagttggtactgaatttctccgcgcttctacagcccttcctattatatgtagaggcctggaattttttttgttttttagaaaacacttcaacttaggttcctaccagcaaagactttttgattagagttttagaaaaaaagttatgggccccaaactgcgagaaaaagtaagaaatccttccctgggactcagtcgtccgcgctgaatttttttctatagttttcccggatgcgccgtgaaaagttgtaagaccaatgcacaactttcagaccccccctggttcccggtcttgagatatcctttttggcaacgaaacccctaaccattctaacatatatataactagcgggtgcgtgaaccgtcggctatttagctgggaaaaagcgcttcgcgctttcggagcttcgctacctagataagctctggttgtggagatatttgggaatttttaaaaactatcagcgatttttaggctgcttcgc

SEQ ID NO: 28286 - DNA, 1985 bp, Heterodera glycines
  misc_feature (18)..(18): n is a, c, g, or t
attcaatgttttctcgtntagtctctgctgctagctaatccagcttttatctttgatcaaaataaattatttgaatggcaccgcccgtcagaaaaaagaaaaatcagaagcaaaattttgtaaattttccgactgtttcaaagctatggattttccactgcccgatcgtccgctgcccaacaaaattcgctttgataaccttcaaaaattgagtaattcaaattcgaggggtcaaagtaacagttcgtacaataattttttttattctaagcctttgtacgaactgccgccaagacaccacaattagagtattttttattaacgacaaaaatatccctttccagttacattgaccattccgtcctcgcgtttctccgtgccaataaccaaatttgggacaaaggcaccaatttgtatttgtatgtgtgcacacatggcaatgccattcatatttggaatgtttttgtcggagaaatttggcccatttttgcaacaaatatttgccgtttggcctttatggatggtgatcaactggacaatttgattcgtttcatttcgccaacaattctctttgacctcaacattgattctgtccattccggtgaactgcttcccgatggaattgctgattttgatgggccaaatgcaactccaactgctggccaagcgttgtccaaatggttgcacactccgagaaaagatggccaacccaagcgattgagttgtgatcttatgtcaggaaccattgaatgggtcaacaatttcaaggaggtcagtccccaatttttcgtaaaatatttggattaattggcatttgcttttcgtttcccattgtttaggcatttctccgtgccaccacttcttctgccagctacaaaattcgacttgaactttttgagccaacagaaattgtgccatttgaattggtgaacgaacggaccagcgaaattctaaaattggagaaaggagaagttgatggatgggttttcccatggataatgaaacgatgccaaattggagggccggcggttcaatgggaggacgaaaatttggataatttgaacgatgtccattttatgcttcaagcagattgcattgggtgatttgcttttattggtgccgtcacattaaatttcatttcatttatgccattgtctgcgcaaaaggcgggtcaaatgaacgcaaaatattctctgaaaatgagtgccggaaaaagtgaatgaattattaggaaatgagaaattctgatcattgaatggaaattgatctgataattgctcctcatatttatttgttgcttctttcatttgatcagaaaactacaaaaaactggttttgctttttggatattgataatttatccaaaaaaaatttaaaaatggtttataaactggaaaagcttgacaaatgcgcgaccgcgatacgcgattggcggcattttttttgcgcgatccgcgaccgcaggatttttctgtgcgcgctccagccctgcttcgaccaatagctttcagttttcaataaaaaaagtttacccgaaaattttaaaaaatttgcataaaattaagaattgtcacaaaaaatggaattttattattattttattcattactagagctcgcaaaaaaggcaccaaaaatagcgaaaaaggcactaaaataggcaccaaaaaattaaaaaaaggcatgaaaaaaggaaaaaggcatttaaaatttttttattaagggtttttagagagcaaaaaaacaaaacctaatcaaacaacttaattttgggcatttaaatgattattgattattaaatttttataatgtttttcgcattagaaaatttttaaacctaaaattttttattaagaaaaaaaatgaaattttggcgatcaatttttgagaaaaatttttaattcttaggggtgtattttttgaaaagtttttcatttcttaagggtgtattttcccgatcttattgcatcttttatggaatatttc

SEQ ID NO: 28287 - DNA, 2031 bp, Heterodera glycines
actttgagcatgaaattttcctacttcccttaaacctaaagctcccgcagcgacaccgggacgtgttgctaaaaaggaataaattaaagaaagcattggtgacttttgattttcttactgtcgaaagcccccatggcaactttaaaaccggcacccggcacacccaaaacattttctttgggcacgtgaacatcttcaaaagtaatggcacgagtgtcggagcaacgctggcccatgttaatttcctgtgaaagcaatttacaaaattccaccattgatttatgagatgtaccgtaactaaaaataaggaacccgtgaaattcatggtgaccgtgatcatggtgaatcccaattgatccaattgcttcccattacctttttcccgcgggttattccaggcgtgtctccgtcaacaacaaaggcagtgaatgcctaagatttaaacaaatgagaaacgattaaggaaagcaatcaccttgccagcgggtgtcttggggtccgagtccgatctcgccaagacaaaaaaccattttgcgtatccgccaccggtaatccaggccttgctcccattgagcacccatttatctcctgaaatatttattttcaaatccctctccctctttaaatgagttacctttcagaacggcggttgtcttcactccgctcacgtccgagcctgcccccggctcggtcacacaatacgcggcaatcagtggttccgctgccaacatgccggcgtacttctgtttttgagtttcgttgccggccaaaagaagcggagctaacgcaagcgatgggcccataatggccaattgaatagccgaacagccataagataacgcctcaacgatcagagcagtctccaaattggaacaaccaggcccacatgaaaaggacggcaaatccataaattacttagtactgtttcattcaggaacactacttccagaaaatattaatttttacattgacatttttttaaattaaaaaccgcctcgacacactcaccatatttttcgggaattgtcggattcatcaatcccaattgatgcgcctgtttgataatgtcccaaggaaatgccattgttttgtcatattccgcggctttaggcgcaaccacttccttcgcgaatttaagagctccatcccggatggctttatgtcttaaattgtgaatgtgatatgataaacaatgtgacaaaatgctaaccactcactggtcagataggtcaaaactgatcagtcttcgagacgacaaaccttttccggaaaaagtatcggaacaaaaggcaattagtttcttcgaaagcatcttttaaagattaagaaaatatatttttaagcatttgatatttaaataaatgggttaaccaacagatgaaaactcaaatccaattcgaatcattcttttacacggtctatcaaaaaaagtataataattgtacaaaaaatacacaaataatgactgtccttaaacttactataaaacccatcgaaaattataacttttacagttaattagaatcttactaaattcaattaaaaatgtaatttaagtaacataagatgtcccagtttgagcaactctaaaaaagtataggtaatttatttttttgataaataaatccaccgttgcagcaactgacgagaaataacaagtctttgaatttgagaagtgcctataaaagttgtcattattttgtaaagcatattcgtccagcaaaaccaccttcataaatttgaaatattttggcatcgcgcatcaatttttcagcaggaaattcggtgttgaagccattgcctccgaatatctataagtttttaatgcctttttcaaccattaaaaatatacctggacagcatttgacgccgtctgattcgcagtgtcagcagcgaaacatttggcgattgatgcccaatatgcccccggtcgacccgagtcgacttcctgagcacttttgaaggtcattaatcgtgccaactccacattgatagccatatcagcaagcagaaaagaaacaccctgatgct

SEQ ID NO: 28288 - DNA, 1664 bp, Heterodera glycines
aaaagatgataaaaaggtcaaataaaatttatataatttttaaaaaattgcggatttttatagtattttactcttctcttatgacttttcagaaccgagatataaatttttttctgaaaaatagaaaatttccagaatttctggaataactttttttgtttttgtggtataaatttcaaataaatctcataaaattctccctatttttctcgatttttaatgctttaaatgagctgaattggacaattttgaggcgagttatgaatttttaaaatttaggttgaattttcaagggccaaaaattattgatttttcaaaatttttttaccaccctccaaaaaattcaaaacgcaatataaagtgcatattcgtgttcagcacctcaaattaccccagaaaagtattttttggcaattttaggagcaaaaaaatttctcatgaaatgcaaatccatggggtcccccctttggttttgcatttaaaaattcatttttattttatatctttttttatattaaagataaaaataccggataaagcacattagatagagcttaaaattctctacaaaaatcctctttgacaatttttcgctaaaatcaacccctgacgagttatgagcccgggactgaaatgtcccgctcaagccaaaaaaaatttctatttccggaaaattttgaaattttttcaaaaatgccaccaatcgatagagctcgaaaaacggttgcttgaaagtggtctccgttttcttgggaaaaatcggcaaaaaataataaaattcaaaaacgaaaaattttcgagggggcctagctcgaaaaattttgaaaattttcaaaatctgaaaacaccatcggatgcagctttaaaaactgcacaaatgctcaagcggcgccaacccgctccgcttaacccccagcgagttattcacgaaaagccaaaaccggcattttgagcgccgttcagtcgccaatttctacaggctcggcatttgatctgatcaaaaagtgatcagtgacaaagttgtagccaacatgtctggggtgtgccctctcagcagactttttccgctcccggttcccaggaaaaagttacagcccgaaaaccgagctcgtttttcaaagttggccgtttcagcgcctctggcgctcagttggcctccggaccggaatttccttatttttcccagatgcgccgtcaaaagttacccctgcctgcaaaatttcagccccctccgggcaaaccacggggacttataattttttctacgaaacccaactttattctatatatatataaactagcgtgttgtggcgcagtgattgctcggtgtagacagtatgctttgcacagtgattgctcggtgtagacagtatgctttgcacagtaattgctcggtgtagacagtatacttttggtatatatgggcgggtgctgacatgagcgcttcgcgcaaaggacttcgttgctagtgcatgcgcggcttccatatccgcgtcttttttatatttaaggtttaattcggccgcttcgcggcctcaaagggtgctccgcgcccttttatattctaaggtctaattcagccgcttcgcggcctcaggacgggcgcttcgcgcccgtttttaaattttatggggataatcggccgcttcgcggcctcgggacgg

SEQ ID NO: 28289 - DNA, 976 bp, Heterodera glycines
ttttggcgctaaatcaaaatttgaattttcgcgtcgatactctgtgggtggagggacgcttgctgggtggcaatgccgtagggtgaaaggctaatttaatgctattttaaatatatttatctattttaaatatgtgtttttatttaatttagaattatttatataatttaaattgtttatttttaggaatgtaatatatattatttaaatgttttatttttagatatcccaaaatgactttttcccatgctgcaccagtgcttttcatcatgtttgccattttgtctggacaatccggcgaaacctttgcgttccaagcggagatgcccctgatcatcaacaccttctactcgaacaaggttttaaaatgggaaatgctctgggagtctaattaacccgtaaagtctaatctaatcagtttttaaaatcttaatctggtttaggaaatcttcctccgtgagctgatctccaactcctctgacgctctggacaagatccactaccaggctctgaccgacccttctcagatggagagtggcaaagagctcttcatcaaaatcgtgccgaacaaagccgacctcgtcaacaaccacaaacccggaactgaggcgttcattgaggctcttcaggttttgttttttcgtttggtcaacccctaatccctaaaaaacacttttgttggtaatactggagaatctggactccacccaaaaaatcatttttaagttgtggaaaaacaacccgggattttcggcccttctgatcacgaatatgatatcagatttgcaaaaatgatttattttatcattgtctggtttttgagaccttagatttgaaattttgattaaagtttcgaaaatctaaggtctcaaaaacaatgataaatcgttaattttttttgagttaaggttttgttggtggtgctttgtgggttcgccgtttacgagaatggggcgaggaagggcaacgaagcgcg

SEQ ID NO: 28290 - DNA, 1082 bp, Heterodera glycines
atccaaatgcaatgccatgtccaaaatacccatgttataaatatgatttgttttttgcttttggataatcaagtaaaatgaattccaactttgttagtgatatgtctaccaactacaacaacagcaaccaacaacagtcagtttcaatccgttcatatcagaaccaaatgcagtccgttcctgtgcctattcaacattccgaggtttatataccgttataattttaccattttggacaatttgcttatgtttagactgaaacgaatttctatttccaacaggaaagccaatttaatgggtcgcaaggaccgcaggtgagcatggctttggcatcgtgaattctaaaatgtataggcatttgttattttaagacaattgaacccaatggcaatataaaaaatggttttctccaagagaatgatgtgaccttacagagacagcaacagcaaatggccgtcagttctccctctggtgggttcagcaattttttacaatagtctaagaaatgttcagtgagttcaactgtagattgtaatgctggattgggcaatggacaaaatggcatgcgggtacaaacaggcaatcttaatccctaaccagaatcgccccattttgaagtacggtttttttgctggctcgcaacagtcggatccgtcaagttttcttttgcaacagacaacagtcgaagaaggtgttagcaacggcgacatttgccataatgcgcagcgacatcagctgcaattttctacgatgaacggccaaaatggcggaatgtgttttccatcgaatttgccatcagcaatgtcgatgttagcaaatgctcctcaaagacgaacatttttattcaattcggacatggcaaacaccgctgctaaatctatgcagcagcatttaaccgaagacatggccggttggcatttgcagcactgtcctattgctccctcaacttcacgtgcggcatttgaacagaaaaggacaacaataaacagcagcaacaacataaataatcaagcacttcggacgacaaatggtcggggcaccaagcgaaaggcatcggctgctcactcccatgtcgacacaca

SEQ ID NO: 28291 - DNA, 1016 bp, Heterodera glycines
  misc_feature (58)..(58): n is a, c, g, or t
gaaaaagatgaagcaagaactgaaaacttaagctactaagcatcacaccccctgcgcnttagcaagctaaatttatttttttaaataaaattttttactttttcatttcaaaatacttttcaattttttcatttattttactatttgagtgttgttggttcgttttagaaaaagtgatgagtaatgaagaacaaatttctcgttttcacatcagcggtttaacggataaattatttgtcgttataataattattattcatagagaataaattttttcattccattcattttagcatccattttattaaacacaaaaaaatatttgtattatttttaaaaataataaattttcaaaaaatgaatgcattgaccgctgcgatttttttccttcgttttatctgcgcattcggtaaagaataacaaaaataattattaaattattttaaagattaaaattttaggcttgaagtgctttcttgaatttgaagggaatggaaaattagccaaaaaccaattggatgatttcgagtgcccgcttgaggggcagctctgtttgttcgctcaatgcgtggacgtttacggaggtagtaaaagcgaacaaaaataaaataaaataattatttttttttaaattattattatttaaaaattaaaggtggcattatgccaacttttgtcggctgtcgtcaacgggcgaatgacaactgcacggaatttcttgcgaaatgcaaatcgctgcaagccgatggatgctgctacacttgcagcacagataggtgcaacagtggctggacttgtggcaacgtgtactgtacaaataccgtattggaaaggcggcatttttgtcactatattttttcaaattccaggagtacaatcacttccaccaccacgagtacttcgacgacaagtacgttgaccagcaccaccaccaccaccaccgccgcgaccaccaccaccaccaccaccccaacaacgccgtgccgttgccgtcgactgatagtcgtccgattgtg

SEQ ID NO: 28292 - DNA, 1376 bp, Heterodera glycines
acccaaaaaaggaactctttatgctcgagccaagagacgagaccaaaaaagactccagactattctcgagccaagagtgcgaggccaagaaaaggaacaagactattctcgagccaagagtcgagaccagaaaagactcaggactattctcgagtccagaatcgagacccaaaaagactcgagactattctcgagccaagagtggaggccaaaaaaaggaacaagactattctcgagccaagagtcgaggtcaaaaaaaggaacgagactattctcgagcccagaggcgagaccaaaaaagactcgagactattctcgagccaagagtcgaggacaaaaaaaggaactagactattctcgagccaagagtcgagaccaaaaaagactcgagagtattcgcgagtcaagagtacgaggccaaagaaaaggaacaagactattctcgagccaagagtcgagaccgaaaaagactccagactattctcgagtcaagaatcgagaccagaacagactcgagactattctcgagtcgagaatcgagaccaaagaagactcgagactattctcgagtcaagaatcgagaccaaaagaaggaactagactattctcgagccaggagtcgagaccaaaaaagactcgagactattctcgagtcaagaatcgagaccacaaacaggaacaagactattctcgagccgagagtcgagaccaaaaaagactcaagactattctcgagccaagagtcgagaccaaaaaagactcaagactattctcgagtcaagaatcgagaccaaaaaaaggctcgagacttcgtatggaaaataaactctataaaattaaatttatttttaaatttaattttcgtaaaattttactttcgaaattcattcatcctcaattaagcaaaagttgagtgctcgggcaatgaattttgctgccaccattcgttccgctatgacaaagggcgtcggccttacaataaactgtttggtgtggtgggtgaatggcacatcgacgagtttgaagttggcagtaatctgatgaaatgcaaagcgggggctatcggatgccaaacttaccgatgcaaagacggtgagtcataggaacaaaatggcaccaaaatgtgccaaaattggatgtaaggggagaggggtcggaatgccaaacttaccgatgcaacgacggtgagtcataggaacaaaatggcaccaaactgtgccaaaattggatgtaaggggagaggggtcagaatgccaaacttaccgatgcaaagacggtgagtcataggaacaaaatggcaccaaaatgtgccaaaattggatgtaaggggaggggggtcggaatgccaaatttaccgatacaaagacggtgagtca

SEQ ID NO: 28293 - DNA, 1597 bp, Heterodera glycines
ggctctaaatcacaaaataggtcattttttacccttcaaaagccccattgcactgaaattttcaaaaaattttcctggcgacgcctatcgccaccgccagatccaccccctcccatcagtacccaaaagtttttagaaaaatcgcgccccaaaaaaactatctgaaaaacaaaaaatcatagggtttccatgactggaactcctttgcaaatttaaacactgactcacccccttccccattcagtcccttcccaaattttatatgcatcgggattttaattaatttttatataagaaaactttaaaaaaagttttaaaaatggtctaaaaattgcaaaaatttgagtttttaaatgcgcggtgcgcggacaaaaaacctaaaaattgacatgagattcgataagaaaagcagcagggcatttgggaagacagacactccgttaattatggagttaatgaacactataattggctaattaattaaagggcgaccaccactaaataataatgaaaaaaaaatcaattttttctgacccaacaaaaatgaaaatgagcgaatggagtgaaaaaagaaacagcagaagaagaaccatttttataaaacaaatttcttctcccaacgcacaaaggggagccggaaaatccgacactggaaaatccgacaccggaaaatccgacactggaaaatccgacacaagcagaaaatccgacaccggtggaaaatccgacacaagcagtaaatccgacattggaaaaaccgaccccaactttaaattttaaaaataatttttgattgtttgagttagtaaatatttaaaatacatataataaaagttaaatacttaagttatttaaaataaatatttttattgcttgggctgggggggggactaatggatgaatgtcccctggggggggggggactaatggatgaatgacccctgggtgggggggatattgctggaacggagcctagaagaaaactgactttattttagttatcggagcaagatctagcaaggaacgacatttcttccagaaatttttaaattatttcatcttcaataatttcaaaaaatcaattttttaatccagaatttaaaaaatagaacctttataatgaatgataaacgccaattatatggacataaaataaatatgcttatgaattgcaacatatgcgcatacatttttttcaaattcaggggtaaattttccaaaaaatcttcaaattccttaaatttaagctaatatcttgaatggctaaatatgttatgtaacattattttagaagagaagataccaaaacttccaattaccatttctattaaatttttttgctgaaaatacccaaaataatgaaaattttttcgatccttagaggtcaaaaaagctttaacagagggggccggttttaatgtagtacaatttttcgaaaaaaattcccaaatatgcccctctatttggaaaaaatattcctgtggggattattggcatccggtatattcaattcacttttatttaagcgccacaggattaaaatagggggaaatttttatttttcctggtttttaatttatcaaaaggtaggggccgg

SEQ ID NO: 28294 - DNA, 1574 bp, Heterodera glycines
aatttttgagtctttcacatttttagccgcgatgcgcgatgtgcgatccgcgattcgcggcgttttttttttttgcgcgatccgcggtgcgcggccgcgggatttttctgtgcgcgctccacccctgttacttagagcgtttaattgaaaaacaaaaagaacgcttattgttagttttttcaaaaaaattttaaggcatagaagaacacagaatagggaaattgatgcataaatttccggatttttcgttttgtacactattttggatgcaaatctaagctaaaagtacatatgtctttagatattccccctgccctttaaatttcaatagaaaattgcttttaccgctttcactcttttcaaatcggctttatccctaattttaattgttgcaattaattttaggggttacacatttccctttctcctctttcctctctgttgcgctatcacaacacaattccaattcgtcaacagctttttcttccctcatcgacgagatgacttattcaaattcggtgatcctttctccccacccatttttatgtaatttttccgccatttcccccccccccctcgttcagcgatctcgtcataaaacttccgatgcttcttcgcgacctcgtcgtacgacctccaatgcttcttcatctccaaatcatcgtacgacctccggtgctgctgctccgcgaacttatggttgtgggaccaccattaactccgatgctgctgctcgacgaaatggcgctggttgtgggactgccaaagccatgggtgctttgccaactgccggttgtgggactgccaaagccatgggtgctttgccaactgccggttgtgggactgccaaagccatgggtgctttgccaactgccggttgtgggactgccaaagctgcttctcgaactcgtcatgcgacctccagtgctgcttcaactgctgctgctgctgctggccgtagtcacagcggttcaagcaaatgcgtcttttgcaacaacaaataattttgctccatttttcaaggtgctgcaacgaacggagcggcgggcgcggaagtggcaccggcgaagaatgccaacaacaacaatacgacccgacatgggaatgcggccagcagctcctcaagcagcgacagtgactgaatgacgtgacgcgtggtcggatgagccatggtacaacaacaacaacaataacaacggcatgaagaaaagtggcgatcggaattgacgagaatttttgcagaggatattaattaaatcacggataattttgccatgagattgatctcccgtcaaatccatccgatttgtatgtatataatttcacccaaaatgccatcatcatgatgttgttaccaatgcctaaatatgtgccatctgtgtattgtgaatgtactaataacatatattctgttgtttcattgattcattctaggggtttttcggggtcgctgatcacgaatctgacatccatttcgaccaattttgaatcccggacccgaattcgaacaaaaagtcgaaaattctaatttttcaaaaatcattttacggtgcgaaaataacaaaagttcaaca

SEQ ID NO: 28295 - DNA, 863 bp, Heterodera glycines
gaaagaaaagaaaaagaaatttaaaagaattgaactttctaccaatgtttgagtaagtgttaaccagcagagaaaggggaacagagctgggcgaaactcgacttacaattagcactcgaaaccgaggcggaaaacccagaggttttcaaagcccaagaattttcaaaaaacaatttagggagtgtgttttttccgaaacttatggtaatttacacaaaattcgaagctcacaaaacctcaagttcacccagctctgatggggaagggaaaggagtttttgctgcccaatctttgaaatgacaaacaaaactcaaagttggagcaaacccatcggaataagccaactcgtatttgatcagcaaagatatgaacgaacgaacggaaatttgatgtacaaagaaggacaattgacggaatacccaaagaatgcattcgaaccgtgagaggggcgggggaagaaatatcagtggaaatgaaagagagggaatgtccggcaaagggcagttgcgcaaaagccaagacaaacataattaagagggtttttggtaattcttcagcttaattggcattttttgtttggatgaaacaaagcaaaacaaagaagcggagatatatttataaaggaagattctgagtttacaaaatgagctttaaaagagaaacagacggaattaaattgaaataaaatgacaaaataaaattttgctttgtgagtgtgtaccgtacaccatttgtagatatctacagtatgagaagagaagaaagaagtgaacacagtgatcgattggcattgtatttgcttgcttatgctaaactggctgcagaacataaaagagacatataaagaaaaggagcatcgcaaa

SEQ ID NO: 28296 - DNA, 1472 bp, Heterodera glycines
gagattgctgtttattaaaatccacaggatttggctttgttgttttgttgctgttcaggagccgttcgttaattgcttcggctaatattttagtataaaaatgtttttttttttttctcctccgctcgcgtccagacatttgcggacaatttcgggaaaaaatatttataaaaatttttgttttaaatgcaatgcaaaatttggtctcatcagaacgtttctcttaattttagatataaaaaaatattttgaagatatgcttaatcatgatcaaaatttactttcactatttcaaattaacagatcgtaacaagtccgttcggttttactcattttaaacttaaagtgccaattttgaccaattgtaacatgggggtcaaaaaatgtgcttttccccactctgtcacctataattaacagcagaagtctttgctaaaaagacaaattcttttttctgaaactaaacacattcgatagaagtacgaaaggtctaaattattgatatcaatcaaaatactacaaatacacggtaagatgtacgttaaagtcaataagttattcaataaatcatggagtactccttttcatcaaaaaaaaggtaaatagacaaaaatcaatattctgcctttaatgtgaatagttagaaatgggtgcaggattagtgatcgccgaccccgaaaacccttttaaacatgttttcatgacttttgaatcataaaaaaattttcgaaaaagggggggggacaaagcacagtattacccccaaaaaataaggcatttgctgactttcaggaaaagcgagattttgtgaaaaatggctaccaattaaatccccggatatcaaccatattactagtaataggcggaatttggccatatccgaaaagaagcgaacaaaaccgagaaaccgttttattttgtagaacagtgtgtgggttggttaatggtacgagaatgcgacagaaaataaaagggggaagggagacaaaaaaagggtgtcaaaataaacggaagaaatcaaaagaaaaaacaaacaaacaaaaaatgggggtggtgaaattatcatcattacacagagatccatccgcgcaagggtcagcaaaagtcacacattcaacacgtcaaaagtcagggcgatttgctgctcgccgattcgtcagggtcagtccctgaagagtgtattgcaataggaaatgtttaaaaccgattccaaatttttgttcgaatcagggttcgaggcttgaattggtgtcaaaaccgaacagggttctccgagccgaaaaacccctaaaatagggaaccatcccttttatgaatattctagatttggggaccaatttatttatgacagtcaattcgaacaaccattacaaatcatggccgaaaaattttttccggactcggggttcgaaatttactaacttcgggggtttattgtttcgtaattctttttacgattttaaataaactaa

SEQ ID NO: 28297 - DNA, 1929 bp, Heterodera glycines
taattaatgtgaatatcatttaaaaaccaataaataatccttttaaagttcatcagcaattaatagagcccggaaatttcttatttgcggatcccgctgcggggttggaactcaaaatttttttgggatacgggatcccgtgggattaatcccgaaaatcccgcaatttaaaaaaaaaattcgggattgcggattgggattccacaaaatcccgcacgggatcccgtctcgtaccgggcactagtaattaatccattcataattaatacaatttggaggtttgaaattttccataatttattctctataactaaatttcacaaattaaactgttctcaccttggctttattttaatgatttttttaagaaaattatgaattagatttattgaaaattttgtttcatttaatttaaaattattaaaaaaaatttttttttaaagaattaatgatgaaaaagtgaagagactaatcattcaattgaatgtggacattgcaatggctgaccttttcgtggaagtgaatgatccggcaaaaaaacgtgccaatctttgcctaatggacagtttgttgactcatctggtggcaaatggcacattgtacacagaagtccaagaatggcaaacccacatgctttatgaacattttattaatcatgtaaaattacaaagataatttatttattttttaaattaaggttctttggttaatgtttaatcatgaaacttgttctcgaggggtttttgacgacctctgatcatgaaaatgacatctattttggccaacttctaactaacccgaactcggacaaaagtttaaaattccaattgtccatttatgattttttgttcaaatttaagccatttttaaagtagcgcaacaaattccattgatttaaagatgaatttaaaatctttaaataattccaaaaaaaaaacaaatgcaatttctttttttgctaagaatttcatacagtccatgattagaatcaatcaatatagccgcattgattgatcagcttcaatcaataatgattgttggttgaccaaaaccaatcaatcctcattattcagaacgaaattccgcgttcatcggatgccgatttgcgctgggccaaaccggagtgccataaggcggaggtggcccaagcggcagtgagcaaattattgagccaaatgcatttggtggtacaatcgcacagttttgtgctgtgccaagttgcacaggattgtgccgaattcgtatcatttgtcaaccaatatgcgattaggaatttcgaaaaattatattgctgtaatcaatgtgccataggtcgtcgtatcgtaatagtgccagtttgcaaaattttcaagcaaaactcttcccacttttgatgatatggatgggctattaaaattataccagttttctccaaaatctgtaaaatggtttttaccaaggatccacccgtccgggtcattaacccgggcaccctcgttttacaagggtttgaaaatttgaaacaaaacacctcaaaaaaacttaagttggcccttgttttgggggggccaaagaaatttcttttttttttgaaaatttttttttggcacgggggttttttcccccaaatttccccctttttttttcccccccgtataacaaaaaacccccccccaaaaaaaaaaaaatttttttttttttttttttttttttaaaaaaaaatttttttttgaagaaaaaatattataaaaaaaaaaatttggcccccccccccccgggagaaaaaaaaaaaagaaagaaaattttttgttttttttttttttttttttttttttttttttttaaaaaaaaaaaaaaaaaaaacttttttttttttttttttttttttttttttttataaaaaaataaataaaaaaaaaaaaaaaaaaaaaaaaattttttttttttttt

SEQ ID NO: 28298 - DNA, 1367 bp, Heterodera glycines
  misc_feature (1177)..(1178): n is a, c, g, or t
  misc_feature (1195)..(1195): n is a, c, g, or t
  misc_feature (1255)..(1255): n is a, c, g, or t
ggtgcaaaataagctattaaatttttaaaaatttaccagtttctttcgggtgtcgtggccaaatgtacacagacaactcgtacaatttgcttagaagctttaggttagaccttgccttaggcttaaacacggagagacggagaatttgaatcttgaattgatcagaaagtaaatgtgataaatgtgatttgaaagggaaaacttttgcttatcatctgcgaaatctataaatttattacaaaacaaggatcggttgaaatttaaaaccattgagcatgaatgaaagtatttttaaaatcccgtaaatggtaaaagccggggctgatgctcgagagtctcggtctcggctcgagaaaagtctcgagtttttttggtctcggtctcgctctcggcattttcagtctcggtctcgattttcgagactcgagaccgaaaagagattgttttacttcccgaatgattggcttttgataaacttaaatttaacacatttttggtaactttttaaatttaataaaatttgatttgcacttttttcacccggcgacgcctaaaaccttaaattttttcttaaagacatgatcaaaatcgaaaattttgtcactttttggtgaaacctattcagcacgtccaaattttcaaaattttccccggcgacgctaacggcaccaccgaacccccaaaattcccttcacaaaaagaatgtaaaaaaatcgctgagccatgatggggccataggcgcaccaatacggcagtgaaaaattcaatttacgaagagaaaaaacttacaaatttcttgttttgtgtttttggagttataatatgtacctaattgaatttaaaaaaaaagaaaatggttaagaaaagactcgaaaaaaataaatgatttttaaacaaaaatttttgaaaaaagtctcgggtttttcggtctcggagtcaagtctcggtccgaaagagtgaaggttagggaccggcgaggggacgggatccagacacggggttttgcggggtcctagtccgcaatcccatattttttggaacctgcgcgatttgcgggatccgaattgtattgtttttgaaaatacaaaagacagaatgccaaactaaataaatttactataaaatcaattaaagataaaccaattttctagggttcggaccccgtgggcgggggggnncttttcacgggggcggnggatggcgggggtcagagtcgcgggggcggggagggggcagaataattcgcccccgcggngggggggggggggggtttgatttgaattaactccaaaaaatttacaaaaaataattttttatgaatgatgtgatggctccacattcctttagtcaatgtatcgcctcaattc

SEQ ID NO: 28299 - DNA, 1071 bp, Heterodera glycines
  misc_feature (10)..(10): n is a, c, g, or t
tttttatatntagagtctatcccagaaaaatggctatctcttttttgataaattttatacacatacaaatgctctcgagcaggatagggaggccgttgcgcaatagaccttttatttttgagggattttaaatttatactctatcccagaaaaatgtctatctcttttttgagaattttatatacatcacaaaagctcttgagtatgatagggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaataggtatctctttttttgagaaattttatac

SEQ ID NO: 28300 - DNA, 888 bp, Heterodera glycines
cattggctcttacccatgagggtaaccttggtaccctcctagtaaactcgaaaattgtattgatggtatactcacctgcatcttgccaatgagggtattattggtacaggaagcctatcaattctttgtccctgtacagctcatgtagtgaacggtagcgctgatctgagcccggattcgtgatcagcgaccccaaaaaccccttaaaacctattttcattaaaaaatgaatacatttataggcatttgaaaatgtatgtgaaatctgccccttaaacttaaagagtaccaaaaattattatattactttttgtgtaatttaaaatacaaaatatttttcaaatttaatttattcaaaaattcaaattgccaaaaatatattaaaaaatgcgcatttttttgaacttttaaacctttacacattttcagactcaccaaatgctcccctccccaccgcctccactcttttgccgatttgtttaccaaaaaaattatttggaggcaaaaaaaaaaattccctttgttcaccccaattaatcgcattttcattcttcatttaatttcccccggttttcgcctcataaatgaatttatttatctttcgctcttctgctgttggtgctgtgttcttttcattcataacaaattgttcccattattattaaataaaataaataaataaaaattgaaaaaataaataaataattaagggtttaattttaaattattatatttttctttgtaaacaaaaaaaaagaaaatttgtttgtgaattaaaagttcaaattagttattaacttatggttatttcattttagaaaaaaatttttttttttttcatttttaatttcatgtcactaaatgcacaattaattacctatccgaatt

SEQ ID NO: 28301 - DNA, 1297 bp, Heterodera glycines
aaaattttaagattctgaaagtgggaaaccggaaatatggcggaaaaaaagttttacgatttttttccaaaaatggggtgttaattttaaaatagagacacttaataaaaacgaacaaaatctcaacaactaccaaaaataaacagataaaacaaactaaataagaaagaataaatcttttttcacatttctgtttattttgcgaacagaaatatgtcttttaggcagagttatgttgaattttctaagttttcaggagaaattaagggccaaaaggcttaaatcgcctctaacatttgcccaaccgaatcaaactaacagcaatcagcactaagataacgtacagacatcctttaagcattttttattcattttatgccataaaaaggcattaaacacaaaatttttgcgggtgaaaaaatacgaaaatctgagtaaattcgaaaaaaaaattctagggggttgggaaaaattttccgtagaagatgattaagacgaacagaaagagcacaaaatggcctttgaatgaggtctctacgtcgcgtctccgcgaaggcgcgtcttgctgaaaatggatgtctcaaagatgaggaaaaatgccttgaattgggtctttttttggatagtcggtatttaacaaggcacccctcagcgaatacttggtatagagcaatcattcaaaggccattttgtatagaattttgtgctctttctgttcgtcatattcatcttctatggaaaatttttcccaatcccctagaatttttttttcgaatttactcagattttcgtattttttcacccgcaaaaattttgtgtttaatgcctttttatggcataaaatgaataaaaaatgcttaaaggatgtctgtacgttatattagtgctgattgctgttagtttgattcggttgggcaaatgttagaggcgatttaagccttttggcccttaatttctcctgaaaacttagaaaattcaacataacgctgcctaaaagacatatttctgttcgcaaaataaacagaaatgtgaaaaaagatttattctttcttatttagtttgttttatctgtttatttttggtagttgttgagattttgttcgtttttatcaagtgtctctattttaaattaacaccccatttttgaaaaaaaatcgtaaaacttttttccgtcatcatttcggtttctcactttcagaatcttaatattttcagaattgctacgtacagttaaaaattcagctcgatcggttcatgggaagtggtcaaactcccaaaaaacagggtgtctttattt

SEQ ID NO: 28302 - DNA, 1011 bp, Heterodera glycines
  misc_feature (25)..(25): n is a, c, g, or t
gagccagggttgcttgactctgacnccaggcgttgaatgttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgct

SEQ ID NO: 28303 - DNA, 1453 bp, Heterodera glycines
ccgcggtttggtcgacccccggcgattctgcgctttgctccgccatcgcttcgtcttccaaattcgcaaaaaagtttttccgcaatttgggccctttcgttttcgatcttttccataaattcattttttgcctttagaatttttcccagcaattcatttttggcatgttctctgagattttgttgcctagtattaaacgaatttcgctcatcttcaaattttttgagtatttttgctttttcttcttcgggtagctttcctgattttaataaattattcattatgaatagggctgggatttttatgtttaccttttttgtagaaaaaatttaaaaaaacacacaaagaatttggcagataaaaaacatatttcggaattttagcagatattttttttaagaaaaatgcattaaaatataaaaaactataataaaatttggtgcactaaaaattttcgaattttaatgaggttgaaaattttgcataatttttttcattggcttaacttagcaattccgaaattattatagagaattttttaacaaataaaatgcgcgtaaatattttgcataattcaataaggaaaacaaaagttatgacaaatgcaaaagtgcccaattattacttttgcctcgccccgtgtttgtacgagaacactcgccagattcctggcgattattttcttcgttttcttaatttaaaaaaatttaaattttcatatttgtataatttaccattttcatcaccggggaaagggcgacagtcattaaatattaaaaaagaaatgaaaaatattagaaaatatttcattattcaataaattgtacaaaataattcgtttaatattatggaaaaaatgaatgaaaagaaaatatttaaacaaatattattattgtaaatattcgagcgcgtgcaaaaatcaattattattattttttgttgcagcaatgaaaaaatgccaacgtgtgtccctttgtcattggcacggatgtttgtttgaatagccacagaaaagacgtaataaaataaaaattatatttgtttttgaaatttttttgcttgtcccgttaaaatattacgctaactttgctgcttgatgtcaatgcagagacacatgcgacgagagaaagactgtatgacagagaaaaaaagagaaaattaagagaaagaccgtttggcagagaagaaaagaaaaaaatgaaattttatcagagattgttgcatttattcctcccaactgatgctgctgtctgctgtgcgatttgcgcccccttttgctgattttttaaattttggcttgtatgcacataaaaagggaatagaactacatggaaatccatattttttcctggcctgtgggaggcctgaaacgcacgaaaaacatgtttttaacttggtttgaagcttttaggatgggtttccatatccatattttccatattttttcatattt

SEQ ID NO: 28304 - DNA, 1428 bp, Heterodera glycines
  misc_feature (1276)..(1276): n is a, c, g, or t
  misc_feature (1304)..(1304): n is a, c, g, or t
  misc_feature (1319)..(1319): n is a, c, g, or t
  misc_feature (1332)..(1332): n is a, c, g, or t
  misc_feature (1419)..(1419): n is a, c, g, or t
aaatttccgactttttatcaaaaatttctgaaattggaaatcggaattccgacgtccaaaattttttcggaagtcggaaatcggaattccgtgccatccctggtataatgtacctaaatgattagatttcgactgtatacattagaatcgatgtcaaagtagacagtgattgggttaattaattttttttaatcacccgaaacaaaactttgattttatatccggtaggtgagtaatgtcattgttcatctaatcatatcacaaaaattggcacatttttagggtctgacggtgccgataggcgcaagggaatttgaaagttccagtataatttttgacaaatttatgaaattgcctcctatttttggtcacatttaaaaaccagatttaaaatatatcaaattttatgaaaaattttcagatagttacagaaattactgctaataaattttctcagcaaaagaatggagccaatgccaccgtacacggtcatttgtccgggggtatattgttagtgaaatcatttatttgtagattttgacaagagaagaatttttgaaagagatgcagaaacttacgcaatcgacagcagaaaatttggggatttcggaagcattgacaaaactcatgttgaacatttataattgggacgagaagacattgacagcagagtaatatttcatttttattcttattttatttccaaatttaggcataaccgagcagcagataaggaggcattttttgaagaaaaaaaaattgccactgggaacccaaaggcgccggcggagggtgaaaagtgccaaacgtgtgacagtgaaaaattttgcaaaatgtcgccatgtgggtgtttcttttgtgtcggatgctggagtcgctatttttggaaagaggcgagtattgaaaattcacgttattaaattattacaaagtttttagataaatcttaaacagacagtccttttgacttgcattggctgttcccattttgctgatgaacaattcatcagtcaaacgtttgaagaatttaacaaaatcaatgatgtggaatacattggagaattgctgaattgaatgcgaatcaaaaaaaacttgtgctgagatttttggagttggctctgaaaaccattgtcaaagtatagttgtttaggcattatcaatgtattaaattaatctttttagcgtaatccgtttgtggaatcatgcccccaaagtacgtgctcgaaaattatcaaagtcaataaagccgggccctgcatagtcaagtgcacctgtnaacgagccttttgttttgcctgcactanagtaacgataatggngaataccccaatnacatttttttgattccaagtaccgcatgctccaatcaggtaaacggacataatgcttcttggtttcaataaaatcgattttagttgntcattactc

SEQ ID NO: 28305 - DNA, 584 bp, Heterodera glycines
  misc_feature (576)..(576): n is a, c, g, or t
gagaaagaaaaattggtagtcgacaaactaaaagaaaagctcttacaagatgcggttctgtattttccggatttcacggcagcaatgaataaccccgatcgatgcttcaccatactcactgacgccagtaaaattggaatatcggccgttttgtgccaggctgatgaaaacaaaagcattcggccaatttacttcgcgtcacgacaatgaagtaaacacgaaagtaattactgtccaactgagcttgaagctctcgcagttcgattcggtgcctggaaatttgcgcaatttataacaggaattccgacaaaaattgtaacggaccataaagcgctcccgccgatgtttcgtagtaagaaacaaacaggaaattctcgcgttgaccgttggttaatggagttaaacgctcgtttcgatctgacagttgtgtacagccctggtaaatcgaacatcgtggctgatcttttgtcgcgctccggtgcgttggtaaataaagcaaaagaagccattgagtccgataatgattttctctagaaagtttgttatagaaggcttagtaatagacgaaattggccnagacctgc

SEQ ID NO: 28306 - DNA, 1594 bp, Heterodera glycines
gaaaagggctaaaagtagcatttcttcgttaaagttttttgattaggtgaaggtttttaggcatttaaatcaggggtgcgatctgttctgatttatcagaaatgttctgatttggagggtccaaatctgataaataaaaatgttctgatttgtcagaaatgttctgattttgtggtcgcgacaattttgaaaaaatctccggcaaaaaaaaagcgtttttaaacgcaaaaaaatctgattttttcatcccgagtgcactgaaattttcgatttgctaatttcctcaccaaaatttttaaaaatgataatcggtggcgaaaaatataatttttaatacatttttgattaaataaattgtaaaaataactgatttgaagcaattttgcaaaatgttctgatttttgaccccaaaatctgattttttgagcctcgatgttctgatttttgaaaaattttcgatcgcacccctgatttaaatgcatattttgagggttttcgagaataaatgcatatttcgtctttttgggttttaatattatttttttttgtgaaattcgacgagaaattataatggatagggctccctttttaggcaaatgcctaaaattttgcgcacttgatacgcaaagataagcacgaaaaacgcgttttccgcttgatttgagttgtctacgacggggtgcggatatgtcctgatttatcagatttgtcctgacttggaggtagcgaccaaaatttgttctgatttcttaaataaactcataatttgaaatattatgacataatgttactattttatcaaggaaatataaggtttgcccaaaatttggttattttttggacaaaaatctgttaataaatcgcattaaaaataacaaaaaaaaatttcccggcgcgcctatccatccctaaaatttttttgaaaaatgcgccgcaaaaaaagcgtttttaaaagcaaaaaaaaaaagtccaaaaatctggtgtttttggtatggtattctgattttgcaaaatgtatgttctgattctgtgctgattatctcattacacaaatatcccttgctgtacacccagtctgatcactctttgtccgtcttttggcctgcactgatcagcccattgatcagtttcccatcctccattcccccgtaggctttgcgtgttgcgccttggtcatcctccgcgtacgtcgtccgcgcctgctgggccctgtttctgctgtacgaatgctacaagaccatgttcgtctacgtgcccatttcccacgtgttcggccccatgttggtgcgcattcggctgatgatcacccgcgacctggtcaacttcctgctgctgattctgctcgtattggtcggaaatgcccttgccatcaaagcggtgcttttccccgacctctccgccaaccgcgaaaccgtcgccacttccgtgcactggacattccaacagctgttcaccaccgacctcagcgttcttgcgcagtccgatgaatgtaagaggcaattgctgccccaaagtcggcccttttgccaaagtgtcggtggttatgccaaccccgaggtgcttgtggccaatttgctttttgaatttttaattt

SEQ ID NO: 28307 - DNA, 1337 bp, Heterodera glycines
  misc_feature (72)..(72): n is a, c, g, or t
  misc_feature (76)..(76): n is a, c, g, or t
  misc_feature (90)..(91): n is a, c, g, or t
ttttgattttttgttgcttaaaattaatgaattttcgttttatcctttattataaattaaaataaatatatntaanaataatatttactnntagaagttaatggattcgcaattgctaccatcagaactttgtcaaaaaatgaagaatttttacaatataaccagtgaattggacagaaaattgttgcacattatgtggtgggatgaaattgactgtttgaaaatcaatgaaacagctgttgacccattttacccgtttttgaattccgcagaaaaacaaaaataaacaaatttaaatttcttatttaatttaaatttaaccgagacttgagaatttttaactgaaattaaataactggacaggatcttgaggcagatgcctttttttttgctaacttactgcggcctaatacgcaccaaaaaacgagtttttaacttggtttgaagcttctagctttaactttttggtgcctttttttgcgattttgatgccaaattccgggcaactaatttttgtgtcttttttgacgttcatgccgtttcgtgcattttttcgtaaaaaaatttttttggtgtattatttttaatttccaaaatgtcgatccttaggtgtgcgttttcgctttttctgcagtgatcattttcaaaaaatggctaaatcattgtcgaaaaacccaaaaatggcgaatagaaatgatatttttgtgctcctttcttcatatacgtaaatccatataatttaaaccctatttcataactttttttcaatttgctaaggaatagagaaccttaagggctatcgaatgatactaaaatgttttgaagcctaagttatgacaattttttggaagagaaacattacgagtcgaggcaggattaaaagaatttaatgaaaattcatttttactccagaaaaactctaagtgtattgaattgtcagtgcaaaaagaaaaaatgagaatattttgttaatttaatagaaaattttatcaaaagaattaatgtttgctgcctttttccaattttttgtgacttttttcatcttcgtgctattttaggtggctaattgaaaaatgttcgtgcctaaaagtccggtccctataaataaatcaccaatagaagcagtggaaaacttgaaatcgtcctactaaaaagacgtctaaacatagtcccaatcgttttcttatgacatgaaacatcaaattaaattggaaaaacaaaaaaaaaagtaaaaaatgattttaaaaaaataaaaaactcaaaaaaatagaaataaagattaataaaaaaaataattaaaggaaaaaatcgttaaaaaaaaaatcaaatggcttctg

SEQ ID NO: 28308 - DNA, 932 bp, Heterodera glycines
ttgctgcttaattcgttgccaaatgacaataatgccgcttccatcactttccctgcccttaaagtgttgtacaaatgcttcgacacatttgactcaaaacagtcagtgtttttgcctttgagtgttttttacgaaatttttttcccttttcagagaccccagggcaaatggctgtgattccagcgttggcattctcgagttaccgactgactcgtgtcttcgtcttaccgaaatgctgctgtccagctctttggcccttccgccgcctcttagagcccttgggcaattctacgtaattatataactaacaaatatttaattgtatacaacaacaatttattgtacatatgtccgtttgagtatttgttatcggttaaggtcgggttcattcgtatgaaagatagagttgattaatgggctgtgattattgatgttcgactgtttccgtttgcgatttgatttttttgccaatgatgtacattccgcatttgttgcaattgaacccaaaaaatgtttctggcctttatccccgcaggcaatcgcattttgtataatctgttccatttttaatcacataatttaacttcgttacgttatcggttttaaaaaacattttatagaataaacatacttttgaatttcttacgtcagagaaatccattacttaacacaccgtccgaaaaaacgagatgtgtaccaataaatagagagtgccagagaaaaacattatcttttttctctaattttttgtctccttttggcgtactatctgttagatccacaggaaattttgcatatagttagagaaaaaaattctgcatcgattaatgctgaatttatttttattaagaaaaacaaaattttaaggcctcataacttttctctggtacaccaaatcgcttagcatttgcttagaaaagcttctcattatc

SEQ ID NO: 28309 - DNA, 1518 bp, Heterodera glycines
  misc_feature (1277)..(1277): n is a, c, g, or t
  misc_feature (1319)..(1319): n is a, c, g, or t
cccccccccccccccccgcccaaaaaacgtgactggacaatttgacagtaaaatacacaaacagatatgaaaccaccgtcgcctatggcacaatcggttccctacggcgctgtccgattattgcgggcccttgttagttaggatatgttttcaaaaattgccctgatcagtctgtacatcgagaaatcctccaggacccaaccctcttccatgctctttcttccttaccattcgattggtgaagtgatcacccccgacctgagatttcaacaccgccgttgtttttcaaaaatggcgaaaatattcttttttcctaccttggtcattgttgatcgatgcgaagtatccattgcgaaaaacgccgacacgagaagcgctcgtgccatgaccgatgccaattgcatttgtatttttcggcatttttttatgcgattggaagtttggtaaatcttaaatctagtttaattttttaccgttggttgataaaagttaatgatttgtttgtttatttttgtcttgacttattcggtgagcatttttaatctttagaatgactatgatattgaaatagaagaagaaacaatagaaattataaatatagacgacgatgaagtatcagactattcacagatatacaatctctagccaaatgaataattcaactcttagaaaaatgaaacaacgaaaaaaaaagaatattgatcaaaaagagagcgaaaagcaaaaatcgcgaaagaatggctttaaatcgttaaatttttgtagaagaaagtcaggtagaaaagcaaaaaaaccgtgaaagaatggcttcaaaacgtaaaaaagaattaaatggaaaaattgaatcttatatttgtgcagatagtttaagtgttacaaaacacaacatagcttttccgattatcattagggccgggaattaaagtcactaaaaatccataaaaatcgccaaaaagtcacaaaaaagtcataaaaaaggcaaaaaaagtccaaaaaagcacgtaaaaaatgcaaaaatgtcctgaaaaattaggcgaaagttaacaaaatcccatttttaataatttatagaataacattttgatcgtatttttaggcacttaattttataaataggtacctaaatgggcataaaaaagagattcttccaacaattaagaaaaaattcatccaggtttcattgcctttttatcgatcgaaattttatttttcggaatttctttgtatttttcggcattttcttcgctaaaattcaaattttgcttcagtaagcctanaaaaatcacgaaaaaagtcgcaaaaactcaaaaaagtcatanaaatcccaaaaaatgcgaacgctgtgaaagtgacagtgtttttccaatgagtaaacaatctctggttgtaattatgcattttttcagcgtcaaagtcccgtctcagtttacgaaatggtggtctgataaatattggcgactatagggctcagccataaatgttataattaatgctgaaaagatgggaagaaaaaaataa

SEQ ID NO: 28310 - DNA, 965 bp, Heterodera glycines
  misc_feature (902)..(902): n is a, c, g, or t
ggtcgaataaaccattttttaggatttattacacatttttggcaattaaaccataaggaaaatgcaatgtgtaaaaatttgaaaatattattaataaaaaacaaattaaacattagacaaaccataattaactcttaatgtattggctttaaaatgaggctgtaatctcgaaattaaaaaaaaattctcaattttaaatgaatttttcaaaagaattttggacaatatttttcaccttcatagtaaaacttggcaagagacactattctgaatggagctgcaacccggcatcaaatgccgaacaacacatcgacacttgccgtgccataacccccgagcagagccgagacgagaaagttatgaaatgttattgcaacactttccattattcggccggcgaaatgggaaacgaacatgaaaccttcgaggagcattatgagcggattttaaaatctctgaaaaaggggccataatttttttgcagtgcatttattgccttggggattataatttgtgaacccaaagatgtgcaaaatgatagacaaaacaaaaaatctaaaaaaactaattttggtttaaaatttcaaaaattctcatttaaaaaaagttgaaaaacacaaaattcaaaaaaaatttggtgacagtttttccaaaaccccaatgatttttttaaatttcacattgttaaaggattttagtggagctaataataagatagaccaagcatttaaaatgttttaaattaattttataacgaataatataatgaaggtctgtctacctaatcgatctcggatttactaccaaaagcacatttatgggtgaattattctttgtttatatgcttttcagtttaattattttatgtaatattcccattaattatcaaattttcgcgtgcngtccatcaccattttgtggcgctaaaaacaaagttaagcaaaaaaacaaacaaaaaactgcta

SEQ ID NO: 28311 - DNA, 806 bp, Heterodera glycines
tgttagaattgaccttatagattcaaaaaataaacctctaaaatggaaattttctcaaaaataaattccttaaattttatttattttttgctttttctcagtaactttgatttggaaaagcgatccggacggatccagagtcgggatcccgaccaaatcagagttaaaataaaaatttattggactattcttaccagtgcctttttcccggttcccgagagccctgccggaggtctgtatcgtttctacgccgactttcggcgccagcccgaattttttggttataacttttttattgttgaccaatcctacaatcttgataacattcgaaatacatgtttagaagctgtttttaagctattattttgcgattagagacaattaccaaaaaagttataacatgaaattatcaaaagttgaaattttgaagttttttctcaataactttttatttgctagaaatgctttttgtaaagctaaaagaaaaatacccaaaatatgtaccaatatgtaaataaaattttaaaataattatttttttattcttcggaaagggtgaaataagcacaaaattacataaaaaatgacctatatgcttaaaacatatttaagtttttgaaaaataattttcggttaattttttttttcaaaagaaatttttataaattttcaaaaatcctaaaatatgtaaaaaatgtatgaaaaagtccgaaaagtccaaaatatgtaccaaatatgtataaaatctcgaattatgtaaaatatgtataaaaccccgatatatgtaaataaaagtcccaactttt

SEQ ID NO: 28312 - DNA, 1211 bp, Heterodera glycines
  misc_feature (1131)..(1131): n is a, c, g, or t
  misc_feature (1159)..(1159): n is a, c, g, or t
  misc_feature (1201)..(1201): n is a, c, g, or t
agtatccctgcaaagtttgctgcgcttctgatcagttccggaaaaaaagtttaagcctaaactttttgccctgtttaaaaagggaattaaaaatttttaaaaattttattcatctccctttttgatagaaaaagcatcagagtgcctaaactagcatgtaaataaaatttggtgcgtttcagagcagtttctgtaaaaatacttatgaattaattttgtaaaaaaataaataaacagttaaaaactcagaatttctaaaaaaatttaaaatcaattacaattgtcattttttcaggttaagttagtcctgtaccggggagtatgcttataaaatttggtacgattttattgcttattgaaagagctagaaccgaagaaaattttttttatttaagcctaaactttttggcatgtttaaaaagcaaattaaaaattttattcatctccctttttgatagtaaaagcatcagagtgcctaaactagcatgtaaataaaatttgatgcgtttcagagcattttctgaaaaaatatttatgaattaattttgcaaaaaataataaacagttaaaaactcagaatttctaaaaaaaattaaaaccaattacaattgtcattttttcaggttagttagtcctgtaccggggagtatgcctataaaatttggtacgattttattgcttattgaaagagctagagccgaagaaaatttttttaatttaagcctaaactttttggcatgtttaaaaagcaattaaaaattttattcatctccctttttgatagaaaaagcatcagagtgcctaaactagcatgtaaataaaatttggtgcgtttcagagctgtttctgtaaaaatatttatgaattaattttgcaaaaaataataaacagttaaaaactcagaatttctaaaaaaatttaaaaccaattacaattgttattttttcaggttagttagtcctgtaccggggagtatgcctataaaatttggtacgattttattgcttattgaaagagctagagccgaagaaaatttttttaatttaagcctaaactttttggcatgtttaaaaagcaattaaaaattttattcatctccctttttgatagaaaaagcatcagagtgcctanactagcatgtaaataaaatttggtgcgnttcagagcagtttctgtaaaaatacttatgaattaattttgntaaaaaataa

SEQ ID NO: 28313 - DNA, 917 bp, Heterodera glycines
cttcataaatgccaggccacagcgaggacactttctgatcaccgcctcgttcagtttcttctccctgacatgcaaagttccttctctactccgtttgcttatcaaatgcccacaattctcgctcctttttgtccttcttcgtcttcgtgcccaactcatcacagcttatcccgaaatggtcttcgtcccaacggcgttcacagagacgacaaaatttggcaccgcagttcaaacagtcgaacactttgttcacggttttgtccacttccatctcaacggcaaagttgcacaatttgcacctaaaaaaagaacaatttaataaaacaataaaaattcaaattagtcggagtgcacgcactccattccactccgccatagaattgtccaattttttgatagaaatttttttggccaccgtcattgcggagtaggtctccaagagaatttttttaattcttcaagacttcggccttcaagaattttttggtataacaattctaagaattttcttaatttttcaaattttttaattcttaggttttgatgaattttcgggaggggatggggtgaggataaagtgcaccctcttcactagcaactcgctctgtccgtaatcatccaagtttggtttggttacttacctctccaagttttgcaacgaggccatcccaatgttttcctcaacaatgcgttcgtccaattttctccgtacttcgcgcttcagcagaattctgatgtcagctaaaacagaaaacatgtgaaataaccaaatgttacacccacagtaaagaattgggtttttgcagcccggcatcatacacttcagtcccacgcccccatccgccagcggaatttcgtcggtcgccgcctgcgcctgcccgcggatacaaccgcgacagaacgcgtgagaaagcgac

SEQ ID NO: 28314 - DNA, 954 bp, Heterodera glycines
  misc_feature (14)..(14): n is a, c, g, or t
tatccagaaaaaanatttcggggagggcacctgaagagctttttttttgctcttcgaaggtgcaaacatttcagaaaatttggctattcttgcttgaaaaaatttttgatttttcatttcggggggcacgtgccccccccccctagatacggtcctgatgtacttatacccagggaagcaatatatgaatgtagaaaattaagggggcatcgcaaatgaaatggcccactacggggaaaaaaaggaggaagaagtgatcgcgaagcgtatatgactgccgcgtacacctatgtaagcaactgaattttaaaatttaatacgaaacaacattattaaatagattaaataagatttccttagataaaaaggcaagtaatacctaagacaacaacaaaaggttcgttcgaaactgtgccagcaattcttgatgcagaaactgagacgagaattacacaattaatcgaatgccgattacaaaaccttatatcaaaactctcgagtgagctgtttaaagaaaggacccaacaggtggaaatttatttttagtatgataattgtcaccgttattagatgcggacgcacattttggaaaaaagacgccagtcaaataatggagatgtaactttgagtgggggagatttgaaaaagtaatagttttacataaaaatgtaaataattattataatagcgttgtaaatatctatcattatatataaaattaaattctttttagtttccttgaagggatcgacattacgaaaggaaaggatgaggagaatgatatgtttcaagtaattaaatttaaactctaatatctaaaaataaataatagatattccacgacgactgcagctattgtggatttatgaaggagtctctaccattaaatttcctataaaaaacattaataatgttgcaaaaaacttaaaaattaccttaaatattattctatat

SEQ ID NO: 28315 - DNA, 785 bp, Heterodera glycines
cttctctccctcctccccctctctttcctctctcctatccctctgttctcgttatctccctttctctccatcttatttcctagtccttatcatctccctccccctcgtccctctccttctctctctgtctctctttcctctctctccccctcgtacctctccttctctctctgttctctttcctctatcctttcctctgtctgctctcttctctccctccccccccttctctttcctctctcctatccctctgttctcgttatctccctttctctctatcttatttcctagtccttatcatctctctccccctcgtccctctccttctctctctgttctctttcatctatcctttcctctgtctgctctcttctctccctcctccccctctctttcctctctcctatccctctgttctcgttatctccctttctctccatcttatttcctagtccttatcatctccctccccctcgtccctctccttctctctctgtctctctttcctctatcctctcctctgtctctccttctctccctcctccccctctctttcctctctcctatcctctgtctgctctcttctctccctcctccccctctctttcctctctcctatccctctgttctcgttatctccctttctctccatcttatttcctagtccttatcatctctctccccctcgtccctctccttctctctgttctctttcctctatcctttcctctgtctgctctcttctctccctcctccccctctctttcctctctcctatccctctg

SEQ ID NO: 28316 - DNA, 1284 bp, Heterodera glycines
gcgagggttgctgctgatgttggcgttgttgaagtgcctgctccctccgaagtgccgcaatctcttcggtctgctgcgcgtatttcgactccttcttcagctgtgtcatctccgccacttccccaattccgaacaaattaatgccgaattgcgttagctgtccttccgccaccgtttcgatttgcgttgtgccgtttccgtccgccccttcgccgtcctttctccgctccattggatcgttcgtcttgccaactttgagtccttttccgtttcccccgctctttggcggtgctctcttccggggagttccggcacatgtcaaaaggcgcgaaggggcggccgagtagggaagcacagccatcgccggagggggcagcacagcggccgagggcgacgcagcggcaccgatggcatccatttgagaagagagcgatccctaggctaccataattaatgggccacagcagcaaaatgcgaaccattgtcttttttgcggccgtcgcataagtgagaagctgcgagtccgtgtccggcattgtcccctgactcaattcgttctttcgcaaatgcatttctctgtttgggtgggaatggttgtgtgcttttctcttctctttcttttcccacttatggcatttcaacgaatttttccatttgaattgcatttggcacactgtgcatttgaacggcttcgcgtcgctgtgaattcgcttatggttccaaagagtggagcgtcgattgaaccgcgactgacagacctttagccggggaggggcgggagggggcgggggcattcaatgcaaattgaaattggccatgtttgaagattaccatcgccattggaactggtttctaatcctggtgtgcgagttctgatgctcttccaattccattttggaaccgaatcgcgagtcgcaagtcgggcacaggtacggcctttttcggtcttgcgattttgccgccgccgaagacgaagtcgaagcggcggaagttttggcagaagaggacgaataaccgagtagaacaaaaggtaggaatggacgaggcggacgaggcgagaggaagaggccgacccttcacgagaagtaagggcctcccccgcttgggactgaattggacggaccttcgccggccggggaagaggccgacccatcgccgaaggagtggaagaagtcctgctgggggaggaagagggagaagttagtcgaaggcggcgcaagtcgaatttggcacggaccagcgaaagtgttttgaaggggcgcttctgtgaaacaaaaaaaggta

SEQ ID NO: 28317 - DNA, 1302 bp, Heterodera glycines
  misc_feature (49)..(49): n is a, c, g, or t
ttaaaaaatattccaacttttttctttcatgttaagcatcctaaaaacncaaaacttaatcaattggtcattttttttacaaattctgttaacaaatcgcattaaaaattacaaaatttttcccggcggcgtctatcggcaccgccggccctccttgtcccccaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctatatctgaattttagtgttctatgtcctgaatttgaaaaaaaacttggtcaccctcaatatacatatacttctgaacaattcaaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgagcaactctaatcaaaattgttaatatgagaatcttcttgaaaataaattaaaaaattctaataatttttttattttttcaattatttgaaagttaaaaaaaattaaaaacataatattatttcttttgcattggggacattattactggcctgataatgatgaaaatgataattgactttcgtcctccattttcccaaaatttgattggccccttttgataggccactcggcactttgttgaccatcaaattcggcaccattaatttgcgggccaggccgttttcgcgtgaggcggagtttttggactataactttttttctttgctaaccaaatccaacattcttggcatcattcgaaagcccttcagtagcactattagcctgcaaaattccaaaaaatttcgttcagtataaaaaaagttcgagccaaaaaaacttgaaaaatttggtttgttgactcttctgaccataacttttttgaaccttaacgaaatttttccaaattttgtaggctaatagaaaacacttccccacgcgaaaacgacgccgacccattaatttggcaccgctcctctattatttctccaattttcacttcatatggctcctgttttagcacaaaattctcggctttagctgctccgcgtccggatgttttctcatcataattttcaatgggttcggttttcattt

SEQ ID NO: 28318 - DNA, 1373 bp, Heterodera glycines
tttcataatttttgttgaaatcttggtcgtgctctgaagggcgagggagggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttactctgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattattgatagtctaatctactcaaaacggttcagaattcaataa

SEQ ID NO: 28319 - DNA, 1362 bp, Heterodera glycines
gcgcttaatttcaaaaaattttaataaaggaaatgcaatgaatttataattaaatttaaaattaatttttttaaaaattaaactcacgaattgcaagtgccggaaccgcttcctcctccgctgcacgtcgttgtgcactgcgcgtgaccattgtcaatgcggtggatgatgtaaagcagacggcatttcggctggcgacgacttgctgctgttgttgtcgatgaagtcttggccttctgtcgggcggcgactttgactgttgttgttgaagttgtggcatttggttcgacgacgacttcggcatttgatggtggcattggcaacggcagaccctcttcattttgtggtggcagttgtggcggcgcttaaattccaaaaaaaaaaatttaataaaggagatgtaatgaatttataattaaatttaaaatttatttaattttaaaatcaaactcacgatttgcaagtggccctcttctgaatatttttttttttgaaaatctcaggatttttgggcatatttaactcatccttaaatatgactgaaaattcgaataatcattgtgaaaatggttaaataaaacggactaagaatcagccccaaatatttcagaaaaatacaaccctaagaaccaacccaaattttctaaaaatacacctataataaatgaaaaatgttcccaaaaattcgtctccaaaatttatttgtttattttctctacaaattcttgattttaagaaattatgtgtgtcaatactaattttcaattttggtgttgatcagttctactgtaaattgtattattttcgtataatgattttctgcagaaaagttatcaaccccctaggaattttttcgaaaaactcccgatttcagtgtattttggggtattaagtcgacttggtgtgtgggcctgggttccatttggaccttcacatatattttctggacaataaaagccagggaaatcaaaacccagaaaggatgaagcaaacggagaaaagtttaaaaaattctaagaaaaagagagagagagagagtgagtgaaacagagaaggggaggggagagagaaaagagagatagaaaagagagaaaaagagagagagagaaagaaaaagatagagagagagaaagaatgggaggggagagagaaaagagagaaaaagagagagagagagagtgagtgaaacagagaaggggaggggagagagaaaagagagatagaaaagagagaaaaagagagagagaaaaagatatagagaaagagagagagagagaaaaaaagatatagagaaagagagagagagagagagagaatgagtgaaacagagaaggtgaggggagagagaaaagagagatagaa

SEQ ID NO: 28320 - DNA, 976 bp, Heterodera glycines
cttttttatggtgttagctacttttgagttatagggcctatttccgtaccaggtgttttcgacaatgattggtttcgacagtactttttaattaattttctacatgatttattgtacacatgaatttatatgaatatacaatttgcatatacaaaatttataattgaagtaactaataaaaataagacttgtatgatttttttgccaaaaatttatcgctttcactttttctatacaaatatctcctgctggaatgtagtcaaaaatacaactaatttcttagataagattctcgaatcgtgtgggaaaatctgtaactaatgccgggtttgagtgccaaaattcaaatctgcaggctcttaagcaagaattcgaaaatctcgaacccctctgcaatgtataagagccatgttcttatcattttaattgtcaaaatttaacgagactatgccatatagaacaaattttttaaaaataagctttactgtcgaaatcaatcactgtcgaaaccaacagatcaccactgtcgaaaactaacagcaccctattttctaggtttttatttttagaacctaaaaactagagtccggcgggatcgggactctcgcgggattttacgggagtcccgctcccgactcccgcttttttcggtgaacgggatttttacgggattcccgttcgggactcccgtcccggaagattttgaacacccgatcccgctcccggaaatttttacccaaaaacgggagtaaaaatgtactggtaagaattgatttttttggtaaaaataatgatttttcactgaaaatctgttaaatatatagccaaaatttcaaaaaaatttcccggcggcgcctaccggcaccgccggatccttaaaatccttaattttcttaaaaaacttgctcaattgcaaaaattggtcattttttaacagaaaccaacaaatgtattgtattaaaatttcaattttttt

SEQ ID NO: 28321 - DNA, 1333 bp, Heterodera glycines
ttatatttatttcatttttaattttaaaaaaatatcaagaatatgttttttaaattaattttatcatttggattacgctgtgaaaaatcattttttgtttgaattcgttttatatttttaaatatttttcaataatttctctttttggggcccaaacgtgccgggtcccaactgaggtgtaccggaaaaagaaccggtctaccgaagtcgctcaggttgggccggcatggttgggcaacagcatgtttttccactataactttctttaatttttttctttgtcagtccaaatccaacattgttggtatctttcgaaagctcttcacatgctctttagccttacaaaaagctaaatcaagcctggaaaaatttattaagaaaaaacttgaaaaatttcgactttttttgcaattttcatgtatgggtcttgtgggggatggggtgtcccgtgtggctccctgaaaatacgacaagtaaatacgacactataaaatgcgacaccggtaaatacgacactataaaatgcgacaccggtaaatacgacactataaaatgcgacaccggtaaatacgacactataaaatgcgacaccggtaaatacgacactagaaaattgacgccggcggaaaatccgacaccgaaagaactgggttttccttgacctggattttttgcccagataacctggtcctggtcaaatatgaaattcagacccaggtatgtagaccctgaatttgttgcaacaatttttctttttataaaaatattttccagcaattaatttttgttcattttttattttatcagtttgccccactccaattccaaatttcgctctaattttgtgcccacattttttgctacgtatcggtgtcatgaacactcttatcattccacccttaaacatatcaaccattaaaatttggtgtcccccaaatttttccgcgacaaacgaaaaaatttcctcgcttttttttgttggggacatagaaaagcttgatgaatgaatgattgaaaacggccgccacgccaagggataaaaagacgatttcatagtatttttgctgaaaattttcgattccttgttgatttacccccctcaagacctatctcacccaaattttccaaaaaatttcgctaaatttttccaaaaatccacaaaatgagcaattttttgatgaaaatctgctaaaaataagactaaaattctctcacggctacgcctagctacagcaccattggaccccaaaatccttaattttctttaaaaaaattagttatcaaaaatcttaaagcggccattttgagctctaagacaaaattaatcttcaaa

SEQ ID NO: 28322 - DNA, 1002 bp, Heterodera glycines
  misc_feature (919)..(919): n is a, c, g, or t
ttgaaagaaattttttattagatcaaaatcggagataatgggcgggcggtggaggggggagatgggcagaaggaaagggtgggggcaaaaataatggaattggaaacgggggaccaacgaattgattaaaaatccaatataaataaataggaattggaattaaatttgcaaaaatataattgtatttccttacctgccacaaatgtgacaggtggaagaattggaaaaaaattttaaatttgcaaaagaaaaattgaaatttcctccacttgtcacattggtgacaggtggatgattgatgaccttccgcggcgctgcgcggcgcggggtgaaaaaacacccgcacggatttgggtaaattaaaatcgacaaggcggcagagttcaaagaatatcccataggctcaggatgtgagcgggcggcaacttcaaagtggtccaataggtttcgattctgtgcggcaacttcacagggagtacaataggtttggtttggaacacacccccctcccctactgggttttgatggggcggcaacttcaaagggctgcgcccctcccataggctttggttcttggcggcagcttcagatgtagtccaataggcacgggtttgtgagcgggcggcaccttcaaaagaaaacacccctcccgtaggtttgggtttgtgcggtaaacacccgctcggaacccgctcgcttttgacgctatatactactcttgtcttataaattacaaatattttgaaacgcgaagaatggaaatgcgtaaaagttttcaaattgggcatgaactctgtaaaaatgtgacggcattcaaaagagaattggtttgggttggtattcaaaacaaatattttaaatcactgcatacagtgccggaaaaaagtttaaaattttttaatttttgtattttacttgngacaatatagaaaatggtttgttttttccgagcgcattttgatggtgcgcatacgttgatagcaaaaagtgaaagggaattaa

SEQ ID NO: 28323 - DNA, 973 bp, Heterodera glycines
tttttataattaaaaattatataagattacaaattaatttatatttataaaacgatttaattaattttgtaagtattgaagaacaaataaaaatttaattcaattatatttatttcgagcttgaatttcgcaatttcacaatgccaaaaataataacagaattcgtagcaaaaaaggacaatttaatttaaactatttcgtaaaatgatgtcaaattagaaaatttgaagcaatattttcaaacaaatccaaaagtgagtgccgaaataattgccacggaattgagaattaaaagtgcaactctacatagatggaaaaaggaaagttcatccatttgatcagtgatttcgaaaatggaaaatgcattaaatctattcaagtgatttgatatataacacccgcactggcctttcttggaggagttaagagtttcaaatcttctacaaagaataagtgctaaagaaagcaataaatgttcttctaaccattctttttaaacaaaacatttaattgttgctgatccaaacagcttgaagctgtgagtgacgactctctgttggaaggttgacttttgttcggaaatgaacggctggaaatgtgcaagtcggagccagaaagcgtgcttttgttgccgccaacaaaactccgttggagacattggtcggtcaacgaatgagaagccgaacaaactaaaagcagaaaactaaagagccattattattcaattgtgaatgagcttaaaaataagtgcgcacatttgatttacatttgaataagatttaaattaaagttcggtaaaaaaattaaaaggaaatgtgtaagcacttggcagattttgcttatttttcaaatttttatgactttaataactattacaaaataattggttttatgtttgttttttaatttttgcattttcagcgaatgtttttttcttctaataaactataattaatcaaacacatggtaaaaa

SEQ ID NO: 28324 - DNA, 855 bp, Heterodera glycines
atgtcttttgatgaatttgtagctttagcttctcgcgcagaagcaacacaaatggctgcaaaaaggcaaagttcggaacaccgaccaaaccaggaacgaaaatatatgcacccgaacaaccgtgaagttgaaacaagttccaaaaatcagttaagaccctatcaagttgtttgttacaattgtaacgaacctggtcatgtttcacggaattgcaataagacaatgtcccgccaaaaccgaaacgaattcccatcgtcttttcctcagcagaatcaacagcaaaccccaaatactgttgccactggggcaaaccgagttttcctaaactcgaaaaacggaataccctcagcaggtcgctcgcagaattttctaaagcaaaattgcattagaatggaggaagaagtgaaaaccgatgcaactgttgccggtgttaagctggaaagagaagtggttgaatttctaagaaacgaattggataaggcaaaaacgaagtcagacaaaacaggagaaagtccagtaatcggaaaaatggtcacggttgagctcaaagtttttgaaaccccggccaccgcaatgcttgacggtggagcacaaatctctttaatgggcggaaaatttttctacgaactgataacaaacggaaaattggaacttcataaaaacggatttaatcgcgtttcagctcgaatttctgatgtgaatgggaaagaattagaatgtttcggagtcatttcactccctgtcgaccgggatggttgtaaaacaactaatgtttgttttcacattacaagtgcccccttcggattcgacttacttatcggtacaaatgccttgcgttctttgggtttctgtctt

SEQ ID NO: 28325 - DNA, 1153 bp, Heterodera glycines
  misc_feature (1124)..(1125): n is a, c, g, or t
tgttgcccttaatcgacgcaaaatatttaaatcaaatccaaaaccacacttaaaaaaggggggggggacgaggacgacagaaatttttgcaagggaatcggcggcaaaaattcaaaggggtccagtaacaaatttggcgcaaaaaaattaataatttggggaatgccaatgaatttccacctctccacgcacttccgtcccctccgcgtccctttgcttttgctggcgctgttccattggcatttcttcgtctgatgaggtcgccggtgagtcggaagaggcgtcgtccatcgccgccaccgctacttccgcgtgttgttgttgtgctgcttcttcctcctcgccctcctccgaatcgtcggacacattgccaagcattttgcccacgtggtcaccatggctttcgacatgctgaagcttgggaatttaaactaatgcacaaacaaatgaaaaactgggcgaattaacccccgttttttgaaaccccgtctttgcaaccaaagcacaaacattgggttgtccccctttgttccctgcggagtgtgaagactctgcagaagatgaggacgatgacatggaagacggtgactgggacataaccggtgaatatttaattggaaaatatcagaaaaaaaattaaaacaacagatttcccggaacgggagggatccagcgcggggattttgcgagattatcccgctggatttcgtcccgcaaaaattatgagttccattcccgcagcgggaccgcaaattcgaactttgcgggctctagggacatcgattccaactttaacgccagcatataaagtttaagaaaactcaaaacgaatcgccagaaattttgaaaaaagagggaatttgaaaattctattttcactgtgtattaattagtgcgagaaagatcaaactgactgattgcaacttgagcaatctttgcctttttctcaccaacaattgtaacatttgctcggaaatttacttttctttttagataaactttgttttatgaaaataagccggtagactttttttgtaggccgggaatacctaaaaaagttgatttccgaacctgagtccgtggaaaacaaacaagaaccctgtttccgatcccgtaccactaanncacatagatatgaattcagcagaaatgg

SEQ ID NO: 28326 - DNA, 900 bp, Heterodera glycines
ttttcgagaaccaagacggttgagaaaagtgtttgaattcggcagaaccaagacggttaaaccgaagattttgtgtgaaaaatttgagaaccaagaccgttgaaaacaaatggttattacacgctcgccacacttaactcgccagaggacccgacaacagggaataattttgaacaacgacgggaatcaaattcgtgcaccggataacgagcaacaaaatttagagatcatgattccggtttcagagcaaaatgaaatgagaaacctgaatgagccaattaaccccgtaaatgatctttcaggagacggcagcattttgagtgaaacacagctgagacaccgacctttggaagtggacccgcacgaatttggcgaatttgaaccggcagcaaacgacgaaaggatggccgaacacttagcgttggtggcgccaatggtcaatgcaggttcggggcgtctcgaaaattttggaagaaatgtgggggaaataaatgacggcgaaataaggaatttgccaccaattggctacctttttgaaagaaatggagattttgaggatagttaagaaaataaggatctttaaggtccggaggtgccgatattcgccttttccgaaaattttcgactttttatcataaaattttggaaatcgggattcaggcgtcccaaattttttgtggaatcggaatttcaatctcaaatgtcggaagtcggaattccggtgtcccaaatgtcagaaaccggaattcaggcgtcccaattttttcggaaattataattccaatctcaaatgtagaaatcggaattccggcgtcccaaattttttcgtaaatatccctcctcctcatatagatacctaatttattttcgcatggactccgaattaaaatgcaatcacaa

SEQ ID NO: 28327 - DNA, 1025 bp, Heterodera glycines
cttgttctgctcgtccatatattcagaaggtaatttgttgatcaccttttgggagagggtttttcttacaaaagccgtcttgttcaaaaagcggttttttcgaataattttccaatgtgtcggaaagattttcagaatatattccagttataaaatccctaaatcagctttctcttgaaaaatactctcgttttacacacccttttttcatttttattgggctgcgaccggacaggcgaaccggtccggttattttagaacaccttctggttctaccggcttggccgggtccgtttcggtatggatgggtcaaaaagaaggcaggatatccggcactggaccctaatttttaattttcgttttcattccatagccatcgtctcctctttttcaggtactccgggcgtcttgtggccgcggtgttgcagcgactgttacacgcgcgcgccgcgcacatttacgggctcggctggttcgcgttgcgccatggcgagctgttgctggccaacggactgcacttggaggtgcgcgagttgcgcgtccattcgctgttcaattggtggtggacaacgacggcaccgacggtggacagcgcggccaacgacggcggtggtcaacgcatggcactgaacgtgcgtgtgtccgtcggcacaattcgtgttggcaaacaggtgtgtgaattgcgttttgtggcacggttttgaagacaaaacgggcgcattccatttactgtaaaatttaccacagatcatgagttgcttttccattaaaatttcatgtttttaatccatacccaaaaatcttgttattccttttttttgttttgttttttatttagaagaaaaaagatattgaactgacataattttcataaacaaaatgttggaaaaatgtcaattttttagttgggttacgagaaatagagagttgtttatttcgtaatttttttttaattttttagttggcggacgaagaaggcagcagaaatgctacgagtagcatttgtgatggtcagaaatgacctg

SEQ ID NO: 28328 - DNA, 1434 bp, Heterodera glycines
ttcggttttttaaccgaaacccgaccgaccgaccctcttgtccggtctctagtttttagcaaagaaaatatcgaacttaaagttcgatgggtgaaaaggcaattgaaatccggaagaaatctttcgtaattattgagacggacccgggaattgaaacaatcgcacaattttattagattctttcaggcaaaaagtttgctttaaaatactccaattttatgtcttttttatgtcttggaatcaaaatcattgtttttgtaatgctattccataaatcattaaatattggctaatttttcataacttttgaaggtttaaaaaaatgtacattctctgaaaatatattgttgttttataatgatgaaataaaataatgtaattgccaccaaagcggtaaatattcttttcttcattgccgtcgacatggtgatgatcagaatgctaatatcataagttcaaaaaaatctatttctttcaaaatcagataaaaacgctttaaaataaagcttatttaatttttatagatgtttaatttggcacttcaagctagcaaattcgattatcataagatttaatcaaaggaaaccgcgtatttttttgattaatttaataaattgcacttttgttttctaatgggtttaaatgagtgttatttttcggaaaaacagaggacaagcagcacatcaaaaaaaatagatttatgttttgtgacctctttaatttatgttttggtacactttcacttctcattattctcattaattttttttccaaaacaatttgcttcacattagtgatctcctcggactttaaaaataaatattgtgtggctttgtcttcgtgtgtttggtctccaccccccaattcaaattgaaggaaaacgattttatttcctatttggcgctcctgaggaacagcaggtaaaacggggaaaggcgagatcggaattaggtagttttgtttgaagtccgaaccggacaacaaaatcaacggaattgaattgaccctgaaccagggcgaatttcaaaaatgttggatgaaaagaagttggagtgaagttgaataaaagaagttggagttgaatttgaagaaaagaagaaagtggagttgaaaagtcctgagccaggacaaagggcaacaaaacgattcgagtcgaacgttttcaaattgcaacaaattcgagccgaactttcgcattcgccgtactattcgccgtcctaatcgcacgccatcaaacgaaaaagtggaaaagtgtcgacagcgggaacttttgttttgtttttgctatacctgagccaggtgcgaaaatgataattcgctctccgccattgacacgacaaagagcgttgaatttgcgaacattcgcacaaaacgaagcgattgaagagcagcagcgacgggttgaaagagtttatggtgaaaatgaaccagtgg

SEQ ID NO: 28329 - DNA, 1054 bp, Heterodera glycines
ctttgcctgtacacctacaaggtgaacatatttgttattttgatgagaatatggaagaagaagagattcgtcaaagaatagcgaattgttctgagttaatggcatattttgaattgaataagacaaatgttttggcaaagactttgttttatcatcagatacctgaaaagttttgttttaagaaaggaaaatggacagagagaaagacatattttaacacaattggtcgaatggtgaaggtatcaccggctgagccggaacgataccacctgaggctgttgctgttgaatgtgaagggagcatgctcctatgatgatttgaaaacagttattgatattaatggtaatgcaaaactttgtgaaactttttcagccgcatgtttagaaagaggtttgattagaaatgatgaagagtggaaaagagcattagaagaagcagagagttttgaaatgccatgtaaattgagagagttctttgcattgattttagtccattgcaatccggccaaaccggaagagctttggaatatgtttaaagactcattgtctgaagatttttgcaggagttttagaaaagaattggcttatgctaaagcatataaagagattgcacttagcattatgaaggctggaaagacgctgccgattttccaaccatggaacataaatgttgatgacgaagttgaacaactgtttgacctagccgaagaattggatttgggacaaagaaattatgctttgatgtatgatgaacagaggaatgtttgtgatgccattttgcatagaatatgtaatcctgtaaatgaacccgccttctactttcttagtggaccgggtggaacaggaaagacacatgtgaacaagacaattgtacatatgctgagaggtcaaaagaagaaagtttgtacaatggcttttactggcatcggatcaactttgctgcctgctgggagaacattgcacaatagatttggactgactttggatatgagtaattcgagtattagtccgagatcaaaggcttggcaagagttgaaagacacagatttgtttat

SEQ ID NO: 28330 - DNA, 1406 bp, Heterodera glycines
  misc_feature (1306)..(1306): n is a, c, g, or t
tttggccatttcagtcacgggcccattactcggcccaaagtgctttccgaaaaaaatctttcggattcgttcgttacagaccgagaggagtcacatgatatatcatttgttaaatttgttgaggtaaaagtattcttgaattttaccttttgggtttttatacatatttctggatttttttaaaatatttatgtatatattttgaccactttttatacatatttttggcatccttattaattgcaaaataggtgagagaaatgataaaaatgttttttatgcattatatgaatcattgtttacaaatcatcaaaaattggcaattggagggccaaaatgattttggaaattcgattgtacgaagaatggacgcaaaactttttctataaagaagaaaatcaaaataaaagcaaaaaaacaggtgagtatttattatttattaataaaaattaaaataaattaattttttaatgctttttaaggaaatgttagcgaagaaaaacattttgtaaaggataatttaagactaaaattttttcataatttgggagattattggatattttatgcaagcaatttttggaaaagagaaaaaattgtacgcaaagtaacgcatcaaatggccaaggatagtaaaaacaaagttgccaaaatgaaagaaatgataaccgaattaaaggaaggaaaagatttcttcttatttgtgagctaattaataaaaattaattgaaatagaatttaaattattgtatattattaggaggtttttttaatttttagaaaaaattatttttttcaaaaaattaaaaaaaaatttgtttagaattcataatggtaaaataatgtttgttttcactaatatttttatcattgataccaaaatatggtttttcgcattggatattcttttttttaattttcaagtgccaacttggctaaatcaatcactcttttttacagtcagttgatcggactgatgatcagccgatgtttttgtgggaggatgggccctccgatgtttctctgttccgcgcactgaaaatttgcgtaagcgaagtggcggatgagtacgaccaaaaatttgtcgacataaaattggacgcacttttccaactcgaactgacgcaattttccaattcattctgtgcatggacaaacatttgaaggataaaagaaaaaaagatggtgacgaaatggtggccaaattgcacttggacaaaatggccattttattggagggagaaaatggggacgaatttggcgcatttctggtcaaaaacagtgagtgaataatccatccaatggngaaacccaaacttatttaatattttatatccgcctttcaatatgtacaggaaagaaagagcaaaaaaacccattttctttgaagggagccgaacttgggt

SEQ ID NO: 28331 - DNA, 893 bp, Heterodera glycines
  misc_feature (19)..(20): n is a, c, g, or t
  misc_feature (31)..(31): n is a, c, g, or t
aattagagattgggacaannagcgtattganccggtaaataccgtttgaaaatccaaaaaacgcagataaattaggcttgtagggaccgggattttgccgagactcgtggttcaggtccacggtttttttggacaaaataccgggaccgggagtcccggaaaacgtgaatctcgggaccaagtccctgtccattttctaagtaatggcaattttaaaatccgggctctaatagaaatttcgaccatgctaaacaactaatattggagaatttgtgtcacagaggaaaacaaatttaaaatgttttttcatttttttaatgtaaaaatgcgctgattaccaacctgacaatagctcaaaattcttatgaaaaaacatactgagttttttcttgaaaaatttctaagttagtaaattttttaaaaaattcacggggggaacgatgcgggagggggggggggacaagctgctcccgagctacggacccgaattcgaacaaaaagtcgaaaatttcggttttgtgtacacattccaaaattttaaaaaatatgtacaaatgacgcacggagtttttgatggaacaaaaggaataatttgccataaaatggcaaaaaaaccctctgttttgtcttggaaaaattctttcttttgtcctgtcaaaaaagtgtgcatcctctgacatattttttaacattttgggatgtgtacccaaaaccgaaaagtaccttaattttaaaataaaaatgccaaaagatcaatgtgcttgatgaaaaacttacaaattctgacaatcagctcaaattctttaaatcaatgcatttttacaccaataaattggaaaaaaatttatttatttttccgccggagggcaattcagcaatattattattacctt

SEQ ID NO: 28332 - DNA, 1084 bp, Heterodera glycines
tgagcaatgacggaaaattgcttaaaaaagaaaccaaccataatcatcaattgttagctcccgttggcaaaccgaagggtacattggggcaatggatgttgggctaccgtatcagttattaaaatttttgtttttcaaaaaggatactaaaactgggataaccccattcagagacaagtcaaaaaaaataataataggcttggactaccatactaattagaatttttagaatgtgtctgttaaatgcaaaactgttgtgaaaaattgttataactccattcagagaagagatagaaaaaaaataaaaataggtttagagagcccatgaacagctgaatcggatgcaagtaccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagacactagtcaaaaaaaataataataggcttggactaccatactaattagaatttttagaatgtgtctgttaaatgcaaaactgttgtgaaaaattgttataactccattcagagaagagatagaaaaaaaaaaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagataagtcaaaaaaaaataataataggcttggactaccatactaattagaatttttagaatgtgtctgttaaatgcaaaaactgtgtgaaaaatttgtatactccattcagagaagagatagaaaaaaaaaataggtttagagagcccatgaacagct

SEQ ID NO: 28333 - DNA, 1429 bp, Heterodera glycines
  misc_feature (1139)..(1139): n is a, c, g, or t
agatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattataatttaaaatctccggcaagtttcgctgggattcaaaaaattttaattgaggcgaaaaagattgacccgaaaattacgaccgatgacgtaaataaattcctagaaaaacagagaacatacacgattcacaagcccataaggaaaagattcccgagactgaagacaataccgagtggcttccacaccgattggcagtgtgatttatgcatttttgatcagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggctagggaatttaaaattttaaaaaagaaaaaatttaaaatcggtgatatcgttcgtattaccaaggaaaagggaaaattttcaaagggatacctcccaaactttaccgaagaattgtttaaaatcgttgttgccaattcgacgacacccgattcatacaggatcgaagatttggaaggaaatttaataaaaggcatattttataaccaggaatnagtgaaaacacatggatgatttttacattgtactaccttcgaacacaccggggcaggagaacactacgtcaaaattcacagtacgactccccgagactttggaattgggcacaaattggtcagtagctctctcatcaattatttacccctactcattcaccgcactcggtataaacggtcaagaagttattaaagtatgggaaaacgacagcagtgtcccgactcaagtttatttacgggacatgaaatttaaaaccgccgggggcctggggaataaaataacgaggcat

SEQ ID NO: 28334 - DNA, 2091 bp, Heterodera glycines
tctggcacatgttaatgaacacggcctcttcattggtgtcgccttcgatctaattaaataaatctctaatatttaattataccaaattagaataaacaaaacatggaaaaaaaaatgtaagttggtgcctttaaatgtgaattgtgcaggttatgtgagatcttttcaaacattaaaaccaattcatgtgtaaaagttgtgctgggatttagaaaatatatatatttttttttgggtcttttgtccactcatttggcaaaatattttttgtccaactaatggtaccatttgaaaacccacaaaaaatgctacaaaaacatcaaaacaaaattggagtttgtgtcaatcacttataactatggttataagttgtatgcactaaacaatgccaaataagcgaataaaatatgcactaaaataccccaaatatgccctaaaaactcgaaaaatgcccaaatatgcactaaaatatgccataaaaattagccaaaatggcttataaccctcaaaaaatgccaaaattgtgtgaaaatacaaaactgacttttaaaacatcaaaaaaaaatggctaaggagcgtttttagataattgcaaaaattttgattttctaaatttatatacgaaatttcgaattttttaaatttttatcatatgctaaaacaaaattacatttttcttatatcaacaatttttttccaaaagttcttacaaaaaaatcaaaatttttcgattttcaagggtatatttttaatttccaaaaaggtcgatcctcacaaaggagaggtacccaagtgacggtgggacttccgaatgaaacttacagggtaggtagatttacccctccccccccccccccccctttgtattataaaatttttttatttttgctaaatgaagcttctggccgagatatgaagcttttcctttttgatatataatatcctttacaaagaatgttaatccaatgtgagcgtcggtggcccagtggttatcccttccattattttttccttcttctaaagttcaattgccccaccgaccgacttttatgaaaaatcagttggccattttttaacaaaattcattaaaaattcttaaaattttcccactgcggcgcctatcggcaccgccggcccccaccaaaacctatcttttcttaaaaaaattagcccaaaatctcaaaatttttttgtcaatcaaaaacccaataaggcgcaaattatgctaaacatatgaccataattgtatgttgaacgtaatgtccaaaagggcattattttttaaaattaaataaacataaaattatggagagggacaaagaatgaactactaatttgcaagtcaaatcaaaatgaactaacaataaatggaagactcccggaatctccggtttttaatcccattataatttgtttttaagaattaccaaaaccaaaggttttcgggtcgtaattgaacagaaaattttctcgtgcattctttttgagtgcgaacatttcacaaaccacacaatttgaagttcagtttttgatctgcggccattattggtaatcgtaaaataatttgtttaatttaatacggcgatatttatgcgtaattcttctgggaaattcgtcaaaaacccaaaaatcttccaacggcactttctggcactgccgtatgcctaatcataaaatatttctaaaaatggcaatttttgacgattatcaaaaagagtttaattttaagagtccttttttcgtttaaattcaactttatgtaatttgatttccaaaaagaaaaacaattaaaaattgctgtttttaattggctaatttgctgggccgcagaccaccgacctttcccatcggtgccatttcagacaccgccccaatgtgtgccgctctttccaagcgtaccacgcgtagtttgccctggtcgtccaaatgtttgagcatcggcagagtgtttgccttgaactgggccatgcgaatttggaccacgccctcgtcatcatcttaagagtcaagaaaaataaataaacatgcttattacaacataataaaattcaaaaatttcaaaatttattggactagaaatccttcaaattg

SEQ ID NO: 28335 - DNA, 1301 bp, Heterodera glycines
cataatagcatgcttttacctgacaaatgctttaaaatgagaaaattttcaaaaaaaaagaaatcctaaggaaaagaacacatatttttttcttttacaaaatattattttaaataaatctgctggtgtttgttttttaattattttttgcttttgctttggcgccaaaacgaaactttcccgggactggtatgtgattggcaaaaattcactgaatagagtgaacatttaaaaagaaattttggtacacttaaagaatttttaggaaaatagaaaaaggaatttaaattagagaagtttttgtttaaaaaaaaggaaaattgggactttctcacgtaattcatttaattaggaaaatggaaattttaagtcatccgttggcggagggagcggcggcacgtgccatgcgggcccaatgatgacgcgataagttacgtcagttcagcgaatgtgcccacgtccgccttccaattggaattaaaaatattctccgcgataagcgctttaaagcgcagaacacccgaggaggatgacgcgacagagcgggactgggtggaggatgaggagtcgcacggcggggcgacgcgtgaggagtcgcacgacggggcgacgcgtgaggagtcgcacgacggggcgacgcgtgaggagtcgcacgacggggcgacgcgtgaggagtcgcacgacggggcgacgcgtgaggagtcgcacgacggggcgacgcgtgaggagtcgcacggggcgacgcgtgaggagtcgcacgacggggcgacgcgtgaggagtcgcacgacggggcgacgcgtgaggagtcgcacgacggggcgacgcgtgaggagtcgcacagcgggccgatggttgaggaatcgcgtggggccgatggttgaggaatcgcgtggggccgatggttgaggaatcgcgtggggcgggtgcggaaaaaaatgaatttagatcggatggaatcatttttagtgtaacagctggggaggataaggcggagcgaggcgtacgcggacccggaaatggcggagggaggggagggatagacgacgagttttacaaaatgatcattcgctcgatgatcactgatctgatgcaattctacttcaattattcgtatttaattgcttttatcacttcaaatgatgaatgaacaaaattgagtccatgtaaaaaaaaaaaattattttgcttaagtcttaaaaatagtacataaattggaaagtttaattaattgtaaggcatccaatttttatgttttttagaagaaactaatgaaataatcgataaatcccgtgccatcgaa

SEQ ID NO: 28336 - DNA, 934 bp, Heterodera glycines
  misc_feature (907)..(907): n is a, c, g, or t
aattaaataataataatttaatttttttctcaaaaatttctccttctcaaccgatttccttatctacctcatttttcacccagacccctttcttaccagtgcttattttgactcgaaacctgaccaaaatcatcgggtcgggtttcgtgtcgagaaaaatgtcgggtttcgggtaacccgcggcaactctgatatggtcaatacagaaataatacataaaattaaaaaaaagggatgaactaccactcaggacttattttctgaataaaactctttcacgagttttttaaatttagctaacaaataaacttccgatttctatagctgttttgggtaagcaattccattattactgcatcttttgttttgaagcctaatttttttttcgttgctatcttgataaaaattcggaaaattagaaatattttgatggcaaaaataaaatataaaacaaaaaattttgttcacttaatccaaagatcaacattgacaaaatgcaaactgattgtgagaattaatgtcaacaataagacaatattaaaatatttaattaattttttcatttttttcagccaatgaaaagttttttattttggattgcgccgaagagaacaatgaatatgacggcaagcaaaaaattattgaacatatccatcagatccagtctgacgtacattggacatgcgatatcaaattcggcgatcgcgaccaacctgtgccattcccattgcctgaaggtgcgattttgccaaaaaaataaataaaaaacgcaacctggcaattaataaacagaagaagagcaagattttttgctcaagtacagtttatgcatccaatggacttttgcgcgtccaatcaaatttttacttcgaattgtatagcattttgacattattatcctacaganatttgctagtctatttttttttcaaaa

SEQ ID NO: 28337 - DNA, 1446 bp, Heterodera glycines
ccgtggtgagttgaatgacaaaaagtgcaaatttggcgaaggacaaaaagtgcaaaatttgctagattttttactaaattaattcaacttttctcatacacaaccaaacaatcttggtatcatacgttattagcttgctaaatttccaaaattttattaagtttttcaaagttatgacaatttttccagtttcttgtttgaacttttggaaaacttaataaatttttttgaaatttagcaagctttgcactttttgtccttcgacatatagcacccgccaattcaattaatattttgttaattttaaatcctctttaaaaatatgcgggtaagttaactatttatagcttttttgggcaaattttattggcaaaacttgaaattttaatggaaaccagtgaatttaactacggtaattcaatgatagaacctacccgaagtacagttaaacaaatagcacgcattttcccccgaaggacaggtgtcagcaaatttttcatttttgtccgtggaaacaatttctcgcttgcactgatgtggcggcaatgtcgtggtagtggttgtcgtggtggttgtggtggtagtggttgtggtcttggtcgtagtagtggtcgtggtgctcgtagtaacttaattaattaattaatttaataataataattattattattataatatattttgccaaaatactatacctggaattggcaagttgagattaacctttgtctcatcatatatacagccgcatttaaagccttgaaactttttcatttcaaagaatttcggctccgaacctttgaaaattaatgaattaatttgttaaggattattttttattttttaccaaaaagtttatttaaaaaatataaaactaatttcggatttttaagataacgccgaaaatgcggattttttcaaaaaattgaatttaacgcaaaacaatgaagtttcaaaattcaagtaattctaacgaccattaatcaataaacaaaattcctgaaatattgtaaatttttggtgttaatacggtactgaccattttttaaattaaaatactttaaactgcaccaaaatcccccgtcaattatacaaattttcaaaaattaattttgatatgaatacgttactataaattttttttcaaattatacttaaaaattgcaccaaaacccaccgtcgattatacaaaaattttcaaaaatccacacctttgctgcattttttctcaatttcctttaaatcgagattcaaatcttcagcgcatccccattctgtatgcgtatcatagcctgttgaaaacatttaaatgaaaaaaagaataataattaaaaccaaataacttatgttgatttgttatttgataccattcgagcagttcagcgtaaaacacttatgcttgacaaaaagctggatgctgatatacagaacattcagttctcccaa

SEQ ID NO: 28338 - DNA, 1094 bp, Heterodera glycines
cgacgtaccgtaaataattccgactggtggactaccaaataaaatgaccgctaaggagaaatattcgaaaatattttttgaactctcaaatttattgaatcttcagttttctattgggatattttaggcgacgtaccgtgaataattccgactgtggactaccaaataaaatgaccgctaaggagaaatattcgaaaatattttttgaactctcaaatttattgaatcttcagttttctattgggatattttaggcgacgtaccgtgaataattccgactgtggactaccaaataaaatgaccgctaaggagaaatattcgaaaatatttattgaactcttaaatttattgaatcttcagtgttctattggaatattttaggcgacgtaccgtaaataattccgactgtggactaccaaataaaataaccgctaaggagaaatattcgaaaatattttttgaactctcaaatttattgaatcttcagttttctattgggatattttaggcgacgtaccgtgaataattacgactgtggactaccaaataaaatgaccgctaaggagaaatattcgaaaatattttttgaactcttaaatttattgaatcttcagttttctattggaatattttaggcgacgtaccgtgaataattccgactgtggactaccaaataaaatgaccgctaaggagaaatattcgaaaatatttattgaactcttaaatttattgaatcttcagtgttctattggaatattttaggcgacgtaccgtaaataattccgactgtggactaccaaataaaatgaccgctaaggagaaatattcgaaaatattttttgaactctcaaatttattgaatcttcagttttctattgggatattttaggcgacgtaccgtgaataattccgactgtggactacccaaataaatgaccgctaaagaggaataatcgaaaatatttttttgaactctcaaatttattgaatcttcagttttctattgggatattttaggggacgaaccgggaaaaatccccacgggggactaccaaaaaaaaggccgctaaggcggaaatattcaaaaaaatttt

SEQ ID NO: 28339 - DNA, 905 bp, Heterodera glycines
  misc_feature (27)..(27): n is a, c, g, or t
ggagagaaataacttcctagtgtaaanatgaaaaatatggcaaaaataaatgggggaatttgcgagggaaaatggcggagggatcgaaattgtcagtcgggagtggatctcccggtgaagtgtggggtccctccagctcatctgcgccatttctttcgttttgcgtccttcggtgcgcgccgcggctccgcttccggatgatccaggacgccgcctccccattgattctcctcctcctcgtccaattcgacaggcgtgccgtcctggttgaacactaggaatccgagctaccccaaactgcgcccgggaattctcccgcttccctcctccgtgttctcgtcgccaagcgaaaaattggagacacgcttttcgtttttggcgcaaaatgcgaaagtttcacacctaagaatgaatatttttggaactttaaattttttgggaaaaaatggtaaactttttgaaaattttgcagcttttcctatcatatttatcacaatttccaaaaaaaatttcttgtttttgcatcacaaccttaaaatctatgattttgatattggtaaaatttttgtaaaaaatttcgcttttcgcttttcgcattttcgcattttcgcttttcgcatttcgttttttttttcatttcgcatttttcagtttcgcaatttcgcttttcgcattttcgctttttatttttcaatttggcccatccctggtgtatatttccaattttaatggtatttttcggagaaaaacgccaaaaaaaagcactaaaacggcaaaatgccaaaaaaggcataataagtcaacgtagaagccgcaaaccaagtagaaatgttttattgatgcttaatatatcgaaactaatgcgcagaaaaaaggcatatgtctcaaaagtcggtctagtaata

SEQ ID NO: 28340 - DNA, 1000 bp, Heterodera glycines
ctgacctttgacttcttacttggataactgtggtaattctagagctaatacatgcaccaaagctccaatctccccagagcggagcgcattgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggtggatttattcgccctggtggggagcatcccggaaacgaaatcatccggttccgggggaag

SEQ ID NO: 28341 - DNA, 777 bp, Heterodera glycines
tatttttcgtttttagtgtatttttgctaatgaattttctgaaaaccttaaataggtaacaaaaatgccgaaataggtacctaggtaataagtagaaaaaatcccaaataggtaagataggtattataaaaatcgtcgtagaagccccaaaccaagtggaaaatgcttttttcgtgcttatctgtgcgtattaagtgcgcaaaatttttaggtatttacctaaatttcccatccctaataatcagtgtgaaaatatatgaaaatcttgctttttcatcatgcgtttaaaatatgaaaatgtttcacttttttgtgtttataggacacttttttactgaataaaattgtgtgacggagacggtttgtttttgacagttgtatttgttctagcgtaggctcacgaccgggttccagacctggatacccggttttttcaatacccggaccgggttgaaaatctggacccggcttttctggagatgtttaaatgtactataaggtgtttttcacgtttgagtcaagactttctgcccctttttgagtaaagtctgatcagacgacttattcacgagaatgatgtggaatgaaattattttgcgatgtatgaaaggcccatgtattgtaaaaataatcagctaatttttcagtcgaaatttaaaaatttaatcatcttggttcaggactttttccacaatgtatctgtgtcacttcatttttaggctccaatttttaatatacttgtggattttttttaatttagcggtactgtcgaaatca

SEQ ID NO: 28342 - DNA, 1927 bp, Heterodera glycines
cattaggaaaaagagttcaatgcgtgcaatcagcatatcttttaggtaatttactttttaaccatatcgtttaagttttctctagcggcgattcattcgcataagataataattattattacttttattttttagattaattgaacatttttaaaaaatccaattaaaatttttgaatttatacgcattatactactaattatttattgtagaccgattataatttctttaattttaattaattactttgtataaaaatatattttcatttattttttgtatattttttttcttatttccacgttttcttaagaatttcatttatttaagcaattgaactattttagtttttagggtaggttaggcccggctatttatacaataaccgggtccgcgtatatgagatttttaggctctaaaaaattccaaaataggtaggtacacaagtaataaaattataaaattatttaaaatattcactagatctttatttttaaatcaataattttaaaattatctttcgatatttattttttattggacttaaaataattcgtgcatttcaggccacagggagctcatgaaaaaataggcatttgcttaaaaatcacatccctatttattataaattagccaccatttttttgtcaataactaaaatttatatttattttttaaatcattcgttaaaattgggaattttgaccaatttttagcagattttcattaaaaaattattaattttgtcatttttttgaaaaattggttcttttctggtttttataaaaaatttagcagaattttttggaaaagtttggtgagattttcgttttgatgctctattagaaacccaaattattaaatatttgtaaaacattatgacaatttatcaaaatttaaaagattctgaggattttcccaaaaagcctcaaaaatcctcaaaatttctaaaaaagccacaaaaatcctcaaatcctcattttccaaaaaatcctcattgacctatcaaaaagccacaaaatgaggataaatcctcagatctgggaaccctggttataatagttttttgataaaaagcctattaaactattaaaataaaagatttttggacaaaaactcgttaaatataataattttacaaacaaaaataacgaaaaatatataaataaataatgaaaataataacgctttatctatttgataatgtataaatttatgtttgcattaaggcattgaaactccaataaaatattttaaattctctttaattattaaacgataaaaaatttagaaaaaggccaatatttaattaaaaatcaaaggtttaacaaaaatttacaatgctaaacaaaatcaaattttctgaaaaatgaataaagcgaagttcgaatccgcgcggtgtatattattttctatgtatttttgggttatttttaatgttttaattcatttaaaagaatgtttttttcttaataaaaataaaattttttaatttaaattaaattgtttttttgtgaaaaatgttttaaattaaaataataatttatttacttttattaaagaactcctgtatttttaaattagaatttgtaaaattaatttcaatttaaataaatattcaatccttgtacatttcaaactttctttttaattaataaaaggaataatttattttattttttaaaatttattaattacattcaatatttaatcttactttttaataaacgatttccttaattatttaatcatctaataactgttgtacctcttctaatcactgttgtacctcttctaatcacttttgtacctcttttaatcactgttgtacctcttctgatcactggtgaacctcttctaatcgcttttgtacctcttctaatcactgttacaccctcttctaatcacttttgtacctcttttaatc

SEQ ID NO: 28343 - DNA, 1175 bp, Heterodera glycines
ctttttgggcagcaaaggtacaccccccggggggagggatgtgaattgtgtgggaaaagtcacaaaatcactcactgtcctccgccccgatcgccgccccccccccgccgcttcccgagggacacacaacaaatcgcaatcgcctcactgccctgcctataaaagggagtccattcgttcggttgacaatgagcgcccgccatttcgataccctcatatcctccgctcactttcttaacacacacactcatagcgacacagattatctaggaggatggatatccattatccacatccatccaactcgcgaatgctcccgaattgagtgacccgtgccccgcgtacaataaacgatttttgatcatcacataacacgggcagcagcattgcgtacagtatgtccgtcctttgcgcaactgctgttgcttccgatgctggggtgggtccgagttacatacagtatgacccgcccctggatgttggggatacagttgttacagtacgcccatgatccttctcgacccgccccccccattctcgaggagattccccgagaaaaaatatggcacaatttttgttttcctacccatgcaaaaacaaaaatttcaaaaaaaaatttttcttcccatgccgagcgaagaaaaactattttaatttattgggagattcgcaacatcagcaacagggagggagaagttttgttcttcgtccatttgccccggtcttcccaaccgcacatttcccaccaattttcattgtgtctacgaagcggcggggtgtttggtaatggaattattcgccgtgcatttttttcaaatttgcaatcggcaaaatttggcgttgcatttattgggcacgggggagggggggggggacaatgggagaaaaagtggggggggggggcaaattagagcaaacaaaacaacacatcgccccagggttgaatttttccaggggccattttggcttggcagcacagaggtcgataaatcgatgggatgggtgtacccgccattaattggacggcgggggagagaatttttataaaatttatttaaaatccagaaattgttggaaatttaaacatttttccagttggaatttttgctttaaaactatagactactcattttcaagttatttagcaattgatcaaataaatgcatacttacttt

SEQ ID NO: 28344 - DNA, 906 bp, Heterodera glycines
  misc_feature (881)..(881): n is a, c, g, or t
attatctatttttttaatttcatttgtttactaaaaacctccctgctaaattctaaatagaatgcataagatcgtaatcattttttttattaatatttatctttttggcaatatcttctgtattttatcatttatttgtaattttattgaaaaatttataaccagttaatttgcttttacgatttttttttattttctaaatagtcgtttataattgtttcattttgtcaatttccattttctagttaaataatgctaaattatttattagaataattagaataaatattcttagtctacaaatttaccttattttctctaattttaagcttgtttccattaatctccccgtctccagttatctcctcctttctgaggtgattgaaaaataatatacgcgggcatataattagagaaaatacggcattttaggataaaattttcttaccaaaccagggccatatttttcaaaatttttaacggtgcgcctttctgcgacaccgagaccccttatttaaggaacttagcccggccctaatcaatctcttgaaataacaaaaaaatgggactttttgtttcaataaattttgatcattccccgatcggggtctgcgttactgacaattttgcactcctcgacccgttttttataaaatgacaaataagtatatttaatgctaaattatttgaaaacctttaccaattacatttttgtaatttatttaagaatctttgattatggatatatttaaataataatttaaaaatattaataatgaattgtttttatgaactagttagttaattagaaatatttagttttcttttttctctattcatttatgatcattaattatttcatataaaaatttttgtttatntattttttattttgctttataaaat

SEQ ID NO: 28345 - DNA, 1330 bp, Heterodera glycines
atacccttaaaaatcattaagaagcaaaaatcaaacccccccacttgtaaggccagccttaactgccaaaagaaaaaagactaaaaaagctgacgaaacagttgatgaacgaattgagaaactaaaaagaagactacgctgtgtgacttgcatggacaaaactgtaaaaaaatggttaaacttcaaagaattataacaggggctggaccaaggggcgagatttcgacgaaagttttgagatttcatagtgttattggtttttagtttagagttacgggtcattcgatgagcgtgaattcggaatcccggaacaatcccggaacggagtctaaaaccggtcacactcacaatatgtacaaataatttttcaattttttatagcgaaatgtcttatttactccatgcaagcatgcttgtgtctgtgacagttgtgccgagaaaataatgaattctcgcgctgatgctgttacgaaattgtgcccatattgtcgcactgaaatcgaagcgaccaccaaattttatctgccataacaacaacagattttagggatcgatcagcaatggaagttagatttaaatcaagatagaaaaacagtacctcaaaatgatagatcataattgttttatttgaatgaattccgttaattgctgaaaaaatctttttatctcgaattattcaaaatgactaaaatttaaagcgtagatgattagcaacaaagcgctggacggaataattttggagacaatatttaaacccagtgcatatcagcatcatctccggtgcaattctcacttttccaattttttaaaaattctttaccgggatccaatttacgaaaaaacatggctccaatttttttttgttttttgatattgctatacctcctttgacacccctcattttcttgcgcttaagcctcctggttttatttgttcaaactgtcagaagattgaaataatttattctgacgactgttcagcagaataaaaatgtgtcgtagaataaatgaaaaatatataggtgagaaaattacgacttatcgcaagcaattttaagtttgatttaatgaatttattttgacgttttttatcgggatgatttcataattttgttgcgctcacagctatgtgattttacccgctggaatactcaaatacaagagaatatgtactatttagtgcccgttcgggattctcattcatatatgaaggagcataagatccgacgcataattaaagcactggctatacggaagttattcccgaaggattcgggctccccataaatctgggcgcatcggttcggggggactgcccctaaaacaaaaaa

SEQ ID NO: 28346 - DNA, 1488 bp, Heterodera glycines
ttatttgaaattatttttgaatttgtttaaattctccgccgtggaagagcttcgccaaattctttaccaaatgcggcaggatggcaccgcgtcatcggccagcggtcggcgcatgggcgcgcagaagccccagtcgccgccgtcgccaccgcatccgaccgcttttgtgccgtcaaccgcctccacgacggtccatcaccagcagcccatgcaggcgcagcaattcagacaaaatttaatggtaaaaaccctaaatatgaataattaatttaataattatttcttcagcagaccgacaacagtgccaatgaaacggcggttgtccccgcgcagcaattcaactcaaccggtgggccccatcagccgaacagcaattgtgagtaaattttgaatgaaatgtcaatttttaatttgtaatcttttcaagacaacactcacatgttgcaattgtttctgactcatggcggggccggcactgctcacagcggcgccggcggcgcccagcaacagcagcacccgcccgtaccgatcagtgccggcggttccgcgcccggcgtggcgccatcatccgccgcgttgagcgcggtcgcctccacgctgggccgaatgttcgaccaattgggtgccgcgactgcgggcagcggaacaaacaacaacaacggcaccagcaacaatgttttgcagcaacagcagcagcaatggggaggcgagaagcaacagcaggtggacagaaaagaagaagaagcagtactaattaataatagcacctaattatgtgctacataggtcaaaatgattgaggaatgcttatctttattttaaaattaagcataacaattttaaatcacttgtttaagtaactgaaccctaattaattaacagcaataattatgaatggcatgagtaaaaaaaagatttaggaatgattcattataccataattccaacgctctttagcaactgatcctctccaccattcaaatgctgcaacaggcagcgcaaatacaacagaacgggcagcagcaacagcagcagacgcacggcggaagttcgagcagtacacgaaacaattcaatccaaagtggaggtaatgaatgggcggaggaagaaagagccgattgaaaaggccatggcagccacatctttattatgtatttgctgttgaactttgtttagagtccgctttcttcgacccgtccagtggcattgacgtgagcgaaacttcgtcctccgcttcctcaacaaacactcaggtgaacataaatgcaattacaatgttgcattgaaaaccatttttgatgttgtaaattaaattgctttcatatttgagatgatgcttcaaagtccgtcccaactgatggactccgccaagccgccgtcccttccgccgattggcaccaatttgctggcacctcacattcaccaacaacagcatcatcagccgcaacaaatcacacaacaaatcatgcaacacaatgcaccggcaca

SEQ ID NO: 28347 - DNA, 644 bp, Heterodera glycines
atgaggatgagagagaaggaaagagagagaaagggatgctgttttaagagagagaggaagatgatgaggatgagagagaagaagagagagagaaggaagaggggaagaaagggagggtgtaaggaagatgatgagaatgagagagaaggaaagagagaaagggacggtgagaaagagagagaggaagattatgaggatgagagtacaaaagaggagagagaaggaagaggggaagaaagggagggtgtaaggaagatgatgaggatgagagagaaggaaagagagagaaagggatggtgagaaagagagagaggaaaatgatgaggatgagagagaagaagagagagagaaggaagaggggaagaaagggagggtgtaaggaagatgatgaggatgagagagaaggaaagagagaaagggatggtgagaaaaagagagaggaagatgatgaggatgagagagaagaagagagagagagaaagggatggtgagaaagagagcaaggaagatgatgagaatgagagagaaggaaagagagaaagggacggtgagaaagagagagaggaagatgatgagaatgagagagaaggaaagagagaaagggacggtgagaaagagagagaggaagatgatgaggatgagag

SEQ ID NO: 28348 - DNA, 1142 bp, Heterodera glycines
tttttcaaaagcatgacacacaatagtgtctcacactaaagtcacagaacaaaccactaatgtttttcaaaaagcatgacacacattagtgtctcacactaaagtcacagaacaaaccactaatgttttatcaaaagcatgacacacaatagtgtctcacactaaagtcacagaacaaaccactaatgtttttcaaaagcatgacacacaatagtgtctcacactaaagtcacagaacaaaccactaatgttttatcaaaagcatgacacacaatagtgtctcacactaaagtcacagaacaaaccactaatgtttttcaaaagcatgacacacaatagtgtctcacactaaagtcacagaacaaaccactaatgttttttcaaaagcatgacacacaatagtgtctcacactaaagtcacagaacaaaccactaatgttttttcaaaagcatgacacacaatagtgtctcacactaaagtcacagaacaaaccactaatgtttttcaaaagcatgacacacattagtgtctcacactaaagtcacagaacaaaccactaatgttttttcaaaagcatgacacacattagtgtctcacactaaagtcacagaacaaaccactaatgttttttcaaaagcatgacacacaatagtgtctcacactaaagtcacagaacaaaccactaatgtttttcaaaagcatgacacacattagtgtctcacactaaagtcacagaacaaaccactaatgttttatcaaaagcatgacacacaatagtgtctcacactaaagtcacagaacaaaccactaatgttttatcaaaagcatgacacacaatagtgtctcacactaaagtcacagaacaaaccactaatgttttttcaaaagcatgacacacaatagtgtctcacactaaagtcacagaacaaaccactaatgttttatcaaaagcatgacacacaatagtgtctcacactaaagtcacagaacaaaccactaatgttttatcaaaagcatgacacacaatagtgtctcacactaaagtcacagaacaaaccactaatgtttttcaaaagcatgacacacaatagtgtctcacactaaagtcacagaacaaaacactaatgtttttcaaagcatg

SEQ ID NO: 28349 - DNA, 1282 bp, Heterodera glycines
  misc_feature (82)..(82): n is a, c, g, or t
  misc_feature (87)..(87): n is a, c, g, or t
  misc_feature (1251)..(1251): n is a, c, g, or t
ctttgccattgctttctttccgcttttcagtgtcaaagtgtccatctcgtccatgcgcagttgcgtctccttcaatttgtcnccgtntaagctgactgttcaatttgccactgctgctgaccttcacttgctgctccaacgcattgcgctgtctctccacgccttgcgcgtgttcctgctcgtgccgcaactcttccgccagccgtgccgcgtctgtcgccgctctccgtgccgtctcttccatcccgcgcagttctgccgtcgtttccgccaactccattttggtctggcccaattcgttctctagtcggcgtctgagagtgttcattgccgcattggcattttccagccctcccatcgtctcgcgcatttcctgcgcctccgactctgcgtgacggcgcgctctttctgcctcaatttggctctttcggcttcatccctggctttgcctgccctgccaagtgcctcacctgctccgcctccatcaatgcttcttccttctcttgctgtcccacttggactcttttctccgtcacttgccattgttcctgaacctgctcccgaagctgttgttcctcgtccacttggtgctgcaattcgcgaatctgctcctggcatcgcttcaaatgcttctgcgcttcaacattggccttgttcgcttggtccaacgcgagttccaattcctgtgattccgttaagtcccgaactttggccaacccaccccaatgtcactctcgagcttcttcctggttttggccaactcagtcttggcccgactctcagattctaaagtgacttgcagcgattccaacgctcgctggtgcattttgcgagtgttctcaaactcctcctctttctccgctattcgtttttctatttccgaacgaatttgcgaaatttcaaccttaaaatcaatgtatgccaaaatgtgtttgccccgcggccacatttgcctaccgacctgtgcccttagcactttggactcttccgcctctaaagccgattcggcatcttccagtgccaattgcaactcctccttctcctgctccaactttcgcttcgccttgcccaattcgtgggtccctcttcccccgtcgttaagctgctccgtcacttcctttagctcttgcatcaacgttttgttctctcgccttagtgcctctgcttgttcattggcttcgtccattactgcaacgaagtcgaaacagctaaatttgaatttggtcactttctagggaagggcttctcgantgggtccgaatgttccagttaatttggcttt

SEQ ID NO: 28350 - DNA, 1362 bp, Heterodera glycines
  misc_feature (113)..(113): n is a, c, g, or t
gggggagtacccttccaaatttcaaaaaaacgaacgaactaatggccgtgggtttggcatggcatcatttgttgttttgccgatttggttcattttcccctccctccccctcnctcccactcttttgacacacagattttattttttcctaatatttgtttctaatttcatgttatgcaaatagggagggagagaaggagtcaaagtccaaataggtaattgaaacgaatttgagttgtttttgtgtgtgtgacaataattgctttaattatttcaaaattgtttattaattgctatgttaaatttaaatttaaaaaattctaattaaaaattaataaatatttggagctaaaaaagagaagaaagaaaaaagggaaagagaaggaaaaggaagaaatgcgcaaaaagtgatgtgagggaaatcattcattaacaaagggggggggggggatacggtatcaaaggaaaaacccctcggaaattattttatttttgaaaatcacaaggcttagggcccttttccgtcctttgtctgacctttttccgacggagtccatctctaaagcttctttcggccgcttcatattgtgataaaacagaagcatttaacagaaaaacaatgaatcaaaaattgcatgaaatgtttttgtgaggggaaaaggaaaaagcgaaaaggaaaagggataaaagaaaaaaggaaaagggataaagggcgattggaattccaaaataacccgggagggggaatcctaaggagaagggagtcacagtgaacccttgacattttaaatccgaaaatcaccggcccaaccgggccaattttattaaataggccttaggtccccattttcaaaattaagtgggggggggtcgtggggggatctcgccatttggtgccatcattagagccgaaaagtgtcccgtcctcaattttttttcgaaagttagggtaatattcagccaggtcctttttcgaattcgacccgcggctccgttttcggtctgtaattcgccaactttgccttccctctctgccggggttcgttcgtcttcagggaaatgtaatttttagggcacgggagggggcatgagttcgttgatttgctgttgtgcagggtgagcagtgaatgacgaccgattgaatgaatatgccccccccccaagcgatggagtgggggacccctccagcgaagcgacaaaaattgctcccctcgggaaaaaagtgtgctgctggtgttggtccgagtggaaaaaacccctccagccacaaaaaatagggcagcggacagcgagcgccgacggggccataaaaccgaacactgttttacccctggtctgtccgtctgctctctggcccctgcc

SEQ ID NO: 28351 - DNA, 1402 bp, Heterodera glycines
gacaaaggcggccaaacaatcgctttgctgggactatatgtacgaatggaccaacggtgtgctgttgcgagcggaggaattggtcagtcggcaccaatcgccgcgccgccgatcctcggcatttttttgacagataaaagtgacggtcactcgctgttcgaccagcccaaatttggtggaaatagcgggccgaattgacacggatgaggcggaggaggaaatggaaatggagcgaattgggcgaggcgagcgcagcagcagcacagacgccgaagcagcagcagcgaaccgaccgctgctgcgagtgtggccctatttggcacgagtgttcagtgccattctgacggacgtggagcggcgccgcacactccctttttcggtgccgccaatcaacgcctttttgacccttttgtgccaataatgcttcagctgaacttggtctttattggtgacattttcttcgtttgccccgagggcgccccgaagatttccgcccgttcgctggacgcactccaaacgctgagctcagtccaacgggtcggctcagttcgttttcgcgtcgaccaacagcacattcattcgcttgacctttcccaatgctttccgggtgacttggccaatttcggcaattgttgttcactttggcgaactaattcattttcagatttctgtcccaccaaatttgccgacttttccgccgatcacttcgctttgcctccaccaccgttgtccggcgccccttcgagcagttcttcgtctccgtccgctgacggcgctactaccggcacttcgcttctcggcagtgccctcccatccgaacgccatacgccgacgattttccaccgaaccgaacgctctccgtcctgcacaccggaaattgcactgagtggcggaatgggcggaaaaatgccattgtcaccgtccaattcgttgctcgttgagcgccaattgttcaagcaagcgaaacactaattaaaagcttaattcggttgggttttcaaaaaacagacaccgaagccgtcgcgtttccttcggagtgatccacgcaattccatcgtttgacggtggagaagccgcggcacagatcagtccgggaaaagcatccccgtcactgatcagaccaatgaaccgatgcccaacttcattttcgacaaaaatgaacagcaaaagcaaaaatggcgaacaaagcgaaaaagaggacgatgaagaggaagaagaacagaaacagtcggaattggtcaaaagtgtggtggatgaaatgctgcaaaaggcaatcaaagaagtgttggtcacagactgaccaaacggacgaaagaaacgatgggaataaccatgagcaaatggcgaattcgtttatttgaaatgccaattcgttcaaagattaaatacaactaaaagtaaa

SEQ ID NO: 28352 - DNA, 1014 bp, Heterodera glycines
  misc_feature (938)..(939): n is a, c, g, or t
  misc_feature (974)..(975): n is a, c, g, or t
  misc_feature (988)..(989): n is a, c, g, or t
cagacgaattggcacaaaatcagatggcacgggcggcggtcgtacgacacgctgtgcagcttctacaaactggcggagagcaaaatcaaccaggccgatgttgaggaggtgagtcggccggggaccgaattacccaaaagaattgtgcacaaaacaggaaaatactgaagatttaaaatcaaattttcaaaaaataggttggcttacaattaaataaatttgtccattcacacatttaataatagtaaaatgttttttcccgtcctctggttttaataaaaatggagtcaattacgggttcaacttctttccgtgtcattaattttctgtttttattttttccacaggtcacacaatttggggacgacggggtgactgaacagggaatggtccgatgttcagtgtccgcgcaacgattgaccatgtgatcatttgtttgttgtttattattatttaaatccgaattattgttttaattgtttggtggattttgaaaagtttaatgatttaataggcccaataattaaatttaattaccgaaattgcatcaattagtagggtgtcaaaaaagaaatgcgagaaaatccgcacggattcaaaaagtaatcaaaaatgaaaaaacttggcgtgggtttgaactttgacaagccaacacacccacttttatcccactgggccatttgtcaccatgaccatttttattttaatttcctgatttacatatatttttcccaacagttcaacgcggcgtccgagcatgtgatgaccagcagcagttgttggccgagtggtggacggcgcgcattgtggaaaatggttaggcaaataaaacaattttacagaacgagctaaaaaaaattttcaatagtattttttgtcattttacagtgcatctttcgtcgtcctgctgctgctactgctttcacttctgctgctgnntctccattggctggtgcccctcgtgctgctgctgnnggacatcgccacnnacatttgtgtgtgcttttggagaaa

SEQ ID NO: 28353 - DNA, 1276 bp, Heterodera glycines
cccattccattcgtccgtcgattgatgggcataaatatataaataaataaataggaaaggttttgtgtccattcgttgggaatgaatgcgttgagggaacaccgccgccgcctccgatcatttcattttgttcgtttattctctctattttattgtcaattttaccgctctgatcaatcggacgaccaaaggtgaaaaaatgacggattgcccccggggcgaaaacggggaaaaaacgaagggccattagttggtgggcatgcatttttaccaatgattacccaattattggctgatcagcagatgcaattcaaagtttttggagctgtgaattattgaaaaatttgaaaaaattcggtgccatggcacggaaaggagttgccggaacgggcatcccgacctcgggaatgccaaaaaggtaattctgccaaggcacaatccgctaaaaacccttttgaattatctgtctgatcgctttttatcaatgcgcgagtgtctcgaccccctactcgggaattttcccgctttttagggctctcggactcgttcccgggtcatttcccggcctcggttttcgattcccaatgaaaagcatttttcgcactgaattacttctgatcataagcagcaatcagtccgttcttgacttcgtcattctattggctctgctctgatcacaccaattatcagctcatcgcacaattggattgttgttaattcccgataatgtcctttttaatcggaaggcgacggaacggaaggatgagccataagcaaatggacacaaacaatcgtttaagtgccgcccatttgctaatgactcgcccactgattgatcagtgcttccagcattgagatgacttttgcttcctttggctatgcgttcaatatttatttatccattcgctgcataatttgcccatgtccgtcgttccttcggggcgcattatgcgtcatcccttccccccttttccttcccctcctctctttcaatccctctttttcttttcctcttctcttctcttctcaatctctttttctttccctccctcaccttttcaatatctcccgtcctttttctcccctctttttcttttcctcttctcttctcttctcttctcaatctctctttttctttccctccctcaccttttcaatatctcccctcctttttctcccctctttttccatccccctctcttcctttaaatccctccttttcttttccctcccctcctcttctcaatcgctccttttctcatcccttccctgccct

SEQ ID NO: 28354 - DNA, 1553 bp, Heterodera glycines
atatagtccatgaaagattcagcaaaaagcgagaagaatgtaaagcgaaaggcacaaagccgtgatcaaaaaaaagagaactaagttcaaaagcagtgattagaatcgaaaagcaaaaaagacgaaagaggggggggggggggaggggattaattcgtacaaaagtacgttaatccgcgacaccgtattcccaggcgcgaagaatgtgctcgaacactcgttgcgcgacgtgttcagcaccgaattgcacaattttgcctttgacattggcatctttcgaagagaaaaacgaaaatccctttttctccttcttcagtctgagctcaatgcctaaaattgaaattcatttaggcattcttaagtttaattgccaaccaaatttcccatttgagtccacccgagtcggccttttgagttcggcatattccgggttccaatctgcactccaattacccgtcagttcgtgttgtcgagcctcaattacgtgcctaagaatgaatgggttattatggtacactttgtagggatgggttgatgatcatttattcacttgtccgtcacaatgatgaccaaatgttttgtgatgcccccataagtcaggtagtgatcagtgtcagcaaaatgaccacggtccgtctcctacaaaaatgtgtttaactgaaggaaattaatagactgaattttaacccggaatattttgtatccgacagcctcctcaaaaacgtatggtcggatgattttgtcatgggaaatgacacgtggcgggcgaattggctttacgtcctcaacattgctaatggcactgaaaacaagtggattaacaatggacccgtcgtgtcccttctccccctcgctcactttctgacattgtccgccgtcgttgtgaccaaatcgaccacccccgacacgggacgagcaattgcaccgaccattccctttcctaaacataaagttgaccagaacgctttatacaaggccccgttcctatgagtttgacctaccgatgcctttgatcccgccgagcaggccgccctgcttaacgccctcgacaggtttggacacgacacctgagaaacaacaaaacaaaattgtcagtgtgatatagaattagcaaatgagtccaaatgtgctaattataagtgccggctgaccggtgactccttccacaacgcttgtgccaacgccgcgaaccccgcgaaacattccttcaccgatgctggtcggctgctgccgggcctgcattcgccgtcgttggtagtcctcgtccaaagtcagtgccgccacccctttgcccattgtgccggtgatgcgcgaagccaagccgagaacgccgccgacggtgtgactaaaaagtgggagggggacatgagtaagagcaataagcaatagccaaaagattccacctgaaagcactagtcagtccaatataaacgccctccccaaattcggccggcccagtgaccatgccgagaacgggttggtagaacaagtcgacagcgccggtgcgcaagtcgcggacaagaccaaacggattgccaaggatgtcgaggcct

SEQ ID NO: 28355 - DNA, 1499 bp, Heterodera glycines
ttaaaaagcaattaaaaaatttttaaaatgagaattcatgcgagattttctggaaataagcttaatagggcctagttaagctgtaaaaaaaatttggggcgatttgaatgagaatagaaatagccaggttcgatgaagttttggtaagccaaaaaaaaatccaaacatttaaaaatctataaaaaatttaaaaattagaattcatgcgagattttttggaaataagcttaatagggcctagttaagctgtaaaaaaaatttggggcgatttaaaagagaatagaaagaaccaggttcgatgaagttttggtaagccaaaaaaaatccaaacatttaaaaatctataaaaaatttaaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaatccaaacatttaaaaatctataaaaaatttaaaaatgagaattcatgcgagattttctggaaataggcttaattgggccttgttaagctgtaagacacccaccacttgggcacttaaaaaaatttcaaaaaatttaatcgtccataaataatttgtaattgatcagcggctcaccaaattttgcagagatacgtatcggagcactacaaatgcttactaattttcctagattttttaaacccggtgaaaattttttgcagacacccaccacttttgcacttaaaaaaatttcaaaaaatttgatcgtccataaataatttgtaattgatcagcggctcaccaaattttgcagagatacgtatcggagcactacaaatgcttactaattttcctagatttattaaacccggtgaaaattttttgcagacacccaccacttttgcacttaaaaaatttcaaaaaatttgatcgtccataaataatttgtaattgatcagcggctcaccaaattttgcagagatacgtatcggagcactacaaatgcttactaatttttctagattttttaaacccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaatattttcctgcgcccaggtaactcactcggccgcttcgcggcctcgtggctgtaaaaaaaat

SEQ ID NO: 28356 - DNA, 1744 bp, Heterodera glycines
tattgagataaattttttgaaaattcaatatactttcccgaagtttactttcaatttgttgaatataaagtaaatccatcaaaaaatggctaaatccggtattaagaatcattatagatgatcaaaaagacgataatgataaactttgaatttttagcgaaaaatcaaatcgacaatcgaaattttagcttttttgcttattttcgtcataaatttattaattgttccttcctaggagcttccacccaagctaactacatatttttcgtgcgtttcagtccctcctcagtataggcataaaatggatttccatatatttcacgccttagttatttataatctttttttctcaaactttgaattatatggttatattcccgaataatagctccattttacgctttgatgattgaattgcgattctcaaatataatacgttttcaaaaaacggggtcacttagagtagaaaagcaaacgtgcgttttatcacacgtctttgtcctattatggccacgttttcactacacagatatcacgtaatggggaaattgagtagcttacgcaaataaccccctttataccatgcataacgtaaaaactgcttaaatttcggtgcgcataattgataatggataagactttgaagtttgatgatttcatccgctgataaatgtttacagggagttcatcaagtacaattcgatcagaaatttttcgaactaattctttccatgttctgtcaaccattaaaaattaaaataactttttttgaactaaccgaaataaatacaaatcgcatggctgaacaaagccagtacaaccaggttggattgtctggatgcaaatattgtccctgccacactctttatttgatgaagagcattcctggccaaaggttccaccaatggccgttttccattgtggccaagaatcaagcaacacaatggcttttttgtccccaatgactttaagcaaaaaattttcaacaaagaattttgccatttcttttgtcatgatatgagaacggccagcaatagccgttatatttggggcctagaggatgaaaaatagacaaattacagaaaatatacagtaaccttaaaaatccctttttgagggaattggccatttttttctgctatgattataagcagcggtgaatacaacactccgtgtactgaaacaattggacagattgtatagctgtgagttgttgctgaaatattttgcgccctgctttccactctttttgtccaagaaatttctaatgtatgttgtgaatgaagctcaagctcaaatcctgattgatcactgttgagaacaaggtccgggctcaactcctcgaccatgtttattactccttgaacaaaattgttggatgtttccagcaatttttccttttccacggcatattttttgttcacgaattttgtgatctcaaaaaattgagtaaaaaggattactgtagatcaaaaccttctgacaacaattcttttggctgatttgaaatttttcaaccaacgacggcttgctttaaaattgggtattttaatttcctgttatgagcccatctccgtaaatccatgtcctttattgtaaggttgattcgcctttttcaaggaacatttcaaaaaggctttcattaatccttttgagcgcagacttccggtcttgataagttttctcgaacctttaatgagtccgaaaaatgttttaaggaaaccctaataccgccgtaatttct

SEQ ID NO: 28357 - DNA, 1003 bp, Heterodera glycines
catctaaatttcaaaaatttggccaagtttgagcaaaccttatggccaaaagcacacaaacaaccagtttttacacatttttggccataacttttttgaaacttatctaaattttttaaatttgtaaaaataggaatttgagttgggttaacaataaataaaatttgaacaattccgtcgttttgcgatcaaaaatgttaaaattttgaccaaaattcaaaaaatatatacaaaaaaatttaggaaacctaatttctgcatcggttgccttggccttacccattcgcactgaaatattgttttttcactctaattcactttacctattatctctaattagccccccccccccctatctaaggaggttgaacaataatcatccggggggataattagagatatacggacggtatcagctcaatcaattttgaattaggatacggagaatccaggaaaaaaatatatgcatttacaaaaataaggaagccgtgtaaattatgtatgtattgaacaaaatcagcaaaacacccttccccattactctctctttatatacgcataaattaatgcgttatggccattatttttggccaacaaatcattttaatctccccccatccgttcatccgttttcaaatctctcacttttattttggtagatatataaagaggccgaaaagacatttttgatgcataatagagaaaaaatgaacagacggtaagcaatttcttttaaaaaattgcaaattttcatttacccaattttcttatgtttcagttggatttgtggtgacgtttggatggacattctgccatcttttgaccatgctcaacttggactcaaaatggcattgctttccgaccgtttcgatgttttggtggacaaacatttcgatgcaaaaagcgaattgacaatttggagaagaaatcgaattcgcaaggacaaagggccaaaagcgaaactgtctgttctgatcgatgacaaatgggtggcatttccatt

SEQ ID NO: 28358 - DNA, 1334 bp, Heterodera glycines
aaaaatgaattgtttataaaaataaaatggagattgttggttaattgaaaattgaagaaaattgggaaggaaaaggaaaatgagcgaaggaaagaacgaatgccaaagcgaagccaaacggaacggaccaaaggcactcaatcattcccggggatggggaggagggcattctcaagagagggagaaaagcgatgccatcgcaaatgacccgagggatggcggagggaccgatttattatttatttctcccccgccctttggcccttttttttgtttattttcttttgcccgtcacaattaattaaattatcagtcgcgtccatcttgttaaagaacgtccgtcggtcagaagcagattctctgcacctcaaatgtgttgttttccatgcattccttctcttagaaaggtgaaaaattaaatattcttgttgaataaatggcaaatgcaacgaaaggaatttttaggacatttggacggaatggtaattgtaaaaattgtttaattaaaataaaaatatctatcaaaatcaaaactaatataaacaaatctgactgatcagcgcaccagcaaataaatatttaaaaagaattattaataaattaaacaagtcaaaaggaacaaatttattgaaattaaatatttcattacatataaaataaaaaggatgtttgtcaattactttaatatttatgtcatattattgataaaatattagtgtgtaattattattgttatttttgctataaaatttgtttttttttcactgatgcattaaataaatgtccaataattttaaattcttatttaatatttttcaatataaaaatccattttcattcgattaacccattaaattttttctttcattcattttattttttttgagaaatgctttttaaattttcaattttattttgcacaatttttttgtgcttttgcgtcgacgacggcccaaaaaatgacggaaaaaagcaaattttgacaaattgggaagaaaataatcaactaactgagttcgaacttgatgacgaatattcgcattatctttacgatttaatgggaaatgaaaacgacgaagacaaatgggccaaaatagaaacgaaaatagacaaagcaattggagggggacaatggccaaaggaggggcacaaaagcggaaacggggaaaatggggacgaaaatgggcaaaatgagtgccgaaatgggcaaaatgggggcaaaaatgcgcaaaataagtgccgaaatgggcaaaatggagacaaaaatgggcaaaatggggataaaaaagtaaaataattgaaaattaagaaaatattgaaaatttaggcaaaag

SEQ ID NO: 28359 - DNA, 667 bp, Heterodera glycines
ctacgctaatcgttcaaatcacgcaatctggcacacacgcactcagcaaagcggagaagttcaatctcctgcgcaacctactcggaggagaagcccgagaactcgtggctggctttcgactggaggacaacacatgacgacactgtcctccaattgctgaaggacacataccttacaacgagagaacacatcgaggagcttcacttggacgaggcttgcttgatggcctcaataattagcgtgcctccatacaagtactccgcgcgactcgtacgacactctattttaaaccatcaatgaaatcacacataggcttaaattaaaacgatggtcaaatcaatcaatcaatccgttcacttttaaccgaattatgcctttgtcatgtccagagtgccattggcagacaaaaaatccttccaattagtcgaataattgtctgtcttcatgcaggacatcacaatgtagcagttgtcaccattttgctccacatgaaattgaaaaatttaatgcaataataatattaatagttcaaaatgacaaactgttttagaaagcaaaagcatttaaaggtgtaatttacctaattggaatgttagacgacccaaccggtaacatgggagattattgggatatatttccaaatatttcatgacacttttacggttgg

SEQ ID NO: 28360 - DNA, 827 bp, Heterodera glycines
tttaaaaaaaagtaagctgcacaaaattaatggctgggcaaacttttcgattatttttagagggaatttatttattttttctaaatttctcggagcaggtcctttcctctccgcgtcgccaccccccccgaaatgttttcaaacctagaaactttttattaaaaaaaattcctaagaaatttcttaataagaaaacttcaagaaaaaatttttgaaaaagacacgtaaaacagaaaattcttaacaaccttttttaatgttttacatagaaaaagcattaaaaatcgctactcttaaacaaaaaattttttccaatatctaagaaacctaattgtaaaaaatttagaaaaatgaaatttgatgcattcttttcgggtgcctaacttccttgcgtggccattaagagaaaattgaattttttttagtggttttgcttttctgccgatgggtgaagcaatgctcggggctgaagctcccccaatgcgtgtaatgacggacggcgctgtttgctggtattacaacaaatttggagcaaatgtctacgttgactgcacataatcaacaacaacaacgacgacagcaacaactccatcgcctacaaccaaagaaaccacttctttggatgtggaaattgtggtcggcggctgtctggcggccatcgctatcattgcgatagcggccgataacttgaggcgttttaaaaaaaagtaagctgcacaaaattaatgctgggcaaattaagcgattatttttagagggaatttatttattttttctaatttcttcggaagaaggcccttcctcctcggggcggcaacccccccccc

SEQ ID NO: 28361 - DNA, 1201 bp, Heterodera glycines
gatcagttcagggggcctcagagatggtgatcgcttttggtaggtcattgttcattcctctttctgctagtcattccggtgcttaaataagcttcagctcactgtcgattatttaattttttaatcaaactttggttccggattaaataattgaacacactactagcttgaccaccaaatagcttcaataccgtataccctcccaatacaattcaggtacgaaaatgatggtgtgttcacacagcttcagctagcgcaaattcggaaaacctcactggccaaagttctgtgtacgaacggcgacgacattgaccgtattcaggtagtacaaaaagttgatactaccgtatctttcactgacttggcgacaataagtaggctcaacccgaaactggtgaataccatatcgagattttatttacaccgatgaatcatgcacttcatcataaaaaaaattctgagcccagggaatgctcctccggcagcgtcaaaaatgtaatggaaaattccttgaattttgaaaatcgtacccaagaaatctgcatttttttgcctagtgcggttctcaaaagctataaatttttttggactcaaagagaaacaatgggtcttcagttggccccttccgaaattcgtgctttctggttatgcttttgtctccgacaaatttattatttttctcaattcttagtcaaatgtgttccgttatatgggcaacaacatgttggcctatcggtcatgtgacgaattggcggagcttaacttgcgcatgtggatgtcctgttgtgatgaaacttgctcagcacgtgcgtcgactggcattgacagtgccaatgatgggaatgagcaaagcagaaggtggaataataaaaaaattgaaaaattgccatagaaaatattataattaaaaaacattggcattttataacaaatatgcatattcaaatgcatgaaatttgaataactttctattaatgaacttttttttttgcacttttttgattatgtaaatatttaaatcgaaaaattaattaaacaaattttactttttaggcgtaagcgcgctgttcatctatatgcaaatgggaataattaattggaaaatatgcacaactaaaaagatcaattctaccataaattgttgctttaaatgatgtttgatttacatttacaaaaagcacaagggtttcatattaattta

SEQ ID NO: 28362 - DNA, 1764 bp, Heterodera glycines
  misc_feature (1757)..(1757): n is a, c, g, or t
ctttgatcaattatcgattgatcagccgtccttttccgctcgttcttctgctgacctgctcaatgctgctcagcttctgctctttgcccatctgttgcatttgtttcaacacagcttcgacaatctttaaaacttttgccctccgtcggtcaaaaaagcggcacagaaaggaaaaacctttttgtccgtacaaatttcctgaaagcgcttctccaaatcgccattttgggctgtgccgtgcaattccttgtacaatcgcttgagggttttctccggtggaacaacgatcgcctgaggggaaattgggagagaaatgccgagacgcaattattagctggccaattcatgttcacaacaactcattaattagcatggcttctcatttccctaattagtgccattttcgtcgctttttccccaatttaatttcaattcttctcaccaccaaatttcgttccaaactgtcgccgtccacataaacttgctggacaagtgggcattgcacataaacactttcgattttctccggtgccacatattcgcccttaattacggttaattgttcgctaattggtctccaaattaacctttgtcctcttcgacccccttttacctgagccaatttgaaaatgtgcttcttccggtcgatgattttcaaccgtccatccggcaacaattggccaatgtctccggtgtgcaaaaagccgttctcatcgaacaattcggcggtcttttccgcgtcgcggtaatagcctttggtcaccgacggtcccttcaccagcacttcgcccttccgatcactctgaaaaatgccaatttataaaagagtatttagcatcagggatgggtagatatttaattacggaaattatatccgtaattacgggatccaaaaatgtcgtagtttccgtaatccgtaattatgccaagccctgattggcatggtctattttgtgccctttttccgccattcgctttccctccgactgaccgtgaaataattcagttccggcacatcggccaatttgaccagtgaacacgcggccggcgccccgcaatggccgccgtcgacgtcgcctggccaagtgacggtgaccattgcagtgcattccgtttggccatagccttcgatgattgtggtgccgaatgcaatgcgcaagtcctgcagcacttccggcgcaattggggcagagccggtgacttgaaaatggggggggggggggaatagcaggaaaaagagagagagtgagagagagagagacattggggaaaaataaacggagaaaggggagggaggcagggagggagaagtgattttggaatattaaaaagacagatcagttagagaaacagagagaaagagagagcaaagaaaaaaatggacatttagagaaatcaagacggttgtgatttccttgcacaagtcaaattaatcaatcgattgatcactttttgtgtgttcatttgatcttcgtttgctcaccgatcagtctgactttgccgcccaattgctgctgtatcttggagaataccaatctgtcccaaattgaccgatttgtgacaatgcctttgcgcaggagagccaatttctgggcataagccaaacggaaaagccattgcttgaagggactcgaacgggcgaccaaagactgaaatggccgaattgaaatgggaaggggtggaggaaatgcgacaaaacaaagacaaatgggccgtaattaattagtcgacattaaaaaatgaaatggcacgccgantagtcgt

SEQ ID NO: 28363 - DNA, 839 bp, Heterodera glycines
tttggaatcgttcaacatcaatggccatcagattgactattcaccgacagttctgtctcgccgcgtgccatttgacagtttaaacgcctttttgtagatggccatcgtcagcaaactttgaactttggcgcccatttggaacatcacattgtagtggtaattgacgcaaatactgaaaaagaaatcaaaaatatttgttttatattaatccaattcttacgatcgaatttcagagcagagaaaaatagccaacgagtagcaaatcccttgccaaagatgggcgttcgggtcggagatgaaattgactagcaaattcagaagcaaaggattggcaaaaaggagaatgtcgtagaacagtttgacaaaggcagccaccaacagatcgtatttgaacaactgtgaacgacggatggttggttgggcagtgaatgacagcaaatgaccgactgaccttgaacagagtgaacacaatggaaggcattggcacggcgcattcgctgtcgaagctgcgtttcggcatcaaaccacgtttgctggtccgccaaatgaagtatttgtgacggcgccgctcttggtattctgttgatgtgacgaaatttaaagcgttttgcattatttattcaactttcggcggcaggcagccaaagcttttcccattgtgcggtaaggaagtgacatttgttgtcagtgtccagctcgaataggtcgtgttcagttaggggacgcttgcgaccgatttgaaggattggaccgaaccacgaatagaaaagacgagagaagaagctggcgttgagtttgggcgaaccatcggcattttttgccttttgcgcattttaaat

SEQ ID NO: 28364 - DNA, 1012 bp, Heterodera glycines
ctctattatagacaaccaaatcaaaatgccattgatggcgacatggcaatggcactggtgcgaaaatccgaaacgaattaaattttagactaaatgaaaacaaaataacaacacgaaaactctccgaaaacgaaataacggaaataaacgcagttcaactacgttattttgttaaaccgacaagaataaatcaaaatgtgaaaattagaaaatagttttatcgcaacaataagccaaaataggcatcaacaaagcaatgggaatcagaacacaatcatctgaagccaaacaataccaccagctatcaaaagccgccgctaagcgaaccaaaattttgcactccacgagaaaagtcaatttcaccaacttcacgtaaaatggatactgtagcactgcccaaaagctaaaagggtttctcctattatataaggtggattttcaaatttaaaaaaaagaacccttaacaaaattcgtcttacaaaattagattttgaaaatccccactgttgatatatttaggtgcattttttaaattaattttccttttgcttacctgtccatcatcactacgttggaaagtaaacacatcaccggactgtttttgttcccattgctctggctcaatctccaaataattcttcaatttcgatcgctcataaattgctagttttcgaacaatgaattgttcattgtgaaagacagtaatttcatatgattgacgattttttggaaaatacagtttcttttttccgcgcaattcacttacttttaacgttttaatccactaaaataacaaatatattttttatggctttatctaatagaaaatttacacatatgtaatggaaaaaacctttttgatggaccaattagatttgatttgtttctcaacaaattaccccattaaaattggattacgtccagtcattcttccgaaatatttgctttatagacccaatttaaatgttattatgcttttgtctaatggaaaattgtggaaaaatcttttacc

SEQ ID NO: 28365 - DNA, 1569 bp, Heterodera glycines
aaattcgcattcttctaaaagtttattagatctcaaataaaaataattaaaatttaggttgaaggcggcgtaaaagttgaaaatggccaaatgcatcaaattttcttgaaaaattgctttacccttcgcattcatccttcattatcgtcaaataacaccactaatgatgatggacatatttattttgtggccgttaaatgcaatggcattgagggaggtcaattgtatcggacaatcactgaggaaattgcgcaaattgtgctccatgagcaaaacgaatgtgaagcttatgacataaaagtgtacaaaattagcaacgaaatatcaaaaaaagacatggtaaaaataattcttatttttcaatttttggggtgtctttttccaatattatgggttttttaaagtgagcatatcacctattttctataaaaaaaaattggtggattgcataacaaaaaaataaaaattttcattaaccaattaatcttactatttgggtttgcttcattacttcgcacaatttcaatcaatttcatctattaaatcctttaaatgctcagtttataattaaatcataatcattttagaaggctttcactggcggattattggtattatattttgttattaaaattttgatttttaataatttacattaagccattaaatggtgatcaattcaaggatggacgacaaattttaggagtgcaaattcctaatggccacacttaccaattcagttttgttacatttgaagcgcaacaaccatcaacaccatcatcatcatggaacacaaaagcggtaacaattgaaagagcattcggaatttaaaattttaaaattgaataggaaatgaagcgcttatcctctgaaattgatatattgggaactgaagtaaagcagctgaagaacgatgttgagcaaatgcgggaatcaattaagacggggctgacagagatcaaaaattttctaagcaacaaattgaaaaattgaacaatttttcaactctttttgagtgattcatttatgttctatgacatactgtaatgtaacggtatataaaatctgtatcattatcttttttttattattataaagagcataactgacataaattggtggtagatgatgcttaaatctgatcctttaattgaaattttgaggcaattaataaaacaattaatttaattttcaatgttttaaaatgtgtttatttgatttctttaatttgaaattaaaaaaaacaaagatttaaaaccaattaaaaagaaaaggcaccaatgactcgtatccattatccagaggcacccaagggttcctaggcaaatgtgttcaatttttttacaaagtttgccccaacctccgacataaaaatgccaaatccataacgagaaaaaaaggcaaaccaaaagacatattcagatttttgtgattttgagaaagcaattaatccaatcttaaaatttgctttttgtcacttattgctttttggtatttcatttttttggcatttcatgtacaaagtttcaattaaattatcgaataaatgacagcattttatagatctat

SEQ ID NO: 28366 - DNA, 1246 bp, Heterodera glycines
gaagttctggaaaaggaggatcaaaacaagagcaattaattaattaattaaaattgggcaattaggactaatagaacacacatttgagtcgacgatgaatttccaactgcaacaaacgagagaaacagcacccaactcagccacactcaaatgcccaaagatgcggacgagcacagcgcggggcaaacgcgaggcagagatttccacgcgacgccggtggtggtggccccttttcggaatggtcggctgagtctcggatagatcgggagggtccatcagaaaagcaactgaagcaaaacatacttttgcccctgactgtacattttcaaacgtggtgaatcgaagtgacaaaagtgcgaatgagtggtgatcagaaggggcgggtcatttcagtacagaacaaattaatttaattaattaataatctattaattcgatttgctgaccataattataattagatttagatttattattttaatatttcccaaacaaattacatttttatgagaaaatatagtcccaaaaaactttactcaaacctgaaaaactatcttataattcatttaaaacttgaaataattcatgcttgcataacttttggtgctgatcaaaaaagtctcttacaccaacttgatcagatcactccttcctagtgaccgggacacccaaaatacactgaaaatcggggaaattttcgaaatccctagggggttgggaaatttttttagaaaaaatgggcaagcacactagaaagagcacaaaaatttctactgatttgacttttgaataatggggctatgacttctacataaaaagatatacttggttgaaaatttgatcaccataaaaatcatcaatttttgatcagtgccataactttttgtagaagcatccaaattaaaaaatcttggtatcttttgatagccctaaagtgccctctattttgcctttaaaatttcaaaaaaattggttgagtttcaaaaaagttgtggcttgtaaacttcacaaattgatttggtaaacctttttgccacaacttcttagaaactcaacgaaattttttgaaattttacaggcaaataccaagaatgtttaatttgggtgcttcttttcttcatatctgttgttgcggacacaacaacaagaagtgtgaagaatcggcagacactgtatgagttagacacttttaaagttaatggtgtacaatacgccaatgaaaaaacagacagctgagttgacacta

SEQ ID NO: 28367 - DNA, 916 bp, Heterodera glycines
attgacatccctactgatgatttatcatttttttcttactacatataatacaaaaaatcctaattgttataaaactcaccgacatgctttattggtgattcaccttcgtttacgattacagtagttttctcctttctttttggcatacagttcacctcgttaatggacaatgccaaaatgaccacgagaacgaactggtgagcatgaaacattagtcactattcttaaattggcttcgaaaattgctaaattaaacctaaagtaactattaaaataaaattggaaatcaaattttgcctttaaaggcacagcttttatttgccaataaaatatcacaaataatcaaaaaataatattaataaggattatttattcattcgcagaagaaagtgagttttttttggataaaataatgaggaataggattttattactatttttacaaattgccatttttattgtaaattgggtttttatgcttgctgatgaattcgtccaattgcttttggttatacacatataattttctcatattgaatgctggcaatattaccatccactgctcattgttggcatttgttgtcgtcattatatacactttcataaaataaattttacaaatttatctttaaaggccctgaattttagattaattaataatttaggagaaaaatccgctttatcttggtcacgaatattttcatagactttgctggcgtacatatcaaggatggaattccgaggcaccaaaaattttcgtaagtaggaagtcggaattccaaggcccaataatttttcgtaagtcggaagtggaattccgaccccaaaaatgtcggcagtcggaatttttcaaaaattttaaatataaaaaatttttcaatattttattcggctaaattttaataataattaaata

SEQ ID NO: 28368 - DNA, 959 bp, Heterodera glycines
  misc_feature (9)..(9): n is a, c, g, or t
atattttcncacatccattctgctaaaactagcagaatgaccgcgttgaccaaattttcccaagccaaaattttgtgtcctattaattttaaaacatttagtttccaaaactggaaatttcgagtgatcattttcacttgactcactcgaccctccccgcatggaagttgaatccaacggaaattctgaaaaacttgctctcagcgccttgagctcactcatcatttttgtttgcgtttctgtcagattacttatgatcaaaagacgaaagatttgcagagaagttgacggtacagctgatttccaaattttgttactgatttctatctcacttatttccttaacaggactcttaatacctaaaacttgatcaatctcataaagtcgaccttcaagaacgatatgtttgtagcgatctgtctgacaatcaacttttctagcttctgcacttattatgagggtttttgggtccaaataagccagaattggcttgtctttcctaactaatgtcacctttactgggattttcttgtaacatttatccttggtttgtgcgaatccatactcataaactggtgaacatggccaaatttccaaaatgttctgtgaaatccattcggtgcgaacttcaccgtccaacggttcatcaaaattaacatttcggcgagttctgtccaattgtcggttgaattttacaaattctctttcttcgattgcgaatccttgttggctaactaccaatcttcttaaacaagaagtaataaatgtcagatcttccccaaatgttagggctaagtccggtgggtcactgatccaacctattcgataaaatggttccatttttctttgaaaacttttaaaacgcaatgtccgtgtcgagccgcccatggttcagatgtgtgataccgatcaacatcctcaactacaatcgaatcgtgtaactgcatctgccgtcgtcg

SEQ ID NO: 28369 - DNA, 1339 bp, Heterodera glycines
  misc_feature (1108)..(1108): n is a, c, g, or t
  misc_feature (1205)..(1205): n is a, c, g, or t
ttttaatcattaaaaatattttagttattaaatgataatcggaattttatcatgctctgataaaaaatcatttgatatggatcgacagaaacgaaaaatagcacttgtgaaaatatttactgaagattggtttcagacgcggtgtagaatcttaaaaaattaatattatttaaatcttttataagattacgcgatacaaattaaggaaatagtaaagttcatgtgatcttgatagaaaatggataatgaaaatgtggtttattgaaaaaaatggtgttaattcgcgtgcagaatctataaataaattaatattattttaatcattaaaaatattttagttaaatgataaatcgaaatttattaatgctctgataaaaaaagcatttgataatggattcaacagaaacggaaaaattagcactttttggaaaatattttacttacagatttgaaggtttcagacgcggtgtagaatcttaaaaaattaatattatttaaatcttttataagatttacgcgataaaaattaaggaaatagtgaagttcatgtgatcttaatagaaaatggataatgaaaaggtggtttattgaaaaaaatggtgttaattcgcgtgcagaatctataaataaattaatattattttaatcattaaaaatattttagttatataaatgataaatcgaaatttattaatgctctgataaaaaaaagcatttgataatggattcaacaaaacggaaaaattagcactttttggaaaatattttacttacagatttgaaggtttcagacgcggtgtagaatcttaaaaaattaatattatttaaatcttttataagatttacgcgataaaaattaaggaaatagtgaagttcatgtgatcttaatagaaaatggataatgaaaaggtggtttattgaaaaaaatggtgttaattcgagtgcaggatctataaataaattaatattattttaatcattaaaaatattttagttatataaatgataaatcgaaatttattaatgctctgataaaaaaaagcatttgataatggattcaacagaaacggaaaaattagcactttttggaaaatattttacttacagnatttgaaggtttcagacgcggtgtagaatcttaaaaaattaatattatttaaatcttttataagatttacgcgatacaaattaagggaaatagtaanagttcatgtgatcttgatagaaaatggatattgaaaaggtcggtttattgaaaaaaatggtgttaaattcgcgtgcaggatctataaataaattactattattttaatcattaaaaatattttagttatttaaa

SEQ ID NO: 28370 - DNA, 1207 bp, Heterodera glycines
acaggagtagcaaaggtggtcatcgatgaatccaatcaagtgcagatgccagatattaaagaaatagaatatttctttaggagtcgttggggataaaggaagaccctaacgaagtcgatgatcaaacagcaatgcagctgtttgacaagtcaatccgtcgtgagaacgacggacgttattcagtgaaatggccgtggaaagaagatataccaaatcttccttccaattacagaatggctttctcaaggttgatgtcgaccttgaataagctcagacattctcctgaacttctacagcaatataacagcacaatccacgatcagctatcaaaaggcatcattgaagaggccagggaagcacatggcactcttgagcactacattccgcatcaaggagtgctggctaagggcaaaaaacttcgcgtcgtttatgatgcgagtgctcacacaaggggtacaaacagtttgaatgactgtttgtacagaggtccggtacttttacctgatctcatcggaatgcttttgcgattccgatgccctgcatttcctcttctcgcggatatccaagctgctttcttgcagatttccttggaaccagaggatagggaagtcacaaagtttttgtggctaaagacaccgaaaaggaggcattaacaaaatataaagaagcgaaggctatccttaaagaaggttgtttcaaccttcgggaatttattaaaaattccaaggaggtgatggaagccatccctccggaggatcgactcgatcctttaggattgatgggcccatgcatccagcctttaaaacttttcttccaaagcttatgggaggaaaagaaagggtgggatgatgccctctcagaagaggactcgactcgctggagtactttccaagattcttggaaagacaagcgaatccgaattccacgaaggacgatgataaagggagaatgctcccttcaattgcatgcatttgtggatgtttcgatccacacatttgcgaccacaatttacctccgagtggagagttcatataaaattcaaaattggctgattttctcaaaaaatcgccttaagccaaagagtgcttcataagcactcactattccaagaatggagctgatggccattcttattggaatccgaggcttaaaatttatacaaactcaattgcgtcgagcaattgacattcctatttgtggagtgatt

SEQ ID NO: 28371 - DNA, 1037 bp, Heterodera glycines
ctacaacggtgccttaatggcattttaatgtcaaaatccttgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgagtactttccaagaaccatgagaataaatatcgcactagcgccaaaatcgaacaagaacgctaatcatcagtatcatcttaattttcccccagtgatttgtgagtgataagaaaataaaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgagtactttccaagaaccatgagaataaatatcgcactagcgccaaaatcgaacaagaacgctaatcatcagtatcatcttaattttcccccagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatgggttattcacaaatatcgacatacttcctgagtactttccaagaaccctgagaatatatatcacactagcggcaaaat

SEQ ID NO: 28372 - DNA, 2030 bp, Heterodera glycines
acttagaaatacttttaaaaagggattgaattttgattcttctaagcataaagttcagatcatttttcaaatttttcgatcggaggaggggttacggtgccggggaattaccgttataatccctttttggtgatttttgtataaatttattttcgaaatttttaatttattaattaaaaatattatttaataattttctaaatttatttaggcattaaaacaagtgctgcacaatcgagtggcgccctcctatcttgagtcaaagtaattttaattaacaaaaattaatttcaatattctcgcttcattatttttgaatttagcattcaacaatggctcagggaaggcaatttggcgaagtgatttcaattcgaaaattcaaaaaataatcaaatccaaatttaaatgcgtcccatttgtgcccagacttgatcagcttgtgctgtccggctgtggtgatttgctgctggacaaaaagtcgtcaaattctgctgcgcatgtgttcctcaatgagttgccaaatctgctggtactgtactgtaccattttgtttgtaccgtataacagaatgtcccccggatgagggttttgtccttgtccttattttattagtactggaaaaaaagtttcttttttaattaattctccttctttctgaaatatatttttaacaaattgttttaaaaacaatttggttgataattttgtttgttaattgtatttattttaattccgtattttatttattttttaatgattaattaattaattaattaattaattaattgctctttcagaatacaattgattccattcacaaggcggtgaaagatggtcaattggaattggtgaaggtgaaaaagcactaattcattaataaattttatgtcacttaactaattaccaataaaacaaactgattttattttttaatttaaaaaattatttaattaattttatttatttattgaaacatttttgtcaattaattataatatttaagttcaattaaatttaataatgttccaacaaaaatgaaaataattaatcaattagtaccttaataaataaaataaatggaaaaatttaataaaggccctaataatttgagggcatgatgaccggaaagcgtttggcatggcacgcgaccggcacgggtgcacgcccctgcacacggccatcattcacgaacggagcgatgtgagatcattattctgctgatcacaaggacaaaccgaactgatcagaactgctgaaaacagcagatagtggcggacaacaatttttgtttaattttgaaaaatcaaatatttaaattttcttaaataatgccaaaattataccgttcacaattttcaaaattctatattatgccgtacacaattttgaaaattttcacttgtgaaaaataaaaaataaatacgaaaataatcttgttgggcaaagatcgaaaaaacattttaaaaacaaaaatttaaattaaaaaaccgaaattttataaaatataaaaatctaaaaattttcaaaacaaaaatttatataatatttttgttcacagattatccgcttcattgctgcaacttatccgaatgttctcaatgcgcctgactatgtttgtatagaattttttttttaatttaaaatttttaagaataaacggaccgccatgcattacgcggccgctgcgcgtgacggcgggcattacctgaaaattttgggcaaagctggcgccgatccaatggcagtggacaatgtaaaaaatggggggaggggctaatttaattttaaatttataaataaaatatattttaaattaaaattttaattcaattaaaataattttgcaggaaggtcgagccccggactattatcgtagaaacaccgtttttgacttgaagctgttgaaggagcgcgacgtggaagagggtcagccagtgctaattatattttactctcttcgacactctcgaccagaacctggcccgggattttgcgagatcccagtggatttgcgggataatcccgcggga

SEQ ID NO: 28373 - DNA, 1721 bp, Heterodera glycines
atttgaaaatgtagaaatcaatggaaaaattaatatttgtatgtaagataaaatttttatatttttcatgaaaatgtaattcataatattattaaaggaaatatggcaaaattaagttgaataatatatgtcaggtttttcaaaaatttataaaattcaaaattgaataaaacataatgctaggcctgattaaaattttataattttgggattagttacggaatccggatttttgggtggaattaagtcaagaaagattttttagtgctttcgaaacgcgaaattcaaaaagagtaaaagtatggcaaataattttattttccaatgtaaaaaaattggccaaactctattttgcttataataaatggaaagtaaaaatcaatcaattatacaatctcataataatatgctagcatcagagtttttataaaaatcttattgttaattaaaatgatttggtgagaagaaattaaaaagaaaaagaaaaagaaaaagaaattaaaattattttattttataataaattttttacaaactaaagaaaaaaaaattgttattctttgcttatttatgattgaaaaagaaattttgctaaaaaattttttttttttgtacatttaaggcgtgaaatttcaaaattaatcttttaaaaatgaaatgttaaaagcaaaaagagaaaattcacaaagaaaattttatcatagcgtggaattgaattatttatttttaaaaattggacaaatatatattttttttaattgctaattttcttccggcaatttttagtttttttttcttcaaaatagcttaaatctaaattttggaaaaaaatctaatttttttacctagattgctaatttttcttctaaaaatttttagcaccattttggcccttttttgctgtttctaatttaaatttaataatttaaacaaattttatcttcagtttgttaatttgatgtccatgttttgcaatttttttccatatttcgtgattttgatccctattttatggtagcatatttggcgatttttcacccatataattggcaatttactttttttctagcaacataataaaataactctttttacacattcatcacttaaatttttattattatgatgaaacattttttcgcgcaatatcatctgtcagtttgacgtggtaaatttgtaaatacgtgggcaaattttatgcgttgtataattgattctaccttttttaatcataagcaaaattttctgccatattatcattattgtacatttcatttttaaaaattatataattttttttacaaatattttcaatattgtagtctttttaataaaaaaaattgagcaaatattataaaattctagatattcaaaaataaaatttaatcatttatttacctaaagtatggctccattagaatagggaacaccatgtttttgatgaatttgaagaaaaaaaaatttccagcctcctaaggttttttttcgaaaattttcccaaatttaagaatttcgtgatttctgatcaccatatagcagtgatctgctcaacttttataagaaaaaatgcctcttttctaatggaaataaataaaattagctcataagcataatttattattttataaattgtttaatttttttattcaagaaaaaattcgaaatgaaactcaaattctttttattagccatattaacagcaatttgtttaggcgttaaca

SEQ ID NO: 28374 - DNA, 1353 bp, Heterodera glycines
atgaagttttggtagccaaaaaaaatccaaacattaaaaatctataaaaaataaaaaatgagaattcatgcgagattttctggaaataagcttaatatggcatagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggagcgatttgaatgagaatagaaagagccaggttcgatgaagttttggtaagccaaaaaaatatccaaatatttaaaaatctataaaaaatttaaaaattagaattcatgcgagattttctggaaataagcttaatagggcctagttaagctgtaaaaaaaatttagagcgatttgaatgagaatagaaagagccaggttcgatgaagttttggtaagccaaaaaaatatccaaatatttaaaaatctataaaaaactccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattagagtacaggctatagggaagctatt

SEQ ID NO: 28375 - DNA, 806 bp, Heterodera glycines
gggctcccggacaatcggacagtggacgttccgacagtggacaatcgggcactgaggacaatccgacagaggtggacaatcggacagtgggtaatccgacagtaaaatgcacaaaaagataagaaaatgccatcgccgaagtgaaccgattgtgccatatcaagaaaaaaggaaaataggcaaagaaaaaagtgcgaatgtagtctaaaacactatttcattgcaaattaatttgggtttggcatttcgtaaatgcctgttgcacatttgatgaatataaacgctttttttgtcattcctcgcacacaatgcctgtcctgcgtattatggcactagcggcccacttctgcgacggccttttcaatatcatttatcgtgggatacggttgggaacgacctcagacacggctgagaaaaacggcactaatccacctgaatcaatcactacgaaataatgcattcattaactgttgcataattaatactatattcataagtaaatgaacagaaacaataatccgattcgaacatagccgggacaagagcttatttaccattaattgatgctagattaaaaattcttttggatccctaatacgtttattagcataattttatataatctttaatatcatatgaaaatgtacagcatacgtaaaatatatgcaatgtctgatgtgaaggacccctaattagactaattcgacactttctatacagacatgtacctgtaagaaaaaaagaatttcaaatggtaattaaaatagtcaaccatttgctgggacattgctctcgattcgctcccg

SEQ ID NO: 28376 - DNA, 904 bp, Heterodera glycines
cgagaaaagtcggcaaattgaccaaattatgcgatcacttctacaggcaaaggacttcaaaatgatgctttttttaataaaatcctcctcagaatgtgattgatcagctgccgcttccgcccggctttgatcagttgccggaaaaggaactgaaaaaggcgcgggcgatctttagcgatcggagcctttcctttcaggtgcaatataaaagaattatgcattaattagccgctctaattggtcattaggagaaggaccgcaaagtgttcgaatttgtcaagtcccttccgtcgcatttgcggcgcattgtccgccccactcttccaccaatgttcgcgcgccttcgatcggacgtaattaaaagtttcaaatatcaaatttaaaattttccattttaaaatccacggatttttctcactaagacccaagcgaaaattggcgatttgctcgaggacgaatcattggacgacgcgcaaaggcaaaagcgattttggcaattggccaacggactgacggaggacgaaaaggcgacgctgggcgatgtgctgaaattttctcccgcttaagctcattttgccgaagggtcagaacaaaaaaagacgacattttggagttaaaatcattttcatttaatttaattttgtttcttaccaaataaaacctccgttccatggaatttggatccaatataattttaaatgttaaaaaaggcaattaaaacaaatattacaaaaaaacgaatacatttattgcattttaataatattaaataaaaaatataaattgaaataaaagatgtgcctattattgaatcgttggcattgtgccaatgccaacaattcatggaaagctttaaagctgaatgaaggacatcttaactcttttgtacttttcttgacccatt

SEQ ID NO: 28377 - DNA, 1483 bp, Heterodera glycines
  misc_feature (1284)..(1284): n is a, c, g, or t
cgaagcaccgtaatttgaggacaaacagtcgaaatgaatgaatgggccaaatgaatgaattgagtgaattggacgaatgaattaataatttacggtccgtcccatcgccgaccgatgaatcaaaagccatggattgcctttgactgtaaaacgggagaagcaatgtgatggtcaacagaccaaaaaggggtaaaaaggagaagcatttggcactgtccgtgccgaacttcgaattcgtcactctttctctgatttttgctgaatgccttttggtgtcgtcatccatcggcttacctccgccattaaatttggcttttcctccgccattaaatttggcttttcctccgccattaaatttggcttttcctccgccattaaatttggcttttcctccgtccattcgttcgttcaattggctgaccaatgagtttctctctgatgaggcgacagatcatcccttcccatcatttgtgtatgttttcgacagatttgttgcacaaaaatgggaggagaggacaaatgacgcggtcgagagcattgggcgatcggtgtcatggagggattgcaccacaaatgccccaattcgcgccaggacaccccaaaatcccaacaaatccctcccctcagcgaaggccatctcaacagcttaaaaaatgctgcagcaaatgcataactttgaattgtattccgtcccattgtttgggtgaccaattaattaattgaccttttttttgttaatcgatgataacaattaggacaccctttagagcagagatcgcatcaaaaattttccaaaataagcatatcactgatcagagaccaaaaataatatttttggagcattaaatgcggtgattataaataatttgtaaattattcgattaaaccaatttaattttgatttaaaatttaaacttttggaccgacggtgtcgaaagacgccgcagggaagatttttgaaattaatgcgatttgttaacaggttttcaataaaattggcaattttaaaattaagtaaaattaatatttttttaaattatttttataccaaaaccgaagaaatatgtataataagcacgaatattccaacatggatccaggtcaaggtttttttttcaaaatgtaagctctacaaagaaatacacccccccccctctccctaaggattgattttaaacgtatgaacttttctaaatcaattttatttatttattaattctgcatctcccgtagttttataatatttgtgtgtgtattttgcattttgtgatttttaaaatgcanatattaagggtttttgtttaatatacaaatgattgtcctaatgtttgcaattaacaattaacaacaaattgctcacttccgaatttgacttggcattttgtgcagcgaaagcgccgaaagtgcgtttgcatgcgatggcggctgagggaggacgaatgacagaactgtttgagacaatgggagcagcgaaaagtgcctg

SEQ ID NO: 28378 - DNA, 1143 bp, Heterodera glycines
gatttcaaaattttcaattttttttagtttaatccattcaaaacggttcaaaattcaataaaaaaaaccttcccggggggaaaaatggggtttgaaaagttttttggggaaaaaaagactttacaaaataatacccctgggagaagggagtgggaaacatgatttcaaaattttcaattttttttagtttaatttactcaaaccggttcagaattcaataaaaataacattcccggtgcgaaaaatggggtttgacaagtttattggggaaaaaaagactttacaaaataatacccctgggagaagggagtgggaaacatgatttcaaaattttcaattttttttagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaaaaaaattttaaaaattttttaattgctttttaaatatgccagact

SEQ ID NO: 28379 - DNA, 997 bp, Heterodera glycines
agtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtcccaccgaaccgatgcgcccagatttatggggagaccgaatccttccgaatagctccctatagcctgtactttaatctgcgtggattttgctcccataattgttgagtaccccaacggacactgaaaaatcgattttttgttttcgggcagtcccccgaacgatg

SEQ ID NO: 28380 - DNA, 688 bp, Heterodera glycines
taataagtaaatttaaaatatgtcaaatttaattgacctttttggcgtttgaatgctgagagcaattcacaattttcaatgaatccctatcattattacatattatgtgttgattttgtaaatggtgtcctctttttacgatattttctactatttttttcaataaaaaaccgattttaccatttttctttaaatcatggattcaaaaatatttctgggcaaaaaagaaattggtgtatagagtttctttcgtacgtgtcccaccgctggttgccggtcccgcgaccgtgcgtgtgcgcatgggcaagtgggggatagcgaagcaagctcggccgcggggtccacggcgaaataaaaggaaacggggccggcgagcaaccgcacaacgacaatgccgagcgtatttgctatataggatttaaaaattgtgtttgatttttcgctggggtgtaaaaagagcgagggatgggtgacagaggagcgtactacccatgcactatttcacctagtgctatcgtttcttttcttctttctttttttggaaaatgatcgctccacgtggcaagatgtcaaaggagcaaatagtaaaacgggattaggtttggagaattatttgaatttgttttttccggacaatatttggcaagatcccgcgattttttgaatttcatgtgttggagatgttggg

SEQ ID NO: 28381 - DNA, 1476 bp, Heterodera glycines
tgagacgccatgctgattgtgtaaatcataataaaaaggcccctatgtataattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaattcagcctcttttaaatcttaattttctgaaacccgaatttagaaaatatgaatgtatttctgcgacgccttctatacttaattcatccataatgggccaaaaatcataggttaagaccaaaagagggattttagtttcagccggaatttctataaaaatgttcgtgtgtaacctatctttatctattcggataagtaagaaattgaaatattcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtacaattctgcctttcctataagtgatgggatgcactggttgatccaatcaattaatttaatattttatttgggatggggcgacaaaggacacaaagtggaaaatttggtagatttctgatcacaattgatcaatatccgcgatgcttcgaatgcccgagttgtgatgtattcagagcgagttgttgtccggcttgatgagtgaagagaaccgatgggctagcagagtgaattggttgaagcatacctaaactgaaaacccttcccctttttataccaaaaatttttggttatttaatagcattcaaaatttacacattatcattttatggttttttcatttctaaattattttttatcgttttatttttttctccccttttatttaagaaaggaaaacttttcataaacaattttaattgcttttacgttcaaccgttttattgtggaataaatttatttattatttggggcgttttattagattattttttagtttttattgcgagaagcattcgcttcgttttttatgaattcattttgttttatttatttattttagtttacttttattttatattcatttattaatttaattttattttaaaataaaaaattttatgaaatgtttattttattttggatttatttttattaattattttgtatttttcagataaaattcttattattttaatttggttttgtttttattaatagttttatattttttcggatttaatccgacaataat

SEQ ID NO: 28382 - DNA, 842 bp, Heterodera glycines
ttaaagcagggttcctatcgaaaatttttcaaaatcagaatatcggccttcaaaaatcagattttggggtcgaaaatcagaacattttgcgaaattgcttcaaaacagttgtttttacattctattaaatcaaaaacgtactagttattatatttttcaactcccataatcgattttaacaacatgggaggaaataagcaaatcgtaatttttttagtgcattcgggatcaaaaaaccagatttttacaatttttttgtgacacatttttccaaaaaacttttggtggaggggagagggtccggcgccgccgggaaaaattttgtagttttaatgcgatttgctaacagatttttgtccaaaaaatgaccaaattttccgcaaatcttatgtttccttgataaatagtgaacattctgccataaaatttaaaaattatgagtttatttaagaaatcagaacaaattttggtcgctacctcaaaatcagaacatttctgataaatcagaacagatagaaaccctgggttaaagcaagagaaaatgtcgagacggccaaaaaaaaatttcgggtggccattctattcataattgaaaggataagcaattaaccacacaaaaagcagcgaaaaaacaagatgaagctcataaaaaagtttactagagaaaaggagaaaagttctgtaattgatctatataaccaaaatatatcacccaactgatcatacaattttatgtttgaaatggaaaaacattttaaagagtgcgactttatgtagcgatttttttaaggatttgttgaataaaatattttattttttacaccaagtcaaattttataaaa

SEQ ID NO: 28383 - DNA, 1160 bp, Heterodera glycines
attctgtgtcttccctgtacaccattcgttgtctcccccgccagggctttcatttttcggtctcctttttggcgaactcctgaagagagaatgggcgttcgttcgttctttgctttttgctttggtttccccattttctcatttcatttttccttttcccccaattcattcgttatttttgttatttttatggtaattcttgagcatttaatcaattaattaattaattctcgttttgccctctctttgcaattctacaaaactttgaaaacaaattttgttgacgtttttaaccaaaaattgacgaaggaaagggcagaaaaaggtggcagcggagacgaaagagtcagaataaatcgctgacgaagtttgaaacattaattattttcccatttgctatgacacagccctatggaacaaaaattcggggacaattttaaaaaaagtcccaaaaataattcacaaaaatatataaaataaaaaatataaaattattggtactttcctgttttgaaggtacaccctttttaaaaaaaactgcaacaaagagcgttcaatattaatagacttcttttggaggcataaaagcaacaatttctgccaaaaatttcctcaaatgcatcgacgttacgtcgcttacagtcctcgggccaaagaaactcgcataaatacgaatacaacatttttttaatggtgtgccttcaaaacaggaaagtaccccgacttttgcgcctcgacacttgcgccgccctaaaaaatccaaaaagttttatctaaactaaattcagcatgtattaatgtggcttatatccttggcaccaaatctgcctttgctgctgagtagggcattgacaaaaaccaaaaaataaggtgtctatcgttgtaatttttttttgaatttcttttaattgcttttttgttggtaaacagcagtttgagtaaaatttgatggaaattgctaaaatattttaaaatatatttttgagtgagtgacgcaaatgtccacttttgctggtcgaggcgcaattctccgcggcgcaaaattaattgtaagacaagcacattttatcacatctttagtgattagcaatattcaaacattaataaaatacagtatccgagttcatttgttaatttatgggtacggtattcacacggat

SEQ ID NO: 28384 - DNA, 908 bp, Heterodera glycines
ataaattaaataataaatttaattaaagttaactcatttttcatcgcaaatttcattaaaaatttgtgaaattttcccggcggcgcctatcggcaccgccggataggcttttacttaataatcctgtagaaattgagtcaaaaactgcgtcatttggtcaattttagacaaaatctgttaacaaaccgcattaaatttcataaaatttcgcaccaggtatggcacggaaagacttccgatttccgacatttttggggtcggaattccgacttccgaaatttttgatgaaaagtcggaaatttttttaatttttttttcaaaaaactagtaagttttgtacaatttctgttaataaattgaactgaaatttttaaaaatttccgcggcgcctatcggcaccgccgtaccctcctccacgttcccaaaaagtttttgaaaaaatcgcgctgtaaaaaacgtgtaaatagttgatttccgatcaactttttaccgtcggatccaatcgaaaaatcttagtcgacccatcagccccttttaatgcatcccgccagcccctaaaaattcatttttcagcatttttttatttttggaaattttttgaatttaattgaaatttttcgaattttcaaaaatcccgcaatcccgcacgggatcccgcaaattttaaatgcgggatttgcgggattaatcccgcgggatcccgtcccgcaaaaaaatttgagttccagtcccgcagcgggatccgcaaaatttgaaatttccggtctctactagaaatcactattttggcgcttcgtaacttaaaatagtgaaaattcactattttggcattttgtcattattttttagctatttccacatttttggaaatttcttaacaaaaatgcaataaaacccaaaaagcaccc

SEQ ID NO: 28385 - DNA, 1834 bp, Heterodera glycines
  misc_feature (984)..(984): n is a, c, g, or t
  misc_feature (1824)..(1824): n is a, c, g, or t
tgaaatcgaagcacgcaaagaatgcaaaaacaaagaattcctttaagaaatttgcaaaaaatgcgatttctacggctgtatggacgaggtggggagtcaacgaagtgtttgttgccgtgccggtcactcgtttcgttgctgttataatgagccggttcgtggtgttccaaattttgtgatttttaatcataaaaaaaaattagacacctccctctaagaatggaaaagttttctaaaattttcgacaaaaaaaatgaaaaatgtttactgtatttggctcccatttttgacgttttttttttaataatttttaattaactttttttctacatttttttgtttgtttgtctaaaagcccgagccaaactttataaatttttttcttacaaaagaaaaaaaatatttataaaaattcaaaataatttttaaatatttttaatagattttttgactagcatatttttgcgaaaattttgaatgaataacatttgttttcacttttcagccacgcattacaactactaccacggtaaagagctggaaatgttaattctttaattattgaaatgaatgactatggctaattgatagtaaattgttaaacaaaataatttcattttttcagacaacgttgttctcaaaattgttttcaactaaagaaataattgatactttaaattaaataaaaaattaatatttatctcaaattattaaaaaaaaaattattattattatttttattattttcaaattattaataaaattcttatttatttaaaattattaagttttaagattattcttttttaaattgaaatatccaattttcagacacttttgtccacagagacaacacaaacgaccaccacaatgtaaagagtttcgaaacatatccattagggatggcacggaatttcaattccgacttccgaagttattgataaaaagtcagaaatttttggaattttttttaatttttttttntaaattggcatttttgtacaatttcttaataaattgcactgaaattttcaaatttaatgacataaagattctgatcattaccattgaataacttttgaagcaaaaaaattgaaaacatttttgaaactttgcttttctcctttcacttttattttttggtttagaatttgaaaactcagcctattaaagatttagaaatttctattatatttttcaaaaatttccaatttccaaaaatttttggggccttggaatgccatacctgatatccatgtcagagaagcacttgttggattatgatttttatttttaagcacacctccacctccatcttccattggactgccactgtgggaatgcgtgctgaaaaacgcttgcgacccgtttggatttgttttttaaaaatatttttacagaatgtcaggggtcgaaaatttacaaaatttaaaatattatggtttattttcgacgaatgaaagcaccaaaaacttttttcccacaataatttttttttttgtgtttgtaatgtttttgattatgacacaaaagtgaatttgttgaatttttaaaatttttagcaaatattttgtttttaaaattgagtaaaaagcatcaaatttttgttttttgttgaaaattatacattcgtagtaaaaactcaattgttagatatatttataaaaatatttttaatattggcataaataagaatttaattcaaaaataggggatttttttttattactataaaaaagttttaaaaaggtaaaaaaaatttttttgcgcatcattagttttataataaaatttgtttctaattctcaaattcatttttctcantaataatagg

SEQ ID NO: 28386 - DNA, 1823 bp, Heterodera glycines
ttgttatcgttctaaaattgataaaatcaagcaaaattctttaaaactcattgaaacacgaaagaaaattacattacataaaagtgaattttaacaattttgtttttgactttttgttcgagtccgggattcgaaacaggccaagttgaatgccagatttacgacacgacctcgaaacccccctacaaacatatttcacgattttttaaaacgaaaattttctgccaaaaaagggggagggtatcatcaatcatcaccaactcaacgtttatcctgtcctttttccagcttgctcggctttgtgttcatcgccacgatggtgttgatgatgctcggttttctgctcgtcctttggtcttccttcagctacagtcgccctttgtaagttcttaccgttcgctttctctgctcgaccattgccatcctttctttgtcaggcacattgtctacgcttgtctcggggctttgctctttatggtttacttggccatcgacattcaggcatttttgtattgaatttttgtggaacatttttgctttaaaagatgattatgggtggacgcaaatacgaaatttccccggaggaacacatttttgcggcgatcattcttttcatggacattgtccaaattttctggtttattttgtccatcttcggtgaccggtaacttttccacttttttcttatttaagagtttattaaggagctgagagaaaattgcgcaccgcgaatcgatgaaagaagggaaaatgagaagatattttgaacctgtgaaagtaaaactgtactgtaaatttcattattctcgatcttgatccatggattcttttttattaaaaaaccggtttattttagttttattttattctttaaattttataggctagcagaagagagactgtgcaaaagggtgtgaccagacaaatccctgggtggctgaatcccgttggccatgactttaattaaaataaattatgcaacggctaattgttgaaggaaattttactaatgattttcgaaaagaaaatgaatacaaatttcgcaaaaattaaatgaaattcaattctcaaaattcttaatataatcgaatttggtactttttaagtttaggggatacttttaacatacattttcaaatgcctataaatgtgttttagaaattagtgaaaataagttttaaagggtattgggggtcgctgatcacgaatccgggctcagatcagcgctaccgttcgctacatgagctgtacagggacaaagaattgataggcttacagtagcaataataccctcattggcaagatgccaatgaggatatcgttcatacaaattttctaattttatttttgttcgagtccgggtcaggggttcgaaattggcaaaaatggatgctgtattcgtgatcagcgacccaaaaaatcccttaaaacttattttcttttgacgccctttttcactcgtcctttcctttcctttttctacgagtgattgtctgctcaatcgattcttttctttgctttgcttcgcctgtattcattatttattccccacttcctttttcttactccgttttcaattaaatttattcacttcacttctttttgtttcttaagcaaaatcaatttgctgtattttacatatttcgtctaattttgaatttaaattatgaatcgcaacaaaattaattaggccatatatcatcaatttgacaaaaaatgcctaaggacaaaacgccaaaaaaccccgctaatttaaaaattttatcgagattttcccttgtaaaactgaagagccgatctcgagtaaaaacttagttccataa

SEQ ID NO: 28387 - DNA, 1026 bp, Heterodera glycines
  misc_feature (9)..(9): n is a, c, g, or t
  misc_feature (994)..(994): n is a, c, g, or t
tcttatttntgagaaattttatacgttacaaatgctctccagcatgataggaagtgcggtgcgcaatcgccatttagtttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaattgactatctcttcttttgagaaattttatacgttacaaaagcgctcgagcgtgagaggggagggcgggtgcgcatcgccatttaatttctcagagaatttttaatttatcttatatccnagaaaatgactatctcttattttgagaaattt

SEQ ID NO: 28388 - DNA, 934 bp, Heterodera glycines
ttaatcaatgggaaggctctgattggttttttcgatttttttaaaaaaattttaatcctaaacccctttaaaattataccctgttccagggatggtcttaacaattagggttaattggtttttttaggcttgggctgcactttttccagccaggcccatttttctcgtttgtttttcctacgaaatttactttgggcgcggtgtcggcgatgccaactccaacacggcgttccattcccggcgccattcctcctccgacagcaccaaacccgacgccaaattgttcttggactcgtgccaacgccaacgccggtagatggcatgttttcggctcccgaatttcagcacatcgtgcagcgtgttgcgccagttcagctgccggtcgtggacaccccaaatgccttaatttggttgaacataatgccaatgccaaattaaaaaaggaattaaaatatttggaaaatttcttggcagttttgtcaataaatgtgatttgataatgcaaaattgaacaggaaatttcccagttttgacaaaaaatttatcctttttaggaatagccatgaaaatctttgaaacttactgaattttataacctaagtttaagaaaaaaaagcctagacttaggtctggaggtttcatgtttgaactgggtccaaatttttgggcaaaaaaccaaaaaaatcggggaaaatccatccaggtctgggtcgaatactctattttccctccccatttttggtgccggtccaccaaccaagcgacgcggcatggagcagacaattgccatcgccggttgtcaccaggggccacagccgttggttgctgtcatgttgacaccaccaattcaaatgtcctgcaaaaaggggaaattgagggattcggatgtaaaaagaggcaaaaatgggggaaaatcaaaaaataattggtaaag

SEQ ID NO: 28389 - DNA, 1478 bp, Heterodera glycines
  misc_feature (1144)..(1144): n is a, c, g, or t
attctccgactcttttgcccgtgcccaaattgcatttttcctgggcccatgggcttaatagtaaatccctttttaatttgttttgtctctttcagcggacgaagagttcgacgaaaatgggcgtgagacgcgggaaaggatagggacaattccgaacatcatttgcatgctaaggtttgtgacttggcttcatccattcattcaacattgcttttttggggaaaaaaaacaaatttttgaaaattgaggggttgaaaaaaatgcaaaaatttagtgtattttttctgataaaccagtgaccagaaaagttcagaaggcagcttattcatatcatatggtttagccatattttatcaagatcttttttcaattttgcatgctagtaaaaaaaagaaatggccaaaaaatgttttaaagttttttttgcaactttacgaagttttttttttgaaaatttcagtcaaataaaagcaaacttttaaggctatcaaatgatatccccacctaaaactgaatttgtcccttcgtttctaaaaaaattcccttaatacggtttttttctcactaattttcccattttttcgtccattttcagaatggcttccactccgttgctcggctatttggtggtccacgagcagtatttgccgggttgcattctctttgtgctcatcgctttcaccgacattgtgcgttacattttttagggtttggtgggggtcggtcctaaggacggacgatcgtttttgagggaggcaggtctccgccgattgggcgacgccgtttgggcgccgccgattgggcgcgggtacgattgggcgccgccgtttgggcgccatgcggcagccaaatttttcgttttcatattatccaaaaactgaaattactacaaaaatttctagccattcacctgaattacgagaaacagcactcaaaaaacgtaatgtttatggggttaaaatctatttgagtcacaaaattccttcatgactctttttttaatggcatgggttctcgaaattatgccctgtaacttaaaatttgaagctgtccttgaatttaatgtccttgaaaaagaattcgagaaaaacaattattttatataatgtttttaatcatctacattcttttgaatagattttgngacaacaaaggttgatttgatgaaaaataaattttcgtcttttatttgaattccgggccggggaatcgaaattggtcaaaatagatgtcagatttgtgatcagcgacctgaaaaccccctaaaaatgtttttaaaaataatttttttatgggttggaaaagtggatacataagtaccctgaaatcttttcaaaaaatttttcctggtgatcgggaaaccgccggaaaccattgttcccaaaaagttttttgaaaaaaacatacggcaaaaaagggcccatggcgggaaaagaggaaattgaaggacaaaaaagtccttggaaatttttaaaccc

SEQ ID NO: 28390 - DNA, 1802 bp, Heterodera glycines
  misc_feature (1034)..(1034): n is a, c, g, or t
tgcattttcagggccccggagagaataaattacaaaaaacacagaataaattaattgatgcaaacaaaaggatttatttatttgcaaaataaagtaaaaatttaaaaaaaaatagaaaacaataaataaaatctggtactaattgaatgtactttacaaattttagaaagaaagtcaaatgaaaatattatcaaatattgcagaaaataattgttttattggaacggcatcattcaattggatgccgtgaaaatctacctaattttaaattttattctaacaaatccttccataaaattaaatgtatataaaatttatttataaaattaaaataaataaaactaactatgacaaaaatatcgctttgaaaaataaaatattcactcaatataaccgtaataaacaatgatgtattaatttacggattattgggggaacaaatcgcaagcaaattgctcgcgaaatgatgagtagcccaaaatttttcaaaatcagctctaatttatgtttgtactttcttgtatatatttctttaatttttatttttaaacgtaggaacaaaaaaatcaatgcaaaactacgcacaaaattcgtccctgggggcaccgccttccatcgattttcgttgctcattctccattttttggttggttggcaaatggaaaaagaattgttgtcatcctccgtttttcatcataatttaacatagagttgagtgggaccgggaccaaaacacgggcaactgagtaccaaggtcctggttttgaccagttttgaccgggaccgggaaattcccgtttttcccggttttttggcctttcagtcccaacgaaaaagtaatttgattaaaaaatgatcaaagctctttttacgctcgatcccggccctagaagcgcttggtgcgttagattaaaaccttaattttatgctatttccagaaatattagaattaaagtaaataaaaagaatcccgattaaaaagatgcggtaatttagataattaattatattttaaatctgttgtaaattatttntaatgaatttgctaaaataaaaataaaattataaataaaggaaaataaatgcaataaactaaaattttattgctgaagttaattgtttgctaaagttttacaaaagttatgaaaattttatttatctttttttaattgactaatttgagatcagagaaaccgtcgcattaatcaaaaaaataaaaaataaattttcaaattatatagcataaatcttataaaaatattcatttaatacaaattttataatcaaataaaagagaaaaagcaaataattagattatatgattttttaaaaatctttaattttattttgactgaatattactgattaaatacaattttttaaaaaatcaaaaatctttgatgttctaagcttcaatcgaaggcatatgagcaagtgaattaaaaaaaataaaacaatataaaatgaatttgaataatatttacgaaaaaatattcttaaaggcaccacctttaatttattatcattgtcaaatactttttcggtgcactaaaaataaaaagtcgagacaatggctataaaatcttcggccaatcgcttaattttgttacggcaacctttaatcgggaaccaaaaataatgactgataaataaatggaataaatttatctaataagaatatatgatttacaaattttataaatatgtaaatccattttatttttactactgcattaattctctcgaactatactaaaacaacgggaaattaagattaaataaataaatattcaaagataaat

SEQ ID NO: 28391 - DNA, 1340 bp, Heterodera glycines
agcacatgggtgagtactcgatttccgctttccattccctgacgtccaatggcggagccaatttgctttccaatcggcagcaaatatctcataagacttctgaacactgcgccaactcccgctccacgctgatagggcaacccccgataaatgttgtatccaccaaattgcacacactcggacgagaatgtggaccaatccacttgtagaggatcaaaatcaacatgcatctttaattgatactttcgctgttttgttattatttatattctttgaaaattatgctttttataaaattgtttacaagcttatcaggttgcagctttccaaagtgtaaaaagctgacaattttttcaaaggtcattccaacacatcgacagtacaaaaagaaaatgacatgtcgaccacacgcacttgagttgggagactgaagtggaagagagctatattcaatttgtttgtagcgtgacaaatggtcaacaatgtgaaaactgggcggtgtccatatccccaatgagtcataatactccaaatgcaaaggagaagcgcaataaatgcacacccaatgagaaccatgagatgtgctggggtcaagattcaccaccatacagtgtggaaatttggcaattgccccggctggtatttggtctgccgcaaaacagccaatatagtagtggcgagtcacgttgtttcttgtcaatgttttgtcaatttccaacgtgttcatcatttaaaaataggacatttttctaaagtgtaatgttaatgtacatgttccgtattggaatggcatcaagatgccgctattggtacggatctcaatcagaatttcagaaacctcttttgataagagcttgtgatactgtatggcaaaaaattgttcttcaactacttggtctgggtttccgcgtatggtcactatgcgcaacactggggccgtcacatctccaatcatcattggttcaataagatccggcgtgtaaacgtggaatgatgacacaccaccactcatgtccggcgaaaaccttgcctcctttgcgggctgcataaactccgtgttgttgaaaccgagaatgtaggcaagttgaggcgagacttcgacctttttaacgtaccgtgggtcggtgttcagaacaaagcgatttctatggacgtcatagttaaattggcaaacaagacgtatctcacggtacgcctgaatccatgcttccctttccatttcctttgtggcttcgaagatcgtacgttcctcttctgtcaaatttttgatttcggcggtcaattttgtcatgcccaattcatccagaacggtcaaatttttgtcacttaattttgaaaag

SEQ ID NO: 28392 - DNA, 971 bp, Heterodera glycines
agggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaacccaaaagtccataatatctttcccataggctggaaag

SEQ ID NO: 28393 - DNA, 1152 bp, Heterodera glycines
  misc_feature (19)..(19): n is a, c, g, or t
  misc_feature (1115)..(1115): n is a, c, g, or t
ttttatcaattaattaacntggattttgaccaaaaaatgaccaaatgtcacaccttttgactcaattctacaggattaatgtcgatccaatggtgtcgataggcgggaaatttttttgcaaattctaggtgaaatttgagataaaaattgaatttattttgattgattttattataaatttattcaaaaattttggcattccgtcttttaaattttcaaagaatgtaatgcggatcctgccggatcccgcacaaaaatcaaattttcggatcctgttgcaggattggaattcaaaattttttgccggacctgatccggccggattaatcctgcaaatcctgcattttccaaaaaatgcaggattgcggactgggatcctgcaaaatcctgcgcaggatccggtcctgctccgggctctagtttttattgcatttaataatttacaaaacgccaaaatagtttattttaggttctaaaaacaaagaaaatagttgctaacaaatagagaccgcattttgaggcatatgcctttttttctgcgcacagtttcgatatattaagccggaacgggacgattcggtgccgccgattcggtgccaggatgggttcactgccagtacttttctgcaccaatttgggttgaagtgtcaacgttgacatgaaatgacgaacgtgccatctgcgaaaacatcagtcatttgtgccgcccattcactgtgtgacgctctcccaaaaataagaatcctataaaatggaaagcacgtcttcagagaaaatagttaaattttaccggtgaatttgaccgttttctgcatatagtccggaatcagccacaaaaaattttctgtgatattttctgatcgctcgtattgactgtaggccagaggaatttggagctctgcgatgctagtcgggactgccaaaagcacattttcagcctgtctcgcgcgcttcacaacctatgaatttttttatgctatgcaaatcgaaataagaaaaaaactttatttgttgcgtctttatccggaaaccgagccaaaactggagtaggaacattgtcaagtgttatagaccgtaacacagaatggctctccatcgtttcatgcgcacgtttnttcagcgatgtcgtaagtgttgaaactttgatgtttt

SEQ ID NO: 28394 - DNA, 2326 bp, Heterodera glycines
  misc_feature (697)..(697): n is a, c, g, or t
  misc_feature (1656)..(1656): n is a, c, g, or t
  misc_feature (1658)..(1658): n is a, c, g, or t
  misc_feature (1667)..(1667): n is a, c, g, or t
  misc_feature (1669)..(1669): n is a, c, g, or t
  misc_feature (1673)..(1674): n is a, c, g, or t
  misc_feature (1677)..(1677): n is a, c, g, or t
  misc_feature (1691)..(1691): n is a, c, g, or t
  misc_feature (1694)..(1694): n is a, c, g, or t
  misc_feature (1712)..(1712): n is a, c, g, or t
  misc_feature (1714)..(1714): n is a, c, g, or t
  misc_feature (1723)..(1724): n is a, c, g, or t
  misc_feature (1744)..(1744): n is a, c, g, or t
  misc_feature (1753)..(1753): n is a, c, g, or t
  misc_feature (1778)..(1778): n is a, c, g, or t
  misc_feature (1781)..(1781): n is a, c, g, or t
  misc_feature (1788)..(1788): n is a, c, g, or t
  misc_feature (1792)..(1792): n is a, c, g, or t
  misc_feature (1815)..(1815): n is a, c, g, or t
  misc_feature (1822)..(1822): n is a, c, g, or t
  misc_feature (1829)..(1829): n is a, c, g, or t
  misc_feature (1832)..(1832): n is a, c, g, or t
  misc_feature (1838)..(1838): n is a, c, g, or t
  misc_feature (1846)..(1847): n is a, c, g, or t
  misc_feature (1852)..(1852): n is a, c, g, or t
  misc_feature (1867)..(1867): n is a, c, g, or t
  misc_feature (1881)..(1882): n is a, c, g, or t
  misc_feature (1890)..(1891): n is a, c, g, or t
  misc_feature (1893)..(1894): n is a, c, g, or t
  misc_feature (1941)..(1941): n is a, c, g, or t
  misc_feature (1972)..(1972): n is a, c, g, or t
  misc_feature (1980)..(1980): n is a, c, g, or t
  misc_feature (1982)..(1982): n is a, c, g, or t
  misc_feature (1997)..(1997): n is a, c, g, or t
  misc_feature (2047)..(2048): n is a, c, g, or t
  misc_feature (2052)..(2052): n is a, c, g, or t
  misc_feature (2089)..(2089): n is a, c, g, or t
  misc_feature (2139)..(2139): n is a, c, g, or t
  misc_feature (2149)..(2149): n is a, c, g, or t
  misc_feature (2168)..(2168): n is a, c, g, or t
  misc_feature (2170)..(2170): n is a, c, g, or t
  misc_feature (2188)..(2188): n is a, c, g, or t
  misc_feature (2195)..(2195): n is a, c, g, or t
  misc_feature (2202)..(2202): n is a, c, g, or t
  misc_feature (2208)..(2208): n is a, c, g, or t
  misc_feature (2228)..(2230): n is a, c, g, or t
  misc_feature (2233)..(2233): n is a, c, g, or t
  misc_feature (2237)..(2237): n is a, c, g, or t
  misc_feature (2255)..(2256): n is a, c, g, or t
  misc_feature (2260)..(2261): n is a, c, g, or t
  misc_feature (2263)..(2264): n is a, c, g, or t
  misc_feature (2266)..(2270): n is a, c, g, or t
  misc_feature (2273)..(2274): n is a, c, g, or t
  misc_feature (2278)..(2278): n is a, c, g, or t
  misc_feature (2281)..(2282): n is a, c, g, or t
acctcctcagaaaaggggggataattagagactggccgtttagtgtagagggattatttttcaaaacacctcgtagactgtgggataattggagactgcgggattaatagagactgggctataattagagcatatacggtaatttgtaaaaaacgtaaaactattttatccttcttttgtaaaaaaacctaaattttgcatttaacttttataaatgtttatattaattttgattatatgaaattaaaaaattaattaattaaattatttataaaatcaggccgaatttctgacacatttgccaatggagaacacggaacaggccaaggtggcggcactccgaatattggagatgggcccacgggtggcaattgtcacgttggggccacggggtgacaaaaatacatataaatattttaatttttaatataattaaaatatttttataaattttaaataggcgcaattgtggcacgacgcgaacacaacaatgggcatgtaaaaattggtgaagtttcggcgccgaaagtcactgctgtggacacaacggtagaaaaaattattatttttattattattattattaatattttaatgcgaattattttcatttacaaatttaaataatgttcaatttaataaattaaagaaaattagcatttttaaattgaataaaatttgcttataaatttactanataatttgttaaattttctaaattggtttaaatatacaacatacaaataaaataattagaaatttattattgaaaagaaataatttttatttaaaaattaattctaacttttgcatatttaaattagattaagaataaagaataaataatttacaaatatatttaaatagattttttaataaataaaaaataataataatttttaaataaatttaattctaaaataaatttaattttccaaagggtgccggcgactgtttctgtggtgcgttggcccactttttggtggcccaaccgtccgctgaactgcttgaagaccacgtgcgtcgggctgtccaaattgcggcactttctgtccagaaaaagggcacccaggccagctaccccacacgggacgagttgatcacaatgggaatactgcaggattagagaaagagagaaaagcaaaaaacaaaaacaatcgatcatgacaattctaccgtattaaatttgtgtgtttctaccgtattcattcattttcctgtgtttctaccttattcaatttgtgtaacctaaggcctcgtgtacatagcccgagggcatggcaacccgagggtggcactgaaatgttttgaaaatttttaaaaccaaatttatttgaattttcctgacggcaacgatggacacacccaattaaatcaacaatttttgctaaactcatttcaaaaatgcaccgatttgatccaattttgttatcatatttttggttgataaatcgaaatttcaaaaaatttatcccaacgattttcaataaaatttctctgacaacgcctacccgtgacctttaccacattttttttttaaattgctccctggacttctaccataacttgtttttttttatttgtatttatttataccataaaattatataaaattatttggcagcgccatttttgtaatgcttcaaattcattttnanaatttctcnanaacnnttnaacaacaattcttnaanttaacctcaattaaattnanaattttcannaaaaaaaaaactaatttctnctctcttantaattaatatttttaattattccanaanctaattnttantccaaatacatcatcatcttatnctaaatnttttctnctnatcttnccttttcnnttttntttcaatcaattttnttattttcaactcnntccaatcnnanncatattcattaaataaatttcaatttttctaaaataaaattatttcnaaatttttattttatttattttttttttctnattcattncnatttattccattaantacaaacaatttttttaaaacattttccatataattatataaattaaaanncatntttaatcatcctcatcatataattactcttcactatnattatcataaattcaatttatataatcatcataatttaatcctccacctnccccattttntctaattccacctaattantnatcaaaaaatacccaccnccacccnatactcnatcacnctcaaactcattcaaaattnnntcntttntcaaaacatctcaaaacnnttcnncnncnnnnnatnnaatnatnnttccccaggtaaatttttttcctgatttatggccaaaaaacggt

SEQ ID NO: 28395 - DNA, 738 bp, Heterodera glycines
tggcctggacctggacctggatccagaaaaaatccaggcctgaatccaggtccaggccgatctctaataattatttttaactatcttaaaatggtgacgtatttcgttgctttttattttagttttttaatttattttttaattatttctttagaattgcatttatggaacaacggaaggcagccgaaactgaagacattccatcgacgaggccaaaagaggcggaagtgtcgccgccgcggactccgttgggcattccgccggcatttgtcaaacggtcggtcattttcattggcattttggagtcaaaagagacaaaattgggcaaaactaagggccaataatgaccggtggaatgaattattaatggttggcccaccaattccctcctttcatccgtttggtcatccctcgtgccaatccctccccaatattcttttgtcttcatttttatttttaatcccatttccaaattggcccatctccccccccccccgcccccttttgcctcgccctttcccttccctcccatcggaaacatttcatttctctcccccaattaattgctctttccccgaatttcgcattgagaagcgtgaaaaggggcaatttgcgtggcatgctgttgaagtcactaccaaagatgaaatgctttatgaatcgacagggaaaggaattttgagtaaatgacgaaaaagggggagagattttgaaaaggcgggggggggggaggggagg

SEQ ID NO: 28396 - DNA, 1943 bp, Heterodera glycines
  misc_feature (53)..(53): n is a, c, g, or t
atgagcggcatcgtaaaatggcattgagggatttagaaattaaaatttttcanaatttcgatataattatgtatgtctaaagaaattttatttggataaagagaaaccaggtaatcctacatttgcatttaaaagttaagtagtaaagtgtcaaaaaatttttggcatggtaaggcaaataaattagcttaaaaaatttatttagaattttcaagaatctcccagtggtaaaaaattctacttttatgtatgattcttgtcactattaagtctcttaggcacaaaaaagcaacgaaacataagcaataggcacaataattatcaaataataattaagaaaaaggatgaatttatttttagattaaaccaagatttcttttttaccaaaagcatataaaagccgattttttatggtatcattagttagcatgcagacaaaataatttaggatttaaaaaattattcaaaaagggtaaaaaattctttttaaaagtttcacatttaattgtttttttctgaataaaaaagattaaatattttatttattataatttttaaataaaataataacaattatacattatcttcaataatttaatattgtttttccaaaaaggcaaaaatatttatgaagatcggaaaattattaaaattttagttgaaattgttaacagattttgtcaaaaattggtatttttggcagaaatctttcattcttaaaggtgcactttttcagggtgcatttttcagtttttccgttctgttaaggaatttttataaacatccaggaaaatccaaaaatggcataataagaattatgataaatgtcgtaaagtaaattgtaaaatttaaaaaatagctgagaaattaacagaaaggataaaatttaagattcatatatctcaaatgatttttttgttgtaaaaaatggaatttaaaagaataattatgtaaaaaacgaaaataaatatattttttaaaattttttacttgctcaagaaagtctaattataataaaaacttctttgaaaatttagataaaaattaaattacgctaaaactgccaaatgaaagtttaagtgttcgtttatgaaaaatttagtaaaattaaaagcgtaacggcattaacaaaattccaaaaaaggctttagcttttccactgacaacaatgaatcgtgttgaatgaacagcagcagcaccgaaaagcacttcccctaacccactaacccaatcaaatcaaatcaaatggtcgaagcgacggacggacggatttccgtaaaaaattcacacacacaatttgttacaccaccgtcaccaccaccaccaaatggggggggggggggagttcgccgggggctgtcatcatccgccgatctgtccgtcccgtcccgtctcccccctccccgtgggggatggactcgtcagttttggtgtgattgggaaaaggttagtccctcatcactccagggatggaacttaccccccccccctccatcccatcggaagatggcggggcccaacaacaacgtgcggagggggggatgtcccggtaagtgcggatgataaaatggattcttctaggagggtggattattttgtacaaaacttatgttagaccgttattggaatatgctcctgaggtttggaatccatctcttctaaaaaacattaaaaaaattgaaaaaatgtcaaaaatatttcaccaaaagagttcttttcaaatgcagccttccacccattccataccaacaaagattagaataccttcaattgccgacacttgaaagcaggcgaaagctgtctgatctgttcatggctcataaaataatttatggccgaacagatctgaatcccctttgaaatacttaaaccttctgaacgctttaaacatttcccttttatagactttaactcgaaatataaatttaggcaaaaaaattata

SEQ ID NO: 28397 - DNA, 608 bp, Heterodera glycines
aagccttttggggctagttcaaaagtcgcatcagcgaccattatccgacaatttcttgctgcgtctaagttatgttctgcctgggtgataaccaacttttccccgccacgaataactgccctcgcaaccattggcttaatttttttttcttgtttttgaagtgctgaacattttgagcatgatatatatgtatctgcattgttttcattcattattcggtattttcgccaattgctcccatttccgattaaataaacagtatgtgttagatcacgggagagacacttttcaaatttcatttctaatatgtttgggctttcttcgtttgctgtgtcagaattagcactcttaattttacaaagatatagtttcaaactacgtaatgccaattgaatcccattttttgttagttcaacatgtaattctttaatagttttgattcgcttttctcggtaattttggagcagcttcattgcttcttgattttcaaggaagtcctcgaattttgactttatatttgacgtaaagtcaatgaagcagaggctaaaaaaaagtatcaaacgtagacttttccttctaaatattttaaaaatttaaaatttaaaaat

SEQ ID NO: 28398 - DNA, 885 bp, Heterodera glycines
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatgggtgcaaaaat

SEQ ID NO: 28399 - DNA, 1130 bp, Heterodera glycines
ttccactttctcttccgcttttctgttcctattacactttctcttccactttctgttcctcttccactttctcttccgctttctgttcctcttccactttctcttccgctttctgttcctcttccacgttctgttcctcttccactttctcttccgctttctgttcctcttccacgttctgttcctcttccactttctcttcactttctgttcctcttccactttctcttccactttctgttcctctcacactttcggttcctcttacactttctcttccacgttctgtttctcttccacgttctgttcctcttccactttctcttccactttctgttcctcttccactttctcttccgctttctgttcctcttccacgttctgtttctcttccactttctcttccactttctgttcctctcacactttcggttcctcttacagtttctcttccacgttctgtttctcttccacgttctgttcctcttccactttctcttccactttctgttcctctcacactttcggttcctcttccactttctcttccactttctgttcctctcacactttctgttcctcttacactttctcttccacgttctgtttctcttccgctttctgttcctcttccactttctcttccactttctgttcctctcacactttctgttcctcttacactttctcttccacgttctgtttctcttccacgttctgttcctcttccactttctcttccactttctgttcctcttccactttctcttccgctttctgttcctcttccactttctgtttctcttccactttctgtttctcttccactttctgtttctcttccactttctgttcctcttcttctcttccgctttctgttccttttcactttctcttccactttctgttcctcttccactttctgttcctcttcttctcttccgctttctgttcctcttccactttctgttccacttacactttctgttcctcttacactttctcttccacgttctgtttctcttccacgttctgttcctcttccactttcttttcctcttccactttctgttcctcttacactttctctaaaacaatctgttcctcttccactttctcttccactttct

SEQ ID NO: 28400 - DNA, 923 bp, Heterodera glycines
ctaaaaaaatttaaaaaaacttattttcacctattttggcgttttgcccaaaatttgttaacaaaaatgcaataaaaaagaaaaatacacccctaagaatcgaccagaaaattttcaaaaatgcgcccctaagaaatgaaaaatttctcaaaaatttatctccaaaatttatttattttattttcttgacgataatttttgattttgaaaattatgtatatccttaatgacttggcaaaatatttttgctttttgatgaaaattttcgattttacacccctaaattcggaactttttggcacctattttcccatttttagcacctattttgggggttttttagaacctaaaacctacttattttggcagtttttagcacctaaaaatcgaagccctagtcattaaatggagtttgaataagcaatcgtttccttgccttaagcaccgcagtgccgttgacactgccagccgcgttggtagcggtgcattggtaatagccttggtcgagcgcgtccaactcgaccattaccaatttcgatgacatttccctgtgccgaattcgaatccgccgactcttttccaccggcgcataattctttaaccatctgaaagagtgaaatgttaatttcgcattttccatgaaaagtcagcaggacgtgaattggacgggcagtggcgaagcggcgacttcgcaacgcatgcgaacttcgccgccgatggggcgagtggcattgctcggcggaacggtcagtcggatgtacggccgtttggcggacggagtgccatcggccattctgaaggcgtgcggttttagcaaaggtttggcatggatagtgagcattgaatgggaaaatgggacgcgacaaatgcccacaaaggcaaacatttgggcaaaaaaggggaaagggggggggggggggggg

SEQ ID NO: 28401 - DNA, 1726 bp, Heterodera glycines
  misc_feature (70)..(71): n is a, c, g, or t
  misc_feature (117)..(117): n is a, c, g, or t
  misc_feature (1636)..(1636): n is a, c, g, or t
  misc_feature (1697)..(1697): n is a, c, g, or t
gtaattataatttacaactagagacattagtaaagaataatgctaaataaacaaaaaaaaacactatttnntaaaggttaatggctgactcttcggtggctagaaataaaaaaaatntaatatttttcattaaatcgtcgtaaaacataatcgaaaataaaatagagcttttgctaattcgagaataatctttcgtaacctttttaactcaaaaatatttttcgaaaatgaatcaacaataaaaaaaataaaaatatattcattaaaaagttatataaaagattaattaattattttatctaattatcttaatccgaacaccggcatctcaattactccatgaattgcaaacattcttcaataaaagacatgttttgagaatttttctaatcgggaattgtaagaaaattgctttaatataataaaaaaataaaaaagaatttagtatttttgtatatgaatatccaaactcacaataatttaaaggtatgaaaaccgaaaaggctaaatattattcatttttaataaatatgttctgagttttataaaaacaacattcttgtcctaagaacaacattgtgtataaaaaatattataaaaataatataaaaaattatctaaaattcaaatacagataaataaaaaatattcggcagaaaatatttaaattaaaatatatttcccagaagaatcgaataatcttaataaataaagaagaggtgtcatttagttagaaataaacaaaatctaatcaaatgtcaaacatataaataaaagtttacagaaaagataataacaaattttagataacaattcttaaattcttcaataagtaaatctcaattaaagaaaatagaaataaaagcataatttaggtaaaattcaataggacaatgttttattttcctttgtttaaaggttatatacaaaacttttaaaggaattgttatcataaataattaaataaaacaaaaaaagattcaattaactaagcaaaatagaacaactaaagatattagaaaaattaaattaaaattatatgcatagagtttttaattaaaaaaaaaattgatatgaaatacaacaaaaaccaaataggcggtaaccatgtgatattattttttctcgaatttttttaaatgttataatttaatatatgaaatttaatgatgcaaaaataatatcactcaaaaaggcgaaaataaatatttaacagctaaaatttattgaaaaagagaaaattcagaataattaaaattgttttgttgattttaaaattattcgagttcgccaaaaaaaataattatgaaaacaaaagttcttttggcaagacaaaaccaaatgtaattcaaaactcaaaattttaaaaagttttaaaaattgatcattagggatatcaaaaatatgtatggtcaaaatatgtaattatgtactataaaaaaaatttcggaaatatgcacaaagaacccaaaatatgtaaataaaaattttttaatggttttttatttttttgaaaaatgaaataggcacaaaatgcgataaaatgagctaaataggcttagaaacacttaagtatttgaaaaattgttttctggttattttttattatttcacaagaaattttataaatttttanaatctacaaaatatgtaaaaactatgaaaatatgtaagaaaaaattttgccgaaattttgngtttttttttgagattttcaaaatttctg

SEQ ID NO: 28402 - DNA, 1014 bp, Heterodera glycines
tttaaaagtaaatatacaaaaaataaaaacggttcattttcagttaacgaaagtgatgcaattccgacgcccaaaaatttcggaaccaaaccctggtttacggtatacaaaatcttttgcacaatacggtagctcacaaatcagcagctttgttaccaagaaatgccccgaagcttaagagattgcccattttattttatattaaagttaaataaacaaggcaaaattttgtgttttaatgaaaagaatcatattatgtaaaataaataaaatttaaattgttttttgtattcgggtcggaatttgacatcatttaaatgctaaagtttaaaaattgtaaagttagcggaccgggaaccggacccaacctggaagaaagccagtaaaaaacgactaaagcttgttcttcccggatcggtccgggttcccgattagggacttttggtgcccaaatggggtccgctgggcctcccaaaatgatcgatcaaatttgataaatttttgaccggtcctgaggccgggcaaatcaccaaacaatttttcctagttaattcaaaccagtggaatcataatcccgtctcagattcccagaattccgcatttttaggagtccgaatccggaattttccgctcccactgattttacctcgggtgaaacttcaataatgaaataagaattttgcaaatttttttaggaatttccatcggaaaaactcaatttgtctaacaatatttaaaaaaaagatcaaatatttaaataaaaataataatttggttgatggtaaatttattaatcaatgtaattaataagtaagtttaattagggaaagggtcattttggcgcccacgttttggcgccaagccatatataccttaaaagggtaaaaaattttaccttccaatgggcttactctaattttcaaaaaaaaaaaaattcccaaccccataaatttttttatttgatttttcatataaattatatatatcattcgattcgtctcgatgagacaaatc

SEQ ID NO: 28403 - DNA, 1055 bp, Heterodera glycines
gcctcaagccccgctttttagaccaacaacaacacgccgagtacatgaggtgcaatgcgcgaaaaacgaccagcctgcttttgtaaagaatggtttagatcgttgattaaatcttaagcaattttgtaatttgaattgacatctttatttttattttttttgctttttaagaatgcggcacaaacgacagtcgctagccgacacgtttgtgtccgcttcccccattttttaacttttgttttgctgccccccattttgtttcgggtatttttattttgtgtgactttaataaaaaaaattgggaaaccccaatatttttgtgaaaacgggccgaaaagtgggctggaggaggggcacaacggggaaaattggccatcaaagcctattttggctgaaatctaaaaaaagatgtaaaaagggaaaacagttgctaaaatgtttgaaatttaggggtgtaaaataacaaaattttattcaaaaataccaaaatcatgccaaacataccatgtttattggtatggtcattgtttaaaagtttttctttcacaaattaggaacttgcataaatcaaaaactaaatcggtcattgaaatcaaaacttatgaattgttcataaactcaaatttattttaaaaaaattcttgaatttttgcttgggacggagttgaccctttttgtattgggacggagttggcgggacggagttggctcgggacggagttggcgggacggagttggcgggacggaagttgacccgcttcgctctctctctctctctcctctctctttctatttctctatctctccgttctctctctctctctgtttctttccctttccctctctcctagagaaagacaaaacaactttttcttaaggaaaatattgtttcatcggagatcaacatttaggttgatattaattattaacaatgttcattttgccaaacaatgtataaaacaacttatttttaaaatttcgttcaatttttacaattttattttagcgtgaaatatcatttggaggagagataacgcaaaaatgagagggtgctg

SEQ ID NO: 28404 - DNA, 1331 bp, Heterodera glycines
atattttcttgataaaatagtgacattctgccataaatttcaaaattatgaatatatttaagaaataagaacaatagcccgaaataaggacaaatcttacaaataaggacatttttattttgtaagatttggaccctccaaataaggacaaatcttataaataaggacagatccgagctctgatattttattataaatttgtaatgtaatcctatttaataaagttgagtgtctgtatccgccatgctttgaattggcgtggcgttttgtaattgttttgcgttataaatgaatttgaaaaaaagaaatgtttggttttcgtttttacatatttgttttgtcagtttttgatttttgcaaaagcacagttaaaaatttcttttttttttgtttcttatattcatagtttctattgttttgttattagcatatgaaaagtttttgtttctgtttatgtaaaagattaaggaaaagaacagcgtagctttttgttttagtttttctaattttcggatatgattgtatggttgttatttttagtcttcgtttgtttggttttttagttttgtattctttgcatgaaagaagaagttgatgttgttatttgtctatttacatgcattgttttctgttgttgtataatttttgtaatttagctattctgccgcttcggcaatattttttttttgtgatgactgcaggtcagccatcattcaacagcatgctcagactgagtctaaatgcttcatgaaagtttgctgggatgactttgtttgggattttttttggctttgctgtttctattaagaatatttaatttagaaaagaaatccaatagatgaagaaaggacttattgtatgaacgtgttggattacaattggatgtgatttcattgcgtagttttggaagccattgacttttttcttactctcgaggaatgcactatttcagctttggatggtcgatcatttgtaagtgggttgggaagcgttatgatcagaatttgtttaatattttagcgaattagtgtctgttctgtgactttagtgtgtcatgtctttgataaaacattagtgtttgttgtttgagtttagtgtgacacaattatgtgtgtcatgtctttgataaaacattagtgtttgttctatgactttagtgtgacacaattatgtgtgtcatgtttttgaaaaaacattagtgtttgttgtttgagtttagtgtgacacaattatgtgtgtcatgtctttgataaaacattagtgtttgttctatgactttagtgtgacaaaaaaatgtgtgtcatgttttgaaaaaacattagtgttttgtt

SEQ ID NO: 28405 - DNA, 408 bp, Heterodera glycines
gcattagagccaatggcatttgtagagatcgacctggacctggatccaggcctggatttttcctggacctggattttcctggatttttgtccaggaaatccaggtccaggtctaatgtgaaaaaaaaatccaggtccaggtccaggcaaaacacgaaaaaacctggattttcctggacaaaattttagaatttattttttcaagtgaccgatgttttttcaagttttaaaaacagattaaataaatttaaaaacacattattattattaattagatatttttagaggtttataagcaattgattttttcaaacctttttttgatttttaaaatgagtttcaaaaaatccaggtccaggcctggatccaggtcccgaggaacctggatttttcctggacctggattttc

SEQ ID NO: 28406 - DNA, 945 bp, Heterodera glycines
  misc_feature (29)..(29): n is a, c, g, or t
actttttgggtggatgttgtgtctttttntgggcccccaaatttggccactatttaattggtcctcccccaacccattgccctaattgggttttaattacattttattgtgttgtgttagctgttttggtgtggtgtagtcatttgatattttgccgattcttatgagtgggcgtcctctgctgctgtgatgtgattagtcattaacaatttatttggggaggtccgccgggagaaaacgaaacgctaaacaaacgcaaaaaaaaacatataaatctattgtatttaaattgaagaagaaacattttatttttattttgttaggttttctggggattaattaaacactaatcaggtgacaaattaaaccatccatcactaattgtagtttatataccaattaggcagtaattgtcctgcctgtactaattgagccaacacgcacactcatttgaagcagtatcttcgccaattatatattttgcctattttaattataaataattaaattgcaaagtttttttttaaattttgctaataatttaaccaattttctccaaaatttactcgcaaattttttgttttgtttttgctttagtttttattgcatattattaagaactgagcttttctttaatcaattaaatatttttcatttttaaattccttacatttttaaaaacatttgtttccctttttgaatataaaatttttcaatttttttgcgcttttaaaatttattttcaaaaaaaaaaggaatttcttcctgcgaaattaatctaaaaaaaattaaatccccctgccttctgggaatggcattagtgtgccgtggtcgtggtggggctgtctgataactcactcactcgcaatccccgcccttttctcctccccgcccctccggcggggttagtgtaattagcgtaaatgccctgcagcggatttaaaa

SEQ ID NO: 28407 - DNA, 1024 bp, Heterodera glycines
  misc_feature (92)..(92): n is a, c, g, or t
aaaaatgcattttgggatttatgaacaatggtttaataaccaattaatttccgaatacagtttgaaaactcagccatttgccggtccaaaanaattctattaatgaaataattgcggagggatttttttctaaaaaattaagctccgaactttatttatttattttcttgaaaagaatttttgattttaaaattatgtgtctcattcccattttagcacctattttgggggtttttataatcagggagcaaacaaacgttttttgctgtcttttttcaattttttgtgcctgtaatcccttaatttttatgcttttttccatgattttgccttttttgtgcttttttcatgcttattttgggaaaatttggtgctttttacagtgcttaatcggtgattttttgtgctgaaagagaagaaaattctaattttttggggtttccgtgtggtatcgagtatcgaagtcaaaatcggtatcgagtatatacatgaaataatgacaattctatgtaaatatttatgttatttcttttatttctattgttgtccaatttttcggtgtacttttttaaatcattttaaggccatttaaagtcataaattcaacagctctattgttatcagaatgctaatagagcatgttaaaagcttttaagtgaagccattttgttcaacttggcaatcaatcaacttaaaaatttgactggccagacagaattggccactccgccggcggaccagcgacagtttcgggggtcgactacccgacctattgggaatgtttttaaaaatatttaaaataatttattttttaacttatcgctgatgctaagccgctgaaagaagggaaacgttttgccaatttcgaacacaaacaacaaatccaaggccaaatacggtggcatcatagaaaagggccccgtctgacggataatttcgtaaaacatttccgaaggtgggctcggcatttgagtcttaaaaaaggaattcgtcatcattttttgtgattgatttaattaccgag

SEQ ID NO: 28408 - DNA, 1657 bp, Heterodera glycines
  misc_feature (1611)..(1611): n is a, c, g, or t
caaatttaagcaacgacatttgaccctcgccggggggccaaaatgtgtaaagttagaggggtggagggaggttggctgtgtttatgttgttttatgcttttggacggattaagaagcgggcaaaatcctcgtcttaaattccaaaagctttgagcagcggatatgcccgggccaaagtttaaaaacggagacaattcttatttaaattttgggaatttagttaataaaaattttacaaattaaaactcaaaaaataaagtaaaaaaagaatatttaaaattaaccaaatttttaattattaacccgaaaattttcttaaatttaattgcatcttatagataatccagcagtgtttttgcggataaagaaattttaaacatttttctttgattgttttgcggcataatggactgttataataattaattcgaaattaaaataggtatattaaataaaaaagcatcggtgatttttttttaatatattttcccacctgggactggaaattttacgatgctcattacatctggcagcgacaggagcagcacggaattgcgctaaaacaaattcaaaaataattatttaaataaaaaggtgcttttaaaaatatttattttaattttaattaaccttttttgaactaaaaaatttaaaaaaaaaagatcaaagattcttaaaataaaattcattaacaatcaatttcaacactaatttggatattattctcaaattaaaggaaatttaaaatagaatttatttagaaaaaaatgcttttcaaaaatgtttatttttatttaattttacttattttaaattaaacaatgaaaaacatatttaattatttaggcgaaaataaatgcattaacaatcaatttcatactttaatttggatattattaaccaaatgaaagggaatccaagtaaaggttaattaaagttaaatatttttatttaataaataattaaaatattctttaatgacacgatagaattgtcgcagtccgttcagcaaatgttggaagtgccgtagacgaactgcttgcgaaggttggtgttgtgttgccacagtgccaccaccgccaccgccgttcactgaccctccgccagccgaggacaccccggagctcagactttcgctacgttccaccacatttttggccgattgattgtgttggtgcagtaacacaaggccaaccgtgtcattgcttgtccttaatgaaaatttaagaaaattaatttaaaaattaaaaaataatttcgctaaaaatttcagaaatttacacgaaaagcatttattttccttatcgttttggtggctgctcgagagtcaatattgttcaagtcgaggactaacagtaagaagaattaattagaaactcaaaaattaaagaaaaattttacccttcatttttgataaaaaatttcgcaaaaataaaatttttttagttttcttttggatcgccgccgtaaatattttaccaaatttgacaaaaataacttgatcgtcagtcactgattagcctttaattttcctaagacttgaaaaaatcaaaaattcacttttcccattgcatcaccaaaaggcaaatttaaatttaatattttttccanaaaataatcaaatgaataattggctaatgatattaatttcctcaat

SEQ ID NO: 28409 - DNA, 1345 bp, Heterodera glycines
  misc_feature (6)..(6): n is a, c, g, or t
ctacantttcaatataatatgtttatgcatttgctaattgagggctcttttttagcgtcaactaattgcccaagcttaccgaaatcgttacgaacatgaggacctcgtcgataccattcgcaaggagttgcccgacgatgggcccaaggagctgattctggcactgctttacagcatgggcacatatgactcgatcagcctgcacaatgcgatgaaggcaaaaataaacaaatatatttggaaaatgaaccgtccttatttccaagaatgtccttaaaaattgactaaatcctctgcccataggagtaaaaatatgtcgatttcagttaattataaatttttgaccaaaataatttttgtactgtccttggatttaaaaaaaaaattgttgtattcttggaaatcagcctatctgtcgttggataatgagttcaatcgaaccctgattacccttaattaactttaggggctcggcacggatgagcatgtgctgactgagatattggtgactcgcagcaatgatcaaatacgcgccattcgaacggtgttttaattttttaaaatttattttataaaaaacatttttaattaaatttaatccaaaacttttttacccttttgttcattttaaggcatacaccgagctatacaacaggcagttggaggtggacattggcggtgacaccagtggcacgtacaagcgattgttggccattttgtgtgccgcaaatcgtgacgagtcaggcgtaatgaatgtggataaagccaagcaggtcggcactgtttcttgacactgatcggcttaattaattgctcagagaactcaaaaaaaaaagccaaaacagcaaaggcgtatatgcaatagataattcaaaaaataaaaaataatacgaaaaattattttttataattttgaaatataattttaataagaataaaaatttggcatatggatgcgcttggcgaaggtggggggggggagactgtgcgccttgactaaataatcatacgaccacccaatttttcccctatgacgtaacatttttggtttgcttttcgtcattgcttttttcgaagcggaccttttaagaagctccgtgcctcagaagggacaaggtgcttttccgatccttcggggatttaaacacggtatgagatgccccgattgggaaaacgctcgaaagggcttgcttagccatcgcggctgaatgggctgccccaccctctcgctttttcacgcccgaccccctgcggtaggaacacactacaacttccatgatttttctgaatcgggtcctaactgcttctccgccgctgcttacctgcgctcaaagaatagtggatg

SEQ ID NO: 28410 - DNA, 1145 bp, Heterodera glycines
aaaataccgaaaaaaggcaagataaagccttcaaattccggaaaagccttgaaaataccgaaaaaggccagaaaaagggcataaaatcccggaaaaagccagaaaatccggaaaaaggcaagaaaaaggcataaaaatcccgaaaaaggcaagaaaaaggcccaaaaatcccgaaaaaaggcaagaaaaaggcatcaaaatcccgaaaaagacatgaaaataccgaaaaaaggcaagaaaaagcatcaaaatcccgaaaaggcaccaaaatcccgaaaaaggcaagaaaaaggcaccaaaatcccgaaaacgcgtaaaatttaatcaaaaattaattttggtcatttaaacgattttaaatatatttatataattttttttaaataaggaaaatttttaaacaaattaaaaaaaaaagaaattaaaataaaaaggcatatcccttaaacatacaaatgttatccgcgtgcagtgcggattcatcgcgcatccggcggcatatcccgcttggtgattggccgtccgttggccttccttgagattgctctcttccaacatgttctgaaatagaaatcatttgattttaatttacaaatcattatggccattatttaagctcccatagtctctaggacttaaaaaaatacatccctgtgaaaaatgaaagattttctcaagaattcatttccaaaattaatttatttatttcttgacaagaatttatgattttaaaaattacttaactctatgctgattcggtctacgtcagttcggccccccacggttcggccccaatatgtttttccactataactttctataactttttttccaaccaaatccaacattgttggtatcattcgaaagcttaaggtgtttagaagctttttctaagttatttctttgcgattagacaattaccaaaaaagttatacatttttcttaaaaacttttttaaaagccagaaaatctttttgtttttaataaggctaatagagcatgttaaaagctttcaaatgatatcaagattgagggataaaaggttttttagtgcctattttccattttttagtgcctatttttaggttttttagagcctagagccaaactattttggcagtttttagagcctaaaaatcccatcc

SEQ ID NO: 28411 - DNA, 826 bp, Heterodera glycines
tcatgcatagggatcggatttttagtgataaaaaatcccaaaataattaactaaatagtgagaaaaatattccaaaatagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaatttgggggaagaatttttgtgaaatttttccaattcttagggatgtatttttgaaaatttttaggtcgattcttaggggtgtatttttgaaaattttttaggtcgattcatggggtgtatttttcgtttttattgcatttttgggaaattttccaaaaaatgccaaaatagtggcaaaaataatgacgaaacgccaaaatagtggcaaaaaattattttagtggctaacttccgaaatagttttttttagtggcgaagctccaaaatagtgattcctagtgatgaatagtggcactaaaaacgaaaaattttcgaaaaagaatgtgtttttcgtgcatttctcgtcgagttaaagccgcagaaaaaatagttaaaaaactaagaatccgatccctaatcatgaatgtgaattttgatgaaaaatgaattttcgactttttgttcgaattcgggtccgggattcggaattggtcgaaatggatgtcagattcgtgctcagcgtacctataaacccctagaaacatgtttttaagacttttgaaaattttgaaaaatttttcaaaaaaggtgtcataccatctaaactat

SEQ ID NO: 28412 - DNA, 2331 bp, Heterodera glycines
  misc_feature (23)..(23): n is a, c, g, or t
tttattggggattatgccaccantttttgcatcaccattattatatcaacattattgtgctttagccccccatacacgggcggaaaaatgttcggacaatccgccgcctggcttccctggcattgaattcatgctcccattactgctccaagcggtggcggacggtcggctgaccatgcagcaactcgttgaaaaactgcatgacaatccgcgacgaatttttggcctacccgagcagcccgacacttacattgaggtgattgtggatgaactctaacaagggaacatcccgaattgtaaatgtgttcgactcaacttttaaaccatttttatcgaacttttttttttttgctccggcgccagaagtgatcagtcagaaaaagtcgatcaaagttttgaagaatcaacaaaattattaaatttttaaaaattcatagccatcaactttaaaaaaagaatgatcagcgaaactttctgaattttggcaccaaaattaaacttttttttgagtaaattctaaaaaacccaaaaacactaaatttcaacaaaaaaaacaatcgaaatgcgttttgaaacccttcatctttttttccttggttttctaaaagtctaacgaaagatttttttaaacaaacttttggaagagctgattttttttaaacaagaaggctggaaaaaatgtgttgacttcacgaataaaaaataaattcccaggtggaaatgaacgaagtgtggacaatccctgagagcggtggctggagcaaagcagggtggacaccgtttgctgggcttcaagcgcgtggccgcgtgtgcaccgtggtcatccgtggccagcgcgtgtatgacgagggccaattcctggttgggcccggctttggccacaacgtgcgattgttgcccggcgccatggcggccaccgcctcaaatttgccatcgccgtcgccagcagctgaattgacggcagcagcaaagaaaactgacggcgccggcggaggcggcaagaaaagaggggtggcggcggtgacagccggcaccggtggtggcaccacaaaacggcacgacacgttgcgacagcaccaacagcaacgcatttcgcccgagctgagccccgaccggaccagcgttgtggggccaagccgtctgtacggccagaacattttgtgcgtggaacagtttgacaaggagacggtggagcaggtgttgaagctggccaagcactttgaggaggtggcggtcaaaatggcgggcgcggacggcgttgaacgcctccatccgtccgcgtttggtttcccgttgcgcgacttcagcgtcagtttgctgttctttgagccgtccacgcgcacaatgtgttcctttgacgatgcaatgcgtttgctgggcggcacggtgtccgtgttcaacgcggaacactcatccgtgaagaagggcgaaacgttggagggtgataaataattatttaataaaaacttggagccaaaattttttttttgaaatttaaaaaattttgagtttttactaaattttctttttttttatataagcatcagatcaaattaaaaagtgctgcttctcccttttgtttttgataatgcaatggatgtaaaaatgccgaaacgcgaaattttttttaaattttatcaatttgtttatcactcctaaattagtttaaatcaatatatccttggtttagtcattatttatatcaaaaatattggtcaaaatttgataacttatggtgaaaatgctgattgtgaggaaatttagatgatgtcatttttgtcagattttgtatcaattgaaaaataaaaattccactttttgtcgcaattttataaaaaagtgccgagaggaaagcggaatgtgtttaagtcctgtgccatataaaaaatctcacacctctctccccatacacagatacaatcatcacgcgttgccaccaatgcaccgatgtgattgtgctgcgtcatcccgagtgcggctccgcccgacgcgcctccaccgtttcgtgcggcgtgccaattgtcaacgcgggcgacggcagtggcgagcatccgacccaggcactgttggacttgcagaccatcaagcagaagttgtccagcgtccatgagaaaacggtggccatggtgggcgacttgcgcaacgggcggacaggtgagaggaggagaacaaccaaggggaggagaacagcggatttggccctgtatcaagttgtacaaaaattttgggataaaattcctttgtttggcactgatattgtgcaaactttggcgcatattcccaaaatttgggtcaaatttatggattttttttcattttaaaacggcaaaa

SEQ ID NO: 28413 - DNA, 1313 bp, Heterodera glycines
ttttcggggcctcggtctcgctcgtggggttaattgtcggtcttggttctcgagtctcagaaaatttcgactcccgagcagaccaatttctgtatctgtccatccaaaaaaaattttcacctgattttgaaagggttgtcgtccattggttgccctggacacagaacagttcagttttaaagcacattgttgaaggcacatttgttgttggtggcccgccgttgtcctcctccaaattgggcactgagacggtcaaagttgcggatggcactccatcgatggcattgaaagatgcctcaaagatataacaataatttgttgggtgggaaaaacaagaccaatttttattagggttaaataaattaaatatttcatgaaatagtttaatttactataaatgtatttttaaaaaaattgaatagatttttgacagcaaatccaccgatttggaccaatttgttaacagagttcgaatttaaaaatcttaaaattcacaaaatttgcttactaaaatactgtcaaaaaattatacctacataactttgcataattaatgataaaaatgaagatctttcaacaaaaatctttagaaaaatgcagtcaaatgaatgcccaaaacttccaaaacagttgtaagaataaaaagccaaccgaatgttggtcaatgtcaactcgaacatcaatgctttgttgctgttgattaccttctttaccttttgatataaataattatgtattgtttattaaattaattaaatttttattttattttatcgggattttgttgcgcgggaaaatgaaaatcgcgggggaattccgaattgctgactttttattgggagggaggtgtcacggaattttcgacttccgatttttagggcctcggaattccccatcccgaatatgtacacactttttttggtgctcctccaaatgatttcttcaaattctcgcagctcctttttccgactttcgaaatcgatgaaccgcgactcggtgaccggcattcggaacagcgacggttcggtgccttaatttggggggggggggcaacaattattctcgagtctcaattctcatgaaatcactaatattcaccaagataaccaatgaacaggttgccctcatcgctgagaagcgctaacattgatcgtaacgactcgctgaaaggtaattaattaattaattaattggtaagggaattgaattgaccccgaaaattgagaaccgaaaaagaccaaaaactcgagaaataggtacaataatcgagaaccgagactctcaaatgatcccgaaaatgaagatcgaaaaat

SEQ ID NO: 28414 - DNA, 1417 bp, Heterodera glycines
  misc_feature (49)..(49): n is a, c, g, or t
  misc_feature (1412)..(1412): n is a, c, g, or t
tggatgaagtatacgacccctgtaattaaaagattttcttcgattattnttaatgaggaccagtcgacaacaaaaaaaaataaaaaaatgttgtaagcattgtgtggaatagttctggcacgctcaacagaacgacaggactggaacgggcgagtcacaacagatgcgtgatctgttgtgcggtgatcaatctccaaacgaagatgaactgcttgaaaccggcattgatcagcagttctattacccaaagtttataccaaaaaggatttttttttctgaaaaatgtttagttggttttttaattaaattatattttcggttttttcatggaatagtgtgaattttcatgaacctaggttttcataattcgcttgaggactcatggctgccatataagtgaggcctttgtactcctaaagtttgtattctttatataatttaattagtgcaaaaagataaatattgtgggaatatagtaatgtctcttagcatggcacgggttcgtccttagatgccaaatttttaccgggacttgaaaaattgaccggagcgggtcccgggaacgggctctataaaatatacatttttgatttcaaataaacgcacgtgttttttcaagtagaattagacgggcccgggtgcccgaccgggtcccagacccggacaccctgttttttcaaaacagggacccgattttttaaaatccaataccaatgcccgacccggtaggtaagggtccaaccgggtccaaaatagggtcaaattgttgaccaaagtttagtgtgaacaaaaaaaaattaatttaatttacaaaaattaaatttaataattatagtaaaagggaatcatttatctgctgggcgccggacttttcgacagtaaaaagtaattaagtttaaaatttaggggtgtaaaatcgtaaaattttatcgaaaaagcaaaaaaattaagcctaatcatatgttatcgaaaagaaataaataaaaattcgataaatccaaaatataacttttaaaaatgcacaaaaaaattaacatcttttaaacaaacacaagaatttcttattttcaaatttaagcatgccaaaagtaagtcaaaaaatggaaaattcctattatcgaagcaattttcttcaaaataatttagttttaattaacttatttgtagaatttttagaatttttttactttttaggtgcatattttgtaatttttgatgcatattttatgcgtatctttttaggattttatttgcatatttttgaacgccatataacatggtaataatttattggatattcagctgaatttattcaagaataataaaattaattatattgtttaaatttgatccattttaaattcaaataaaattcaatttcgcaataaatttttcaatattggtaacaatgnaatct

SEQ ID NO: 28415 - DNA, 1076 bp, Heterodera glycines
ttttggtaattgtctaatcgcgaagtgatacatagaattatattcgaaacatgttaagctttcgaatgataccaacaatcttggatttggatgccaaagaaaaaagttatagcgaaaaacataaaaatttttgaaaatctgcccacagataacacaagtacctattttttacaatcaggacgccatatttaattaaatttaaagaagttgggatttcccttgctttttacttggtcaaatattcttggtagaactcagcaacctgaattttcatttttctttttagcttgactataataattgaatgaaaatgcgattgcgaacagcgagcactcaacagcagaaaaaggtgccgacgggtgtcagaacggcggcgagggcttcctctacaactccgactccgatcagttcgagcagtgcgccctcccgggagttcagcagagagtcgagcagccgaccgccggacggcacggcgtcgcccctcttcggcttacagcacgaccgacagcagcagcaggggccgatgttctccgcctcaagtgtttgttactggtaaatgactgcgaatttatttgtttggattagagacatggttcgaaagggtcaatcttgaagttctagtcttagaaactaaaactaatcgtaaattgatttcgacatccccccccccccccgagtttattttgatttttttaacgaaatttattttaatgattttgtttcccttaagtaacggcgagcgtcaaatgggcaaccttgaggttcattgtgctctgtgcaagcgttggttccatcaaaattgcttccaagacttgaaggatttgtatggaattttttttatttgccaaatttaaaaaaaaattgaattttaagcggtggtctcccctttatggtctcttacgttttccattgtcgaaactgttcttcggatggtcgcgagaagtgggcaattaaaagtgcaagttcgtgttgtaccctactcgaaacactaacatttagaacattttcatgttattttccacctccccatttccgtttagtcaaatttttctaaaaatttccctctgcgttcttca

SEQ ID NO: 28416 - DNA, 802 bp, Heterodera glycines
  misc_feature (768)..(768): n is a, c, g, or t
ttttcgcgatttaaaccggttcaaaagccggtttaaacgctttgccgcgtcgttttttcgatggtttaggcgttttcagcacctaagaaaacctgtaaaagtgtttttatgcaattttgagtctggaaataaaagtgatattcgtgatcagcgtcacaaattaccctagaaatgactttttatttgaaaatttcagggagtcacaaaaccgaaaagtattctattcaattggaaaaatattccatacccaccaaaatcagtaccacaaattccattcaaagtacaaaatttttaaaaaattacaatcacacggatgcgctccgcgtcagccgcgtccagtgccgtgttagcattcgccgccgcgttttttgccgcgttcagtcgctgttgtgccagtttaaatgccgcatccgcagccgcgagttcggcgtccgcgtcgcgcttttgttcccaggccaattccacgccagcgactgttctctcaacattttgtcgagccgacctcagcttcatatccatttcaattaatatttgatcagtgctccgatccaagcctcttatcaaaatgccaaaggtcacaaataataattataattggtaaattgatccggaaaagcaaggttctcgagcaaaaaaaataaattaaaaaaacatttaactgagaaaaattttttaaaaaccaaaaaactgttcccaaaattcaatttttattataaaataattcagggaatttttatgctatttccgaattgttttttcttctatatntcacatatttttatatttatggatatttatcatt

SEQ ID NO: 28417 - DNA, 1810 bp, Heterodera glycines
  misc_feature (1769)..(1769): n is a, c, g, or t
ccaaaattttcattttttcaattaaaaaaaaattaattttttgcattagggcgcccgaggttaaagcttgggctcaagcggtggccgatttggggcgccaaatttgcacaatcgggacagtgactacaaagcggaacggagcgcggaacatttccgcatgcaaatcattgagccaaaagtgatttcacatgcgcacattccgggtgagtgaaattattgaaactccgacatagccagggggggcctaacctaaaaaatccaattttaagggaaaattgattaattttcaaaatttaaaaaaaggccgtgatcaagagggcacctctcacttttttccccagaaaatttaaagtaaaagattttcagtcaccgattgaaacaacaatttaaaattttgaaaggaaagtttaattaattttaaaaattttaccgtcaattgcaattcattaaaatttaaaaaaaaatttccctgcttttcccctgtcaacaccgctggacacccaactttcattttgtttatatgtcaaaatttttaaaaataataatttaaaattttttaattaaacaagcacgaaaagtgctaattttatggatttttgggaaatttaacgaaatttcaatgttatttttctcgtcaaaatttaaaaaataataaaaataattaatgccaattttaagcgcacgcaacgcgcgactacgccagacgccatctgatcaccgattttccctcacttcacggcaaacgttccttcatcgaccttgaagcgattgaacagcgtaaacttcgtcaacaacgaaaattgccggaggcaaaattcgaaaaaaaaatttttttttttaataaaaaaataataaaattccatccaatgataggccggtgatcgtgatcgggatttggacaaattcttgaaggttcgagaagataaggagcaatggaaaacgccgtggcccgcgccgaaggtaggaaaattatatttaaaaaaataaaattttttaaatttagcccgaagacgaatcattgcgcgagttggaccgtcttcgtcaggtataaattaaatatcattttcgatcaaaaaatttttgaattttttagaatttataaaattgcaaatatgttctaaaataaaatttgtatataaaattttctttagtttaattaattaattagaaatttcttattaaaaataacaattaaataacattattttttaattttaaattttgtctaaattaaaaatatattttttaaatttaatagcttaagaggcgcttatcacaaacaaaaaaagaatatattaaaataaaattaaaattcccataatttctcataactgatatgaaattaaatacaattaatttaattttatttattttaaaaaatctgcaaaatataaattaacaattaaaagaaaatccctctttcagaacattgatcagctgcagaaggtcagcaatcgctttgcttttgctttcgttttacgctttttcgcttttgcttgtatatatatattttttttgcgggcatttcaaaaatatttaacttcggacggcacattctcttaaatttgaattttttttccaaatttggcataatgtgtccttttgggccaaaaattccacaggcatcgatgcgcagaagcaaatcgttgaacgaattgcgcccggtgaaagcatccgcaacaaaacctgaacaatttacattaccgccactgttgccctcgaggcacaaaattttggaggtaatttttttttaaattttttttatttanaataatttttaaaccgaaattttacaagcattgaatttcaa

SEQ ID NO: 28418 - DNA, 1186 bp, Heterodera glycines
caaattgaaaaaaagtccatcccaaacgatgaaagcggcacgctgccgtaggcatttgttgtttaaaatgtcaaattccggcatttttctctggttcggagtccaatgaacggtccccataatttgccgcaatatcaaaaaattacagagtttttgaattggaatatttcggtaaattattagccttttttcggaaaagtaatgcattaatttgtaagcacaggaggattctatgatccgcttctgttccgggttaaatagaattcacaattttctgcgtccatttgccctttgctcaatttaaattgtcagacaaatcattttgtttcaataattttgttttcccttttgtttttataaattcaattttttcaaattgtgaattgccactaatttgagaagatttcggcggcacaatttcctcgttttgcccaatcagcagaagcaaacacggcgatgggaaggggggggggaggcgatgtttggacattgaaaacggaaattttttattttcatttctaagaattacttttattacaattttaatttttaaaaatatttgagtttccattcatttttaaattaaaatagaatttattttaattttattaaatgctttttttaaggccttaatcgaccaataatatactcaattttcactttcaatgcaaaaatttgaataccaaaaagcaaaaaccgaataaatgcaaaaaagagaaattgaaattgaagtgttccttcgggaattggcacttacattatgcccatcttagccttcgttcggttgtttaatcatcgttttggcatttccatgtgccgcgaaagacaaagattttatcaaaaaatgtcaattctttatgttttgttgatgaaccttgacctcttgagttgacattttgacacaaaatttgtttccatttttggcaatttattttggagtcattcgtatgcatttgttttgatgtacataaaaataggcattcaaattcttgacatttttctcgacaaatctcttccgcgtgccattccattatttttccctttctcatttattttcggcatttcacttatgccattgacaaaaacattgcgtgagcatgaatcacttcatcatcacacacatccacaaaacaattcatttcattctttattattgaatgactgtggtcggccatgggacggcgga

SEQ ID NO: 28419 - DNA, 1289 bp, Heterodera glycines
aataaataaattttttaaaaaacggaaaagggtaaagaaaaattttaaaacgcaaagaatgtgttcttttttatattgtttttgagcctctggacccagtttaataatacctatttttgcctatttttgggtttaaaaattgtccttattcaaaaaaaaaaattaaaatttttaataatttcatttacaattgaaatataagcaaaattaagttttttgactaagttttattggtttgttatataaaatcgttaataaaaatggaaactctagtcatctccataatgtcatttaattttgataaaattttttttattaaattaatgtttttttgcatatattgatattttgatgaatattttatatttattttattcatttgcatattataaggcttttatgggcatattcattgcttaatgtagcaatgtattggccaacaatttaagataattaataaaaaatatataaattttcattattacgttactttatttatttgagttctttctttaataatatgaatataaattctttgttcattttactaattactagggaagtttctgagagtcaattgagattaagttgaataattttctaataagataatggtaatataatgtcaacaattacacatttagaagtaattaacttgtgatttatgctgatgaagctcttcattagtttattttcttctgtttttctctttatgccatcattttctacaaaaaatgattcgctaattgactcctctaatcgttctgctgctgatgctaatttgggcaatgttttgccatcggaaaatgatgatgattttgtgtcgattccgatcaaaactgatcaaaaacaaattgatcaatttcttgaagaaatttatgacgaatgtggagaaaaaaaaggagaaaaatttggaaataattaacaaaatattaaaaattagaagaaaaaatgataaaaaatcattgaaaacagaggaagatgaacaaaaaattaaaattgttcatcaatttattgaaatgcaaaatgaatttgacgaaaatggaaaacgaaaatatgaaaatgttaatgaaattgcgaaaattattggtgtaacacattcaagaatttaccattggattgataaatatggattatcacgtaaaacaatttttaatttaaaaaaatgtaataaatgcattttgtttatttaatccaatttaagatttgaaaaaagacatacaaaatgatcgacgaattgcaattgttcaccaattttttgcaatgcaaaaggaatggacgaaaatgga

SEQ ID NO: 28420 - DNA, 1734 bp, Heterodera glycines
  misc_feature (1447)..(1447): n is a, c, g, or t
  misc_feature (1570)..(1570): n is a, c, g, or t
tatgataatttaatagctagaaatttttgaacaattccctattatgcaaacagcagaattaatgctcctaataaattagaagacgctctttttttaatgttgtttagtctatcagagattgaaaaatttatatctgaacgaaacaaataattggaaatattttttctaaaaaattttaatttttaataagtattacttttatttggtagaaaaaaggcataaacgaagattgattacattttcagaacgagggtctgcctttggacgatcatccgctgattcagcattttcatcgcattttgactgccacattcccctcccaaaaaaaaactatttttttcttaaaaaattatcgtcgcctggccaaaaatcgtaaaaatttggcagtttttggtcaaatttgataacaaattgcactcaaattttcaaaaatttttccccagcggtgcctatcggcgccgctgccgcccccctttctcctcaaaagtctttgagaaaagcgtgccgcgaaaaatgtttttaaaagcaaaaaagtgatcaaaatcaatctcactctgatcttgaaaataattttaatgatgtaagactttttttttattttttgcttgtataaaatttaaaaaattatatggaaaattgaaaaaccccgaccccgagcgattttgtcaaccccgaccctgaccccgaccttgctgaccccgacaattccgacttttccaaccccaccggtcgggggtgcaaccctagtttaaactttgaactgattcaaaaaccatttatattgccgctgacttttttttgacttttctgtcgttttcggcacctaggcgagaaaaattatgataaattggaaaattatttttacgagagccggggaatacgggcatcttttgaaacaggggaagaacaatctaataattttcaaatctttaaatgaatttgactcattattttgaagaattttttattttagatctgtttgtgactgcaaattcatcatgtgctccaaagagcgagtgagtggaaattatgtaatataatttaaaaaaagggttaaactattttaaaacaatcgaatcctgacaaatttggtatcgttctaaagctcttgagagctaggtctaaaaatcagggaatgaagtcgagccgatgcaaacccggactcgaacaaaaaactcaaatttaattttcgccaatatgaattatatgtcttgccttcagaatactattttctgtttatttcatgcagactaggcctaagcaagcctaagctgaatccaaggcctaagctgaatccaaggcctaagctgaagcctaaacctcagttgtcccagtgcactgatggcgtcggctgggttcatttcctgatttttagactaagctcgacaagagctttcggatgtaccaaaattgtcaggattctatcgttaaaaaaagttagagtgcncaatctccccatttttcgagtgttggtcggttcaaaaaccggttttcacgggctgttcattacagtacacccaaaatttttaggagcgtattcagaaaaaagtaaaaaacactttttttattnttaggaatgcactcgtaaacggggcaacagtgatggatggtatttatttgaggtgatattcaaattaataattattttgtaaattaaaattctctaaaaatttgtttatgcagttttttcgtaaaatataatttacggttttttttatctgaaatttatttttg

SEQ ID NO: 28421 - DNA, 581 bp, Heterodera glycines
ctgtaaaaaaacattttatgccatattatttgttaaggaacagatgcagtcccatgggctgtatccttcagaagcactacaggatccatcaacgcgtgcttcacaaataaggcgcaaacagtttactaagggggtccgtgctccggcaaagggtgcgccgggacagccacttgcatgttaccattgcggcggaccacacctcgtcaagaattgtccaaaggtgtttttgagcttaaaactataaatcaataatgttttaagcggcaagcaaaccccaagtgctttaaatgcggggggtccggccacaaagacgttgattgcccaatggcgttcaacttgggtaacactcgtggtattttttaaattttttttagattttttgttatgcgaattacattaagcaggatgctacaactgtgggggtccgcacaaggatgcacaatgtccggcacgcagcaactttccatcttatgccggcattgatcgagatcgtaggcgcatgtattgcacttccgcattcacaaatcttttttattcaaatcaaaaaaataaaataaaaatggtggagggagggggggggg

SEQ ID NO: 28422 - DNA, 1012 bp, Heterodera glycines
  misc_feature (993)..(993): n is a, c, g, or t
caataattgttaagttttctagaaaagcccataataatgtgcgttaagcaaaagtttttgaaaatgtttaaaaaaatcaacatatcgatcggcggcgcttgtaaaagtttgccgtttttgggtcagaaattgtcaaattctgcccaaatggacacttttggtatccgcgggcatctcagtgccatcacttaccattgctgctactgcgatttttggtctctttggtttttaccaccaaattgtccggcccgattagcgcgagatcagcgtgacatgcctttttgtcccaactgttttccgactcggacataaacacctcaaaatgtttttgttttaattatattttacatgaaaccttaattcacgtatgtacaaataacatttcgtcataattaatcatttaattaattaatttcctggtcaattttggtgcccagttggtcactgtcatttttcgactctctgttgtggaaaagcttttgcgaatgttcaaatgggactaaatgaaaaaaatgatggcagtgaattaatttactctttaagcatattcgatttatatattttatttccgtaaatacattttttattttttgacttttattaatttaagtttataattgcgtgccttttccgtgaccttttcccaaattgttgaccaacaaatcgcctgctgcaaaaaaattaattaatagtaattttatcaaaatattataaaaaaaaatttcatcctctaccacttttgcttttcatcagttcctttttcttttttgggtttgtttttgtggaagtggacgattcggcgacctcattcgaccgctgagaaagctttaaaatctaaaaaacaactaaataaatgaatcactaattaggtaattaattaattgttatacattcagcatttcaagttgatcaattcgatgtttcaagtcatgcacttcgttttctaattgtccaatttgaactttagcggcaatgtggttttgctggaaacgnatagttcaatacgtcaaaa

SEQ ID NO: 28423 - DNA, 829 bp, Heterodera glycines
cttccgaagaatgccaaatttgtccgagtttggccgttttaaaaagtcaagaaccccccttttcactcaaattttcgagttttaaaccggttcaaaaaccgattttttggcatttccgcaattggatacctactttttcgtgcatagctcctcgagacgatcgattggtatatcatttataccattttttccggggggttgactatagtacacccgctgttgagattgggtcggggaaatttttagcatatccaaaacatttcggattataccaacggcaccgactcggtcggcgccgaactgggcggttcttctcctctgacaatccccgattgcatcattccgatgctccaaaatttttcggaaatcggaatttttacctcccaaaatgacgggaattggaaatttttaaaatttagaaaatgattaaaaattttcaagcttttaattaagctaaatgtaaaatttgaagagaaataaaagcaaaaatctgattaccaagtaaaaatgttaattatttgcttcagctaatcgtcgtttcattaattaacatttactaattgtactcatttgcattacattcaaatatgccaccgcgaatgatacagccggcagcacttactgaggctgtaggcaattttgagaaatcattttacaatgcttatctgtttgagggggtcgggtgagggttggttaccataaaggcgtagccagggcgggtgctaagggggttaaagctccccccccccccccccccaaatacaaaaaataaaaattttcaaaaaatgggcaaataaaaaaaagaaaaatacatccaaatgggattttt

SEQ ID NO: 28424 - DNA, 235 bp, Heterodera glycines
  misc_feature (222)..(222): n is a, c, g, or t
cccccccccccccccaaggcaccgccgcacccgaaatttttaaggaaaaatagtatttctgctgaaaattttagattttccttggtggtgccccccagacttagcctctcacccaaattttccaaaaaatttcactaaatgttcaaaaaaatcgacatttttttgattaaaatttcctaaaaatggctcaaacgcgcaaaattcgtctcttttttggacaanaattcgttaacaa

SEQ ID NO: 28425 - DNA, 772 bp, Heterodera glycines
aaaaaagaaattgtcttctgtttagcgctaccgaagcgaccccgttttcgcagaaacggctcgaatgatcactgcgcttgcatttgtgccaattcagcatttaactgctgcaattactgcgctgaactacatcgtgggggaagaattggacccaattttaggctggtaagtttaaagcagggattttccaacaatttgcttataaaaataggttccttatcaactacaccggcgttcctttgccaaatggaacccgaacacgtccgcgttttccggtggactattggaacgtacacgaacggactgtcaatgaagaggaacgaacaaacaacatcgcggaagcagcgcatcgtcgacttcaaacgatcttcagctgtcgctatccgtcaatttggcgcttcatcgacgtacttcgaaaggatcagcgttcgcgtgacgctgattatgtgcgctgcgtgaacggcgaagaaccagcgatgaagaaaaagaagtttcggaaggcggacaagcgaattttgaatattattgaaaattttgatgcccaaaatattattgagtttctcaggggaatttcaagtaattgtgttatggacccgtgattttgttatttaatgatttttttaaataaacatctgaattttataattagaatattgagatgatgactgtttttagcgaaaaaaatctggcggcgagatagccaaaaaacaaggcgcggcgagttgggcggcggcgagtttctcgcggcgagatggccgcggcgagttgggcg

SEQ ID NO: 28426 - DNA, 1580 bp, Heterodera glycines
atttaaaggcaaaaatatgtgcggtcgtctgttagaagacattcgcgaaaaactttacccaaatgggtacaggaaaccaaaaagggcaaacaaacccaaaaatgaaaaagatttagaccaaattttgaaaaagattgaaaacgacaggaaaatctgtgttttcaaaactgaaaatattttgagacaatgtactcggattaaagaagttgtcaaagaaaattgggacatgaatgtatttatccaagggagcatatacaatggccttggaagaaaagaaagtgatttggatttagttatgataaactcaaaaggaataccgaatgattggacaaaagacgacagttgccaattttttgacaaattgcgaaaaaggttaagagaatctggaatggcattaacccggactctgataatcccttcccgaaatgtctccattttggaaatcacaattaattctgatgaccaagaaataaatgctcaaattagttgcaataatttgattggattgattaattcgaaatggttggcatgttgtgtgcagttggatgtacgatttaaaactttatattttgccattttggaatgggctgacttttttgaaattcaccaaagtgctaatggaggcggcactttaaattcttatggttggacatcacttttaattttttatttgatgaaaattcctaaccccgttttaccaaatttgatcaaaattttaccagaaatttttgaaattcgaaatgttacatacacaaagaaacaaatttttgaagtactgaaacaaaaacttatttgggagacaaccaattcccagagcatttcttcactactcattggattttttgaattttatacaaaaatcaatttagaagagagccggttgaatatgaaagaaggaaaaatcgacttttgggagaaaagtgctcaagaaatgaaaatgcatttattcattttagagccgtttggggctttcaatgtcgcaaggagtgtgacataaaatggatttatcaaaattaaaaatgcatttcatgtaacatgggaaaaattaaaattcggtattcaaaatccaaaaaagctgttagaagcaataaaaggaaaggaaaatgacgaaattatcgaagaaaaattgaatttgaacagaattttaatatctgatcaggaattagtccaaggacaagaggcaaacacccgaatggacagtgcgagtaagtcaagaaaatgggttcttaattcacaaaaatatttctttaacgccttaatgattatcaatataataaatttttgtgtagccacccaaccaatgatttgccataatagagcccaaacaaaattggtccgattcaaaagggacacctcttcgtgcggaaaaatcagtagatttcttgaacaacctactcgagctttaatgttagatttatttcggccaaacccagataattttcaatttgaggcctggagatgcataaaaatcagacaaacaccaaaatacaggactgatttatttgggtacaaaattgaaaaaattcctggatcaatttttttacaaccacttttgaaaactggcatcaatgacaatttac

SEQ ID NO: 28427 - DNA, 1369 bp, Heterodera glycines
ttattgagatattctttttataatgcgcaaaaatataagctaaaaacaaaatatttgccttaagttttctcgaaccaaactacatttattttgcactcaaaaaaatattaaaatttcaaaaaaaagagcaaaaaatcccagtataaaaataaaaaataaagaagcgtttttcaaattaattaaaataatattttatacaaaaaatgtaatttatttattattccacaaaaataatttattcgtttttttccttttctttcggctgacattgggaaaagtcaaatcattttttcacaatttggatggtcatatttttttattcattccgatgctaataatattatttacataaaaatgaataacagaagggatagaaaaattatgtgtacagcgaatgaattttatttgtgtaatttatcattcataaggccaaacaaattattttattggaactaaaaaatttattatttcaacaaaacgaaatatttaattcattttagtcataattatttaaaaaactgaaactataaaaaatgaaaattattccggcattttttattgtgtttttctgtgctcttctgttgattgtcctttttgacggtctttaaaattaataattacactaatacaaaaattaaatgtttttgtttcctttagaaatggcttacgccgaagagctgccgaagatgggtttgtgaatttaaatttctcaaatatctgaggaacggcagcgatcataaactatttaaggaatctctgaaaggattttttgctcttaaacttaaaaaaatttcctgggtatttttaaaaattttgcaattttaaacccatttttaaaaatagattggaaccttaaatggacatttttggattgttttgatctcatttatttttttcaatgaattttaattcgttttaattatatttgaatttcattattaataacacttgttattaagcaaatgcaaacgatccatcagaaatctctcatttggatgatgatgatgatgatgatggcagtgattcggggagattggatgacccgaacagagagcatttgcgcgattacattcttctgtgaaattgaggaaatgccaattgaggagcaacggacgatgttttggcacaagataaacaaaaagaaaataagaaaaaatttaatttctaatattatttgtatttggaaattcgtttattcatataaagcaagtctctttataatatgttgtgctgtttgtgatgagaaacctaaagctgacaatgcttaaaatattattttatttatataaatacttacatttaatgattaacaaaagaaataaaatttaaaataatgaaactccacccggaatcataccgatggctaaaa

SEQ ID NO: 28428 - DNA, 1469 bp, Heterodera glycines
tttaagctctttggattgctgaaacttccgctgatttggtaatgataaaatcaataatctcattagggcagtaatagcagtaattaggtgttggcactgaatcgctgtctcgaactcggcttcgccaaactgtgccggattttgttcgccggccatcgcattttcgcctggttctttgcctgttccctgtacgccctcggctgggccgtgttcatcaaacccgccgtgtacagcagtgttttcttcggatggttcttcgacccgttcgttggttatcacaacgctgatgatcaacaacaaaaacagcacgaggaagtgggcatcaaagaaatttcaaaatattggataaaatataaaaagtctaaactaggtgtggtacttatgttcgtaaaaatgtccatatttaaaccttgctaattggtggtattattaaggttacatctcacagcccttatgcttaatcaaattcaattccaaaaagataatttatttgatattcggccatttgtagatgcaaataaattctattagggaatgggatgcgcaaaaatatctaaaattggcacagaaaattggacacggcaaaattggggcactattagaaagaaaataaataatcaaaaatataaataattctaccaacgatcaaataatggttaaaaattatcgatgccttgagtaaatttctaagcaagtttatttgtgctactcaaatgaatatttctatttgatagagatgattgttacttaccgaatttcacatttcgattctgatcccaatctcgatgattcaattacacatttgttttctgtctcaatgttctgtcggtattctcgaacatttactactgtaattatttccttcgtagaattattttatttacaccagcaatggtcttgtattaaataaatcctgtattcagaatagaatttgattttatttacttaaccttaagcaagttaatttcttatattttgcaaaagacaaaatttggtgtccaattttccgttttaaaaattatattttcaattgagtcccccattttttgttgatacttatccaaataggaagaagctatttatgaataatttaagtacgagcattggcttcaccccgtgcacaattttctggtggcaattctgagtccgctcatttatttggcatttgcccttaaacttttctacaatgttcggacgagtcgcagagagtttggcgttttggtttccgaattggattccgtccaaatacgagtcaatattcatttatctttttaatactaaaatttaaaatatctattaaataattttaaaattaattttttggattagaaatttaaattcttttcatttcaaattttaacttatttttttagatatttctccaagttctgctgatctccgcaatgaacacattgactggctctctttacgtatacgttcaaagccatgaagttgggcaatggatgatt

SEQ ID NO: 28429 - DNA, 2013 bp, Heterodera glycines
  misc_feature (1938)..(1938): n is a, c, g, or t
gcaatttcggcatattttggtgccattctttttttgtatattttcttttttgcttatatttttttgtcattttaatgaattttaaaaatcttatttttggcgtcaaaattgaattaaataaaatcaaccctaatgattgaactcgtataaaaattttatcggatattttgactatttatctttaaatatcgataatcattctctttttttgtgctttttcattcataattttttttccattttaaaatgcaatttcgactgattttcaatgtttttgcaatattttcatcatcaatttgcggattatttctttttatttgccaataaattttcattttctccatttttatttatagatctcttattttaggacaaattaaaaatgcaggacagacagaaaattttaaatcaatttaaaacaacaaaataaatacaaatacaaaaatttctttttcttcccatttttctccaaatataattttatgaatgaatgggcatttatttattcgtgaaatgattttcatattaataaattggatttttttaaattaaaacaaactacaaatcacaaaatttttattttaatccttatttgagagtagtcataatcaatcggatgcaaattttaagcggcaaaaaatcccaaatttattaattaaaaagcggcaaaaaatgccgaaattatcgcaaatagtggcgaaaaattagtacattccaagcattcaagataataaattataacatttttacggtgccggcattttttctaagcaatataattttttttgtcactttttcaaaagagtattatcgaatttatgccaatgataccaatcgaaaattcatgtttcggattttaagaataaattttttccaaaaaatgactgaatgtcgttattttattccaaaaaaacaattcattccatacaaaaaaaacattttattcatttggatgtaggtagttagttatacaaaaaatgcccttaaaactgccaaaaaatgaatctaaaaaacctcataaaattgtgaaaatttaaaattgactaaataatatttaacgaggctaattgcatattttattaattactccatttttaagatttataaagatttttaaaatacttaataaatagaaataaatgcgcttttcgggtttttctttgattatttgcaacaacagtataaaacagacaaataattagaaatttatttaaataaatttaaataattcaattagccaagataataattttataaaataaaagaattggacaaggccattcgtgagtggacctatattagggaggcattaatagcacaacccgtggctggtcgattcctaaaaagtagggctggtcgggatccaggctatttaacgcgataaagaaataaaaattccgatcaaatttgttttcccatataaatccaacaagaaattgttttactaattttggtttttttgaggcaatatgtccggcggtgtatgttcggtatataattttatgagatttattataagattctttttttcatcattcgtttcattcttccgattctccaaattgtttcctccatcttgtaacggtacttggaccaattttcaatgtttttgcaatttccttttcactcatttttggattttctctttttattttccaataaattttcatttttcccattttttcttcatccgttattcttttacatctttttgtacaattgtgagtttttcttcatcagtttttgatttgtgacatttttgtttttgaagccccaattctttaatccatttataaatatataaacgatttgtccccaattttttcgctatttttctgtcaattttactccatttttttcttgaatattttcttcctttttgcttaattttctctttaattttataatattttcttattatttcccgtttcttctgtncatttcgttgtttttcttctttttcttcccatttttctccaaatatttcatcaaatgttttctggtgcaattttt

SEQ ID NO: 28430 - DNA, 880 bp, Heterodera glycines
caccttttacatggtttagaattttaaaatttagcctattaaatatttaaaaatttttaattatattttatattttttgaaaaattccggcttccgagttccgacatttttggggtcggacttccgacttctggaattttttggtgcctcggaattccatccctgctggtatataccgtatacatatagatgtaaaaatgcagaaactttaaatcaaaaacacgaatgtgtgagtttgattggacaaggtcaaaaaataaataaatgaaatgtgagaaaatgcaaaaaacgatggagagaatggattttaatacgcacaagtaatggaagatttgataaatgcagctcgctgttggtgagaaatgacatttttgttggcgattaaatcaatggcatcgtttcttaattttgaacgtgggagaggagtggcaaagcaaaggaaagcattcaaaaagttggtttacgagttcggtcattacagtacgggtgctatagtcatttttacatattagagaccggacgggatcgggacctcgcgggattttttcgggatcccgcgggattaaatccgggatcccgacctcgggatccgtccttgatcgtttttctaaaatattcgggattgaccggggattcgggtcgggatccctccctaccatttcgccaatcccgcgggatagggtcactataatttttcgaacaaattctattttcttattaagatcttacaattttttatacaaaaatttcatataaattccaaaattctttcccggttacccaaaatccaccaaaatttaaataaaaaaattcggttgaaatgtaagaaaatgtcgacgccaatttaattatattctcaattaagttgtctaattaaata

SEQ ID NO: 28431 - DNA, 1163 bp, Heterodera glycines
ttggacaatttccctttgagccagatttgttgctgtaggcgttgtgccactcgcagttggttaaggctaataataaaatttgatttttcatctaatttcacagatctctaggcattctccggtttttgtgctgatgctcctggtaatgaatttttgtacaatttcaattttttcttcatcagtttttgatttgtgacttttatgtatctttttttgaagaccaaattctttaatccattttggaatatatgttttatttgtccccaattttttcgcaattttcgaattaattttattccattcttttcttgaatattttctgcctttttgcttaattttttcttttgttctataatatttttcaattatttctcttttttcttccaatttttcttccctttttccaaatatttcgtcaaatgttttttgttgaagtttttattttccgatccgctttgatcaattttgttggtcaaaaatacaattaaaatgaataaataaatgttacaggaaattcaaattttgcgatccagctgcaggatttgagggatcccgcgggaaaacccctggatccagatcgggaatcatatcccactttattttgagaaaaaaaaaaatttttatttatttgtttaatcactgataaatttgaaaattttcaaaaatttatgacatttattattaaacattgtttcttttaaaataaaaaaacaaggaatttatcatttttgataaaaaatgattgacaaaattcattaaaatttctggctttttaaagctttgcatatttggacaagaatgttggatttttacggaaaattaattaaaaaattgagcctagtttttcaaaaattagctattagaaggcgaacaataaaattttctagttgaaaatttgtttccgatttttaaatttcttttttgttttgatttttgtgaaagaaaaatataaaaaaagttttttaatattttcacttgaatttttttaatttcccatttttcattctctttttatttaattagctattttaattttaattgattcattgttaaaaaaatcggataacaaaaatatttaataaaatttattttcttcaacaatttttctcaattttaatctttttcctaaactataaatcaataaaattattcaaaaatattta

SEQ ID NO: 28432 - DNA, 1990 bp, Heterodera glycines
cccccccccccccccccccccccgccacccattcgtcgtccgtcgtcgccctccctcttttcttctacgcgttgctgtgcttgtgctcttcggttttacacatttccgccgattgatccttcccatttttgctttataattttgctacaaaattttttttcttttttcttcaaggttaaattgctggccatgccttgagaggcacagcccctagggtttttgatgacaaaatgattgatttactgctgttttatgtttgtttaagaaagaaaagaaagaaatgtgccgacaaaaaatttttagaaatttttttttttgcctcgggcgattttattaaataaatgaaggcaaaggaggaggccaagccaacggaattttatttattttttacgaaattataattgacaaaggcttgtaaaaatattttttaatttaatccggctttcgtgaaatgaatcgaccgagactatgatttttaaagggatttttacacggacggccaatggcatggctatttttctgggattttctcggctttattccccctgaaaccgtatgattaagcctaatcttttcctatcttggccataaataattcaagactaaacatggaatcgcactgccttctgtcctcttaattgtgattaattgattcactgttatttttaaagtgaaaaattatgtgcgccatttttttgtttttactaaatttgccccgggctatttattttacatatgggcgaggggtcgtatcgacattgtaattttatgattttgcgcagtattttctttcttttttttttgtaaaattattatttttaataatactcttccactttggacatttttgtgtttttttttcttatctttaatcaaaatttatgaaattaattccagtttagggggagggcctggcccaattttgggctgtaaaattcaaaattttctatccaacttttttgaaataaaaaagaattactacatacctatctcatttaaggaaatgatttttaattcataaattgtagggctgctcgagattctctgtctttcgttctcctgttgtgaatttctcgggtttttttgggtcttcaatgcatggggttaattttcggtctagttttcgagtctcggaaaattaaaaatttggagaggcgggggaatttcgaaatttcaatgccgttaagaaaaagtagaacgtttatccgtttttcattgaaaacattttggagtcaaatcaacaaaaatatgtgataaactcgagggtccgacggtgccttagacaccgacagagaaaattttggaaattttaattgactttattagacaattgagtaaaatttttaaaaaacttaaccttacccccctggctacgggcctgactgatcccttcttggaaccgtaatttgtgcgttatccactcattcccatctggtatcaatcatgtttgcggaattttccccagttttgtcccctgctggggaacaacatgcttattaatgattatgtaatttatattatcctgatcattgccagagtttttgtcggttggccaattgcttagccattatcactgttaattgatgggctaatatattttccacaactttatccctccgtgttcccaaattcctcaaaaaaacaacattttttggctttatcccctcaaaggacaggcttttgttcgcggtgatggctttaccccttcactgccccagatgacactggacttttgcggctttatgctttatcccccatcggcttgcatctccgtcgtgtcccacaattttttttgtgttgttgcccgcttatcgactggtccatttctaatgatgatgatgatcatcctcatcatcattatgcatgcgtgagaagccggtcatcatcatctacaactgcttctgcttgcctctgctgcacaacacaacgccaaaaaactggaaaatcactgcgcgtgctttttgtcgtcgttcgcttggctttatccccc

SEQ ID NO: 28433 - DNA, 1664 bp, Heterodera glycines
  misc_feature (1062)..(1062): n is a, c, g, or t
ttgtccccagaaatttcgttttaggattttcaccgtaacaaatcaagaatttcatccgttttatttcactaactaaccaaaaaattttagacaggtcatggttccggtgacgaaattgtcgacgaaagtgttgccgattcgtatgacgggaagagggaccttagtgaggacgaaatgccagtgttctgatgccgagtatgcgattatctgatgacgctttactactacacttattcaaatatactttgatttttattttgagttggttttgttgtcggataaagattttatcattccttttcctgtgtggtagggttcagtttattatttataaaagcagacatgggttcgtaattacagaataaatttggatgtcaaatatcaccaattttaggcttagatcgtttcaaccgctccgcaaaaaccgttggaatgcgttgtaagcagtttcaagttcaaaaatcatctgaaatggtagcggactaagtcagggaatcatcgtaactgtttttgttgccttccaaaattacctgtcgtgcaacttcgtctgtaatctcctcatgagcagccattccctgcagcttgtcatgcctgaaaaagtcgtcatgctcagacaataaaaacgtcaccaaatttaccacgatttcaccctgagtttggcgtcgaaatcgtccggcaaagtactctgaaaaatgtggaataggaataaaaaaagcatcctaccattgcgttgatggaggcgtaaaggtcgttcagattggggaaaagttcgtccaccgcgcgaatgttcagcttcaattggtccaggaatgtgatgaacagctccacaatgtccgcaatgcatttgagagcatttcctttgtcgtcgcgcaccgtaatgggtcggtcctaacgattaaattttatgcacaaatttgtgaatccgaaaattaaatttgctcttttttaattaaaaaaaacctcacgaatacgctccaacgcggccgggcattgaatgtaatatgagcggaaaaactcgtcaattgtcatgcggggaaccaatcgcaaagccaccttaacttntgtttttgaaagtactaattccgaatgcaattaaaatggccatttttgcgtgttatagcaaaaaattttatatctttcaaaaatcacatacctaaatagttttttttatgtaaaatgcaacaaaaaagatcgtcgctacccctgaaatgttgtgccaaaaacataagtgtcactccttttaatttttaaataaaatactttaaaaatgcctaaaaatgtaaaggtgtaaggatataaccaatgttttcgacgtcgatcaaacagtacaaccttgatttgaacaagcagttttgagcattccgccgtgtactccttggcgtggatataatcccggctgaacaccttctccaggcactccaacgcgttgaccatcgcgtacagttcagccatgttgtcaattcgatcgcgctccgcattgttgtcataaaggcgaacctgtgcgaaaatggaaaaatacgtgttcatttatatctactttaaagtgaaatttactaacttcttgtgacaagtcaattgaagccatggcaaaaaatgtggaaaaattaataggtaaactccctaaatcaacaattcatccaatcaatagataaaagcctaaatct

SEQ ID NO: 28434 - DNA, 1049 bp, Heterodera glycines
aacgcgggtagaaatatctggttttaatcgagaatatgcataataattccaggttcaatatttattgaaattcattgacttccgtgtccatactcatgcttaattttttaaattttatattttatttgaaacaattgtttccgcgcttctatttaacatcatatatatttttagaaaacacaaatttaacgtgtcaacgacaaataataccatataacattttaatagacatatgttcaaaaatccatcgtttgattacttataataaagtaatttttctttttaatgttttgtctcgtctttgtctaccgcttctaatatttactaccacttttatttggtgtctcaacaaatgttgattccgccatacaacacaatcagagaattattattgccttatcattatctaattagagcatataataattaattcatattttacaatattcaaatttttaattcattttaaattaatgataaatatttttatctcactaatttgcagatttattttccaaggctattgctttaaatttctcttttatttctgggaattccgtttttgtgagaaaaccttaaaaattcacataaataaaatattggtcattctgaaaattgaacgcagcaaaaacggagaaaacagcacaatagaaatgaaacccttatataatttggaaaaattaattacgccaaaatccgagcccgggttaagcattttgttacaaaattttgacagtaaacgggattgctcgggattggggtttcatcggggtcccactcgtccatttcgccaaaccacgggaacccatgggatttgagtcaatataatttttcgaacaattaccattttttaaattaaggtcttgcctcaaatataaaaaatcaaagaaaaatatattcatttaattttcttaaaaaaaatctttaaaaattccaaaaaattttcccaggccaaaaattctactgaaatttacaaaatttgatgagaaagtggaagaggaacagaaaatggaagagaaagtggaagaggaacagaaagtggaagagga

SEQ ID NO: 28435 - DNA, 1389 bp, Heterodera glycines
  misc_feature (827)..(827): n is a, c, g, or t
  misc_feature (954)..(954): n is a, c, g, or t
ttatacacaaaggcatacgatagctctgtttttcctttcgctatgttctctttcattttgttaatgttttcttgcataattttatttcattttttaatatttctattttaccctttttagcaaaaatacaatcattttaataaccattccataaaataaaagtaaagttatactttttcatgttaaaacaaaattcaaattttctgagtgtgttgtgcttattatccctctcagtgccatcataaaatgtcaaaaaagatttctccacttttttaattgcttaaaaatggcatgccgcggcatttgtcgcatccccaaccttttcatcgtgccatcaaaatgtccgtttcgcggatttgtcatgccttcgttcgtccatcatttccatttctttcattcacttccccctccccatttcattgcgttaataatggtcagtcaactcgtcgtcgagtgaatgaatgaatgcgttggcttgaccattccattctctgtgacaaatgatgtgccaatgccgtcctccccctccatggtgccctaatttatttattttcgcaatgttgcctcgggcatgttccgttcccccacccccctttcttctcccttttttctgcgtccattggggactcggtttatccccaggccaaaaaggcccccttaatcttcaatttttatcctctcccctgaccacacatctgcatcatgccttcatcatcatcatccacttttccattttctctcatttttgcataaacacacatttaccacggcgaccacaccgttgttgcatgcacacacaacacattccctcaattccatgctcattnttgttgtgtttccaactgcttcccccttgtgctgatacctcctcccccccccctttctccatccctctaattttcttcaaatttttttccctttttgctttttttttcacaatgtgactatgtatanaacggaacaaaattccaaaattttagttggatatttcccatgaattttctcaatttcataaattggcaaatctaattttctttctcattttgaagttttgtggcaaatcatttttgaaaatgtatgaatgtatatattaggttttttgacaaaaaatgaattttaagcctcacctaatctccaaattataaattcggctttgaaaatttaaccttgtttaactatttaaaacaaaaaataaatttcccataatggtctttttccgtcccgtccacgcgttcgcctcgtctgttgtccccccccccaacccatcattctcaaaagcagctccttcctccgtgtttcccgttttcttcatcatcaccattttgttcatgcatgtgctctttgctcctgctgtgattagcaaaaaaaggcccttctcatcgcaattgt

SEQ ID NO: 28436 - DNA, 904 bp, Heterodera glycines
  misc_feature (23)..(24): n is a, c, g, or t
attcagatttcgaaacatgagcnntcataaagattccaaaaaattttgaggggattcggaatgccagccctggtgccgaggactgctgctgctgctgctgctggtgaccttgattaataattgaatggaattgtacaatgcccttgttgctggcaaaaaatcccaaaataattcaattaaatgacaattttgccatataattcttttgaaaattaaaaattcttttttattcttaagggtgtatttcttgtatttactgtgcatttttgttaagaatttataagaaaaaatccaataattcttgtatttactgtgcatttttgttaagaatttataagaaaaaatccaataattacaaaaaataatgacaccaaataatggcaattttgtcgctccattctagagtgcagcgggaccggacctgaacacggacaactgagtacaactgagtaccaaggtcccggttttgaccgggaccgggaaattcccggctttttcccggttttcccagccaaaaagtcccggtttttcaacccaaaaagtcccggtcttgcccaaatttcccggtcccgtggcactctactccattcctttcacatttttgtggctttgttgtctgtcgtcaattcaaactcggttttccgcttgttaagatcgcctcgctggaattctgttcagaggcattgtctggcaaattgtgcgatttatttgtttgattttgtttggttttttcaaataagtttcaattaagaattgtaagaaattttattacacataaaaatttattttcattaaaattatacaaaaaaattgcggtaattaatttggatatataatttattttcatcatttcaacttccttaatgatgcctaccaaaattggcaaaacaaacaattaaattgt

SEQ ID NO: 28437 - DNA, 812 bp, Heterodera glycines
  misc_feature (9)..(10): n is a, c, g, or t
ggaaaattnnttcagaatttttaatgaattttgttaagaaaatggatacatttttcagaaatttctctctttttctccttcgccggcgaccccccccccaccattttttatatgtgccaatttgttaaaaaaggcattcaattacaaatgtagatctccaatctttcaaaaatgccttcctttcattttccagtacagtccttgaatttctgtttaaaaaaaaaattttttttttttggttgattttcattggaaatgcagcacattgccccattaattttaaaagtttggaagttttcaaatggcactattaaaatatcaaaataattttcaggtgggcccatcggttggccaaattttgaggatggcacgtgacaagggccaaaacataacgccacagatgatccaagcgggtgtgtgtgtgtgtgtgtgtttgccaattctttgaatggaacagagccaaaaacaaacaaaacaaaaaattttagccatgcaaacgcaactgttgcaacagcaacaaaagctgaaatcgcatcaaattttggctgctgcggccgcaaaattgccaccggcggcgacaatggccaaccaacagagggcactgatcaacaacggggccaggcagcagcaccagcaacaacaacagcaaatggtaaaatatagtatatgctatatgacaacgacaacaaaaaaaatttacattttacgaaaagcctggcaatttttttaatcaaaaagagagaaatctcagcattttacagaaaccacaaacaaaccaaaccaaaaatcgatagtaacttggccatcaaatt

SEQ ID NO: 28438 - DNA, 1669 bp, Heterodera glycines
tgttcgtcgccgggcactccattctgcgcacgttcttcagtggaattgtccgagtccgagtgttcgtcgccgggcactccattctgcgcacgttcttcagtggaattgtccgagtccgcgtgttcgtcgccgggcactccattctgcgcacgttcttcagtggcattgtccgagtgttcgtcgccggggactccattctgcgcacgttcttcagtggaattgtccgagtccgagtgttcgtcgccggggactccattctgcgcacgttcttcagtggcattgtccgagtgttcgtcgccgggcactccattctgcgcacgttcttcagtggcattgtccgagtgttcgtcgccgggcactccattctgcgcacgttcttcagtggaattgtccgagtccgagtgttcgtcgccggggactccgtcctgctgctgttcgctcactacattgttcgtcccagcagcaataatttcctgaaatttgaaaatttttttgttaaactgtggtaaataatgcattattacttccttcttcttcttcttatccgtgtcgcgcatttggacgaatatcggcagagggaggcaagtgctgatattggagaataaggcaatggaagagccaaatagggaggcaaattctgatattggagaataaggcaaatggaagaaaccctaacaatttcttacttatatactcttcccacgctagtgagggaagaactgctgggttgccgattaatgactaaattttatttatggcaaatacataggtattcaaaaaataggtacttggcttaatgttctttgaataaaaaaatacaatgggcggctcctgcgggatcccgcacaaaaaaccatatttggggatttcgctacgggtttaggattaaacatttcaaacaaaaaaattatcggcatttgaaataaagctaacaaataagttcaaggagtgtaaatttgttattgcttagactattggcaatgttttaatcctgaacaaaaactgaaccacttaaaattatgcaacaacaaaagtacggcaaaactgttggtcaaacagctcgaatttgacggaggaggctgccatttgcagcaaattgcaaaagtggagggcggaagagacttaagtgagtggaaagggaaaaagtcaaattacaaatggaagaagtgcccacaaaaataagtagctagacaatttatataagattgttgcatttttgctaaaatttcagcacttttgctgtttaatgcccccaaaaaaatccaaaaagtgggtccttgtgttttgttaaaaaatttttttgtcattagtcgagaaaattttcacggggatttcggagcgctaaaacgaacctgacagctcttttgcaattccaaatctcttcaaaaaggtcctcattatagatttttctggtgccctaaacagcaaaaatgccaaaaaaaaaattctcggctcggaatctttgtttcaaaagtctggcaattttttaacgctctgtttaatagaaaaaataatagtgtccaacttcaactcctaaatgttcaactccggctaacaccgatgcgaatttgacgacgagatcaacgccgacggcaccaacaaattattcgccgttgacacaattggacgagcgacaagcacgtggaagcaatgacgacaaatggtgaca

SEQ ID NO: 28439 - DNA, 1306 bp, Heterodera glycines
aacgaacacatttccaaaccgcagaaccccgttgaagaagaaatcctcttagacaaagcaatcagccaaatgcaatccttccgaaaacaattccctcaattatttaattaatagttctgctatgacctccaacaatttctctaaaaacttcaaatcttctcaataaaactctccacaaaaatttttttctctccaattccaaaaaaaacttgatttacctttattggaggtctgacttctccacttcaactcaaattcaattatcgtttgttacaactattcattttatcccatttcttatttccaaatgacatttaacttcttcactattaacttgcccttatttccaccaaaagtataagcggcagcaatgcccttcttttggttctttttattttaaataaataaatgcctacctcacccaaatttctcaaaaaaattgactattttttccaaaaatccataaaaattgactcaaaaccgcaattgtcatttttaggtgaaaatctgaaacgaatcacacaaaaaagtagtatgaaaaaaaggtgccgtcaaaatgattttgtatgaccggatatgaattttaataccctctcatttttgcgttgtccctctctctacccaatatgtttttatcaaaaccaaattcttcaatataaatggatatttttatttttatgccaaattggtttaggctgaattgctggcatttaatttttgcttctgcgtattttcttcttaagtaataagtcctgtcgaaccaatataatgaaataggggttctaatttcggaaaccgggaattattgtttcgtttattacagattctatctgccggtatgaaattagtcctaattttttaattcatgaaaataaaagtctcaaaacgagatgaaaatgattaattaactaaggtaaataaatacataaaatagaaaaaaactagaaccaatttagaaccgttttttaacattaaattttaaaaaattcctaaacccttattatacatttaaacgccgttgaaaactattcatttgtttatttgaaaaaacaatttttttttttaatttttattctataatttttttattcatttatctgattttcttgggtctcagcttcattgaatcccattaaatttgttttgacggtgaagctttgccacgtttgctctccataaaaatgtccattatattgaattggcaatatttatgaaaatggaggggagaatatatttgttaatatttttattgtaaaggagataggaggaatagtagtaatttgaatttacatttttatacattaat

SEQ ID NO: 28440 - DNA, 911 bp, Heterodera glycines
  misc_feature (4)..(4): n is a, c, g, or t
ttantgtattacacgctactcgcttaataaaacaagactcatcttctaatgaattgcagtctaaatgattctgacccaattttcatgtattttaataacaatgtaaaatttaagcatcttcaaatataaaagttaaataaaaattcatatgaattaattcatgatatccacccacttctccatcctctgaattaacatcaggcgagttttcatcttgcacttcattcaaacccatttcttcaaagtattgatcaacaagcagcccattttcatccaaactttgttcaagcaaaagccttgcatcttcttcaattatcatttcttcagcttcattacggtttgacggcggattgaagccaaccaaatgtccaattcttccataataattagacatggcttcaacaaattcatcattgcagtaatccgtattcaaaaaagccaaaatatccgccttcgctgaggcaattcctctgtccaattcaagagttaattcaagcgggcgagctggcaattgtcttccttcatcaacggccactgcggtttcttcttcagcatgacttagttcctatcatttacgatacaaaagttagagacaaacaagtacctgaaaactcgctatccatctgccgagcaagaaaccaggctggtacaagcgttgctgtcgtccgtggtaagactcagcatggttgatggttcgatgccgaacaacgtcaaaaagtgcaaaaaagtgcagccctattctgttgttgatccatgtgttgttctgtatatttggtgttgtctaagtagttttacatttatttacgcagtaatcgagaacttcactcaatgcgccctgttgtaaagttttccatggggagtgtgtgatgagatggcgcgtgagttgaagcgaacgggctaaatagttggga

SEQ ID NO: 28441 - DNA, 949 bp, Heterodera glycines
cccctctgccatgctgggaacatttgtatggtacaaaattcctcacaaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaa

SEQ ID NO: 28442 - DNA, 1169 bp, Heterodera glycines
  misc_feature (1165)..(1165): n is a, c, g, or t
gtccgagtatcggctcccaaaagggaggccgatgaccaaggtaaaccaaagtgctgaacatgtggccaaaaacatgctcaaattgcaataaagcaaacgagttatagtccagcgtgtgtggcactttacagatgtcgccccgttcccatctgcactttaaaaggaatgcacaaacacaaaagtgctgccacctggactaaagggagggaggagggatgacgtgcgagttagggcacttccggtttccattgcattgaaatatgcaatgtgtctgctcatttcacgagcgaaaccaagtgcatgtcggctgacgcaaagaccctaacacaatttcaagcttaacacgaaacacattacatataagataaaacttataagaaaaatcggtgaaattccgatcaattaattatttccgatcttatgttaattccgattaacttttatttttgttcattaagccaattttttacatgttacatgtaaacggagggagttcattgtatatgttacatgttactacacttattagcccatctttattattcgatccaacaattattccaaattccatgtaatcaaaaagtccgcgctttattgctcttaaaaatttttcagactattacaagtcatatgtaaatcaaactccatataatttttttgttcattaatgtaaacggagggagttcatgtatatgttacatgttactacacttattagaccatctctattattcgatccaataattattccgaattccatgtaatcaagcgctttattgctctataaaaaatttaatttcatacttttacaagtcatatgtaaatgaaaattccatataatttatttttgttcattaagccaattttttacatgttacatgtaaacggagggagttcattgtatatgttacatgttactacacttattttttaatttctcttttgttcattaatgacaaaattagttatttgttacatgttacatggaaacataacttcctttggtccaccccaagttacatataagataaaacttataagaaaaatcggtgaaattccgatcaataattatttcggatcttatgttaattccgattaacttttatgctttctattcaccaaggtatatccaaatcaaggttaattccgattcgctcttatgctntcag

SEQ ID NO: 28443 - DNA, 1699 bp, Heterodera glycines
  misc_feature (244)..(244): n is a, c, g, or t
agaccaaatttacttttcatagactttgtcttttgaaattttatttcgtttcggtcgttagcttttttttttgtattttttgcattaattaaataatttttacaaattaatttttgtgtcaaaaggcgtccgtccgttatgaaaatgcttttgggcgctgctgccattttggcatttgcttctgctgactttgtattcgtgggtggcaatcaaatggaatttgatccgacggcggtgaattctntatttcctttcaattctttgcctttttgttgccatttgtccgttttcatttgtccgttttcatttgtccgtttttatttgtccgtccgtccctttcagccgatgttccccgattctcagttcatcgatttgatttcgcgtgacatcgaatcattctccggcccaatggcttttggccacaaatttatgagcggtgtggcccattaattgattaattatctttttaattaaatattgtccccttaattcattattaatttgtttcgttttgggcggtgccggcgaaggcgaccaacagctcggccccgacggacccttcgagcatcggcagcaagtgaaaagtgacagcgtactgcccgcttattgtgagccgccgaatccgtgtcccgttgggtacagtgaaaaggacggatgcatggaacagtttgataatacggtagggaaatggaggagtggggggagtacggtaagaaaaaggaaagagcgagatgaaggagagggaggagtgagaggaaagagacgggatagaagaaagagaaaggattaagagagagagaggtgaaagaggagggatagaaagaaagaggattgagagagagacggagatacagtaatggaaaagggcagtcatcaaaaacgattaacgctttaattgagcagtatttaaggccgaattctcgcgcagttaccaaggccagcagcagtgcctatgtgaccaggaacacatgttcaagtgagaaatgggttaaccaattagagaggcaaagcagctccaaattattgtgcactgtccctttgattacggcacttaaacggtccctttgaagttgcccgtcaaaggaaaacgccgaagagtacgcgcagggcctggagcaactgcttgcggacaacggactgcacaaatcgtacgggcctaagcacaaagcacgaattaacactaattgtcccctttgttttgcagaatgatcgccaaaaagttccatctgacgcgagcggaggtgcgcaattaaatacgctaatgactacagcaaattaccgccactttcccgcaaggaaccgcgccgtcggaaacgctccgtcgcttttgttggcccggcacacgcgacgcacagccgctacaacccgtacttggagggcattccgctgaagtcggttgccaaaaaggacggacgaaacttgaaaatgtgaaacaaacggggcagacggaaagcgcacgcgaccactggcgatcggatttcgtcggatcgaatttttttttgtttttacccctccccctaaaaaatgagccccttcccctcccgccccccactctccgctgtagtctctctcttccttcgaatgagttaatgacgaatggattggctaatcggtgataaattacgagtttaattggccctaattggcccatccattacaaaaagaaacaatggacaaattttaaaattaatgttcataa

SEQ ID NO: 28444 - DNA, 831 bp, Heterodera glycines
ttgcactttaggcacccaatcgaattagttggtaatttcttttttaatcttattctttaatcgtttgttaattcagtgattaattaatatagtgcaaattagttaaatatcgaatgggttttcaattcacatcaatttggcaacgtgcaatgaaaaatggattacgtcaccttcatactaataacccctaactcttgcagtatcaaatacatgttccgtctctatcacaataaaaaaatactatcatattcttgatgaaatgcggtcatataatgctgtgaatcaaaaatttttaaactaaattttttaaaattattttcatcaaaaattactcgtaaaaaaagctttatcggacgcctgagtgcagtagagtcagaatacaacctggttgttgaattggttgcacgggaaggccgcgatttcgagtcccttcgacttgtatttgtccagcaactgcttcagctgactgtagttggagtcggtgaagccgcagttcgacgctacgttgaccaccaacagcactttgccacggtatttgccaaagctggtctcattgccgtcaatgtctttggccgaaaattcataaatgcttttttgctgcgggtccgatggggcggcagaagacgaagaactcattgcacccataaacttgatgttgagtggtgacaagaattttaaaggcaatacgaatcgctttaacatttttcgcattaaatcaaatgataaaactgttatcaaataaatggagattatagaaaagcgaaatattcccaatagcaaggaatagttttattatgggattcaccgcccaccggtaggggtcaactccgt

SEQ ID NO: 28445 - DNA, 1526 bp, Heterodera glycines
ctaaaagtacgattaattaattactaattacgtgttcgaacttacgccctttggggtggggggggggtgggagtcagcggccaattttgcgattttctcaaaaagtgaacaaattttgtttttaagccagttttaagaaaattcacaggcggcgccgacaggcgccagcggtaaaaattgggtttttttgtgcgtaataactgattttagacaaaaagacttttttatagaaaatatagttgaatgatacggtgctaagtcgaacctaaaaaagtttaaaatacgtttattggctttttattggagcaaattggcatgatatttgcgcattcctgtttctcataatttaattatttgttcttcaattaaataattaaatcttttgtcctgcttgtgttttttttgtcggtttttaatgcattttttaagtctgtttaagcaaaacatattaatgaaaatatttgcttcaaaggattatattttttcattgaattatatttaattgtacaataaaaacaacggtattaaattatttaaaaaaagcaattaagatcttacattattttgcatattttattttgatttaaagaaataataatagttaaaaacttttaagtttttatatcaaaagtaaagacttattatgtgctatattacttttgttttaattttatatttgattatgtcattaaaaatttattaaataaattaacggaacggaacgtaagagaaaaatttctgaataagtcgttaattttaaaattatttttaataacaaatagaaagaaatattatttattttataatcttaataattattaaataactgttaaaaagaatatcaatttttttgtttatttaataataagcttgtatataaaacataattgcatttatttaaattttgggttaattttttttaataaaattgtttaaaatcataataattgcatccggtgttagtcaaataactgaaaatgctttttttaaatttttacaaaaaaactaagaatgaattgaatggattaattaatttcttacttggattaaaaaaatttaaataaaaatgtaaaaaaaaatccaaaaaaatctttctaaatgcatatattattgagcaaaacaaaaaataacataactaaattgactaataaaaattaactcatttttgcaaatgactaaattaattattaacacaaaataaattaattggtttttaaacctttaattcactaaagaacttattaaaaaatgaatacaaaaatagcaaatattcgagtaaaaccgtatatatttttcaattatgataaatcgagtaaacctcttatgatttataatattgtttttaaaatagttttacaaaataaaatgattgaacgaaatggcgataatgatataatattaattatttaaacttcaaaaaaaattggtaaaatatacattttagtaagcgaggatattgattgttttagtaaattaaaaaactaataattatttaaataaaaggttaaaaattattttagtcaaat

SEQ ID NO: 28446 - DNA, 865 bp, Heterodera glycines
aaattaatgaaaaaaatttttaaatttcgtccacagctctgaatctgccatttttgccctattttttctatttttctcgcgatttctgcttatattttaggatttttcgacccaaaaaatcattcaaagctttattctgatcataaattactattaacaattttttgataagtttttttaataaaaattttaaaaattaaagaaaaaaaattaatttttgaaaattacggattgcggattacgggaaataaaataattctcggtaaattcaattcgagaacttgctaagcctagacagatagatattaactcaaacatctaaaaaaaattttaatttaaagttggtgtcggattttccggctcccgacggcgggaggcgtcaatggcaactcgtacaaagtcaactcgtataatttttaatgggtgtggccatatcttttttttaagtcaaccaaattcttcaaatttgatatcattcgaatgctctccatgtttagaagcaatgattaagcagaagctaagagattaagcatctcacaaaaaagttatctttactggtctatttaggacgctgatcacgaatacgtaatcagattttacttagacttcgtcaagacctcagaatccctgtgtgattgggattctggggcatcattttgaggggggggggggcaagttcggatccggacggagtacattaattttctaccatttattttggggttttcaatttttattcatttaaaaaattttttattttattaataataaagaaaaaattttcatttgaattaaattattttttgggtgaaaaattttatttaaaaaaaattttttaaatttttgaatttaaaaaattaaagaa

SEQ ID NO: 28447 - DNA, 1702 bp, Heterodera glycines
acgcgcattagccatggtcccatttgtttgagcaaatggtggtcaaatgccatgttcactcggcaacgagcccatcgccgacttcgaccaagaaaatggagcaaatcgtaaagcaattcttgtgggagacgtatgccggtggccattttgaagagtggagaattttgtattatggtgagcaatgggcgtaggagggggcaatttggggcttataaatgagtgggcaaatgcttaaaaggtgctaaatcatttccaaaattcgctaacatggcataatttatttaaaataacaaaattttacattattgatgatatcatctaataacttctttatctagtgaaattttaggatagaaagagcaaaaatttactaccgaatcaaagtaaaaatataaaattttgttacttttaagcaaatttatgccatatttttccgatagttaagatggcatttttacgaaatgacttagaagtgtggctgaaatgatgctgtccgcctcccagaaggcaaatcaatgaatggaatcaatgaatgccgtaattggatatagaaaaaatgcccgacacgaccgacgatggcatttattataaaaattaaaaacataaaaatgaaaacccatcgcaaataaatgaattaaaatttatacgatttatccggtataatatgtgtatatgcgtatgaaataaaagagtgaatacattattagggatgcaaaaaatatgcacataaaacatgtaccaaaaattgcaaaatatgcactaaaaaattaaaaaatgcatataaatttttcaaattgggggaaatgttcgaaaattctccaaattcgttaaacataagctaaaaatctcgaaaagactaaatatggtatgaaaaatccttttataagataaattataaaatcaacctaaaatttataaattttaaagaaaattgagtaaaaaaccgaaaattttccattattttagcataaatttccaaaattaagtaaaaaccgaaacttttccatttttggacttattttggcataaatttccaattttttcaagttgtattttaaatacaaaaatgaaaatttttgaaaaattcaaaatatgcatatggaaatatgtcctataattcatggctcccacagtccacaaaaattatatgcatttgcatttaatttgcatccctatgaattaggttcttagaagtctttatagtacgaccgtgtcttttcgtcatatctgactacattttgtgcgctgtattcctctcggaactgctgcatgcctgtttaaaaattttatggcattaatacttcataatggaaataatggaaattgatcagtaccattaattaattaattaatcaattaattaattggctgggaattacatttaatattttggcaaaaatatatttatttctatattttgcacttttattttatgagtttctgtacaatatttcgtcattttttcgtatatatttatttaaatatttctgggattcttaataaatgtaattccgagccctattaataaattataagcgcaaaattttcttccaatgacttacggcctaagatcaactgtaattcagtttcattggcggctgatttagtccaaattcgaatggaatttttcgcactggcaaaaaggtccgttcctcatcttccatatccttctttactttcttctttggctttcttttctgtg

SEQ ID NO: 28448 - DNA, 1080 bp, Heterodera glycines
gtaaagcatgctttgactatgtggccaagatatcgcagaaggacaacaacagttcgatgaagaacaaagtgaacgcttttctgactgaagtggccgaacgaatccatcggttgaaacacgtacagaggacgacgacgcaccggtaaaagcaagggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaaagccactaatccgaataattggtagcaccgctgctgttcagatggagcgcctttctgctctattttggctatgcccccggcgatgtgaaggaccaaaagccgttgaacgtgttcaaaatggtcattgaatttgcgttggagtaccggacgagcaggtcgaaaaccaaaaactaatggcaaaactcaaatcgttttaatcgcaccatttccagggacaaaattctgcaaacgcggaaacgcctgcaggagaagcgagagcggaacaaaacgcgcgggatgatgatcggcgcggcacagaacgcggcggtgcagcggaaacggtccggcggtgtcggacgcggcggcggcggtggcgaagtgccattgacagacaaagaggcaaatcggggcatgaagctatgacaattgggtgttatgccattatagcgtcatcaagaaatgtcgcgcattttggccggagggggcgctgccaacggagacgaaacgctgctacgaaaacggatcggaccgggcacagcggtggcggtggacaagtcgagaatcgcggcacaaacggaaggtaatacggcacggacaaacggaaatggcaccttccaattttttggcattttagcaatgaaaaacggtgccggaattacgactggcgtcgccgctgatgacgacgaactgcttgacggcgttgt

SEQ ID NO: 28449 - DNA, 2001 bp, Heterodera glycines
caccaattggggccctgaacaaaagtgccacctacagattgtttcaaatttgcattaatctcagccgacggatcagcagcgatcaaatggcactcagggtaaattttgatcagttcccgttcagctctaaccgtatgtccaacacctgcaaaaatttcaaaatttagactaatttttattttcttttttaggtttgtaccgaatgtgacaactgtgcaagttcgcttttgaagattgacattgggacaaaagcgcataaaatatttaaactcatcacttgaattcaattttagaatgttcgctttgttcatttgctctttccaaatttgctaaaaagcaaaaaattaaatcaaaaatattattaaatatatttaacatgagtaagtataataggtaattaattagttaattatcccgaacattgaaatgcggttgaatttgtgtccacgtgccgttcacatctatggaaccgtccttaagccgaacatcgactaaaccacgctgctgtttggcaagtgccgcaagaaaatttgtatcattaacctttggacattctaactaaaaaagtgacaaaaaataaaataatttaatttctctataaaattaaaaaactaagctgaaaaaacttatattttaatttttctaataaatttttacatttttacattaatttttgacataatcaaattataattatgtacaaaatgaattcaaaaaaactgctaaatttcattgctattctcttcttacttttggaaaaaaatagtaatgggtccataaaatattaaattaaattaattttgaccttttttgaaatatttttcgatgagtcaaccgttcggatcaaagcatatacaaaagcagcaattaacatcattaaaatgcatttcatgaacagtccaagccatttgctgcttttgctttggaaaattattcggtgttcgaatcggtcgtcgtttaattgcgccatcggagtgtattcagtgtttgaattggtcatttggagactgtcgatttgatttcaacgaattaaattttaattatcctttatgattttggcggtttttgtattttaaaatattatttccaaaatttttgcagaattttgctaattttaaaaatttaattaaataaaatgattaaatgtatattttttttcaatcaaaaacatacatgaaaaaagggatgggtcaaccaacggccggtggtgccgaaaacgccgccgggattgaatttaagccaatctatgaatttatatattttacccacatttttgttttcaaacccactggcggatttaggaaacgcaccagcaccactcaaaatcggatagatttttgtgcgaaaattgtttgattttcattaatagtgaatgatttgcgaaatgataaaaacatacgaaactcaaaagattttaatcttgaacaaaaaatcgcaacagaagtgtttaatgacctaattaattttttatagtatgaacaacggcgcgagtgtattattttttgaaaaatgcatatttgctggaccgtttcttgaactcttttgaaaaaaattatataacctttaaaaccaaatttgaaaataaaataaaaatgaaaacaaatttagatgtatttaagcttttcacgatgttatcgctcaagaagttttgttgccatttcattgccagcaatcatttttcttatagcgattgcaaaatcaaaattatttgcaaaatttgaccattacggtaaagtttgttttttccttttttgagttcttttttggttctagtcggttttacgcgtcccatgaatgaccacactcagtttcttaggcattacttttttcatagttcgtcaatgcctttttcttggtatcaatcgaaagcttgaagactcgggatcttaaaatgcaagaaaaggacaaatattggcattaagagaaagattacaatgggaacacttgaaattcagcttttttgaagtatattcgagaacttcattttgtctattttctttt

SEQ ID NO: 28450 - DNA, 601 bp, Heterodera glycines
aatgtcctttttatgccaattgcctttttcactgttgccatccgttttggggatgttgtcactaacggccccaggttttgggtggatttttggactgtgggagtatccgcgggaggacaaaaagtctatgtttggagcccaatgtcctgacaacatcctgaaaactgttttaaacacttggtattttattacaatgtcagacaatcataaaattagagttccttttttccttttcgattaaaagaaaaaaaaagcacaaaaaaattgctttctctcccaattaattaattacaattgtacgaattatttcttcccatttgtattttttgtacgctttaatcgttttctgttttttttgtgccgtaactttcgatttttagtgatcatttattgtatttcacccattgtgatccaatgatgaatgttacggcacaagcatttgttttaatatgaacttttcaatgcaaattcccccccccccctccaattgataccttttcacttattcgtttgtgccgccccccgtcttttgatgttgccttccccccccccccgcttttccctccctccctcttgcccttcacgccgcttttcctctttt

SEQ ID NO: 28451 - DNA, 1539 bp, Heterodera glycines
ctgacgagttatgggcccaggactcaaatgtcccgctgaggtcaaaaattttttctatttctggaaaaaaatcgaaaattttccaaaaaaattaccaatcgatagagctcgaaaaactatgttttggaagtggtctccgtttttctgggaaaattcgttaaaaaatcataaaattaaaaaacccgaaaaccgttttttaggcctaactcgaaaaattttgaaaattttcgaaattttaaaatctggaaaaatcgagcttattgaactctacaataagtctgctggccaccctgcgctcaggtcaaaccctaatgagttattcggctggtactgaagtgggaaaaaaaaaaaataactgagtctccgtgtctgtacaggtccgggatttggtctgatcaaaaaataaaaaatactggattatagaggacacttctgcggagtgccctcacagcgggaattttttgatccgagtttcagaaaaaaagttatgggccgtcaaacgcacgaaaaaatgagaaatccgtccctgggactcagtcgtccacgctgattttttctctatagttttcccagatgcgcctcaaaaagttgtaagacccttccaccactttcagggcgctcccggccttcggccgggagaaaatggttttagcaacgaaactccttgtcaatataacgtatatattaactagcgggtgcgtgaaccgtcggatctggcacagggataaagcgcttcgcgcttcttgagcttcgctacctaggctgtgaagcgattcaaattgatcgaattggttggagagatttttttgaatttttaaaaaattataaggggtttttagtccacatcgaggctcaagacgggcgcttcgcgcccttcgcgtcctcgaacgggcgcttcacgcccgtttctaatttttgttgtgcttttcggccgcttcgcggccgttttttaaattgtgttgagtcggacgggcgcttcgcgcccgttatttatgggttgtggagtaattgttggatccgaagcaatttgggattgatcaaatagaggtaaagggtgcttcgtttccctttttaaattttgttgggctcagacgggcgcttcgcgcccgttttttaaatttgttttggccatacgggcgcttcgcgccgttttttaaattttgttggactcagacgggcgcttcgcgcccgttttcaaattttattgggcttgggcgggcgcttcgcgccctagaagaggtacaacagcgattagaagagtgattagaagaggtacaacagtgattagaagaggtacaacagtgattagaagagtgattaaaagaggttcaacagtgattagaagaggtacaacagtgattagaagaggtacaacagcgattagaagagtgattagaagaggtacaacagtgattagaagaggtacaacagtgattagaagaggtacaacagcgattagaagagtgattagaagaagtacaacagtgattagaagaggtacaacagtgattagaagaggtacaacagcgattagaagag

SEQ ID NO: 28452 - DNA, 1821 bp, Heterodera glycines
  misc_feature (39)..(39): n is a, c, g, or t
  misc_feature (59)..(59): n is a, c, g, or t
tcaaatcatcatcgccaaagaaaaactcttcaattgcgncgtcagtattttgcaaatgnagtttggcgggtctggcaggccaaaatgcacacagcttaagttaaagcagctgtgcagccgccaatcaaggtcggctagggcttcaagctctgctgctttatgctgtgccggagtaataatgccttgcggattgtacatttggtctttgtacttgttccacaattctatggcattactcggctggccatagaccatgatgctcacaaaaagccatctcatctgatctggccagcgcgacagagctgcctccgccagagttttgtcccaaattttgccgtcttcaagaagaccatgcattattgcagcatcagtgaatgaggtacaaagcaacccattaaccatcttaagatgatctggatctccaggaaagtgacgcataagtgaatagagcgcgaacctttccgggtccgatgggggtacaggaacaattcggccgataggtggcctttttatttgctgccttttgtacaggacccatttgtcctttgcccatcggaactgctctgggactttttcaaaaagaatgtccttaaactttgggtcattcttccactcattttgccattgtttccaatatgctgaacaatgcgtttctggcagttcgccttgctggatttgttgagctttgctcaccagctggaatgccctatatacaatgggctgttggtttggcaaatgaattgccaatttgacaacatgatgtgaaagacgggcaaatggcattgaatgaacaatggcatatgcttccgttgcaccacggaagttcatcttggcatattgagccggctcatcaattccgattttattgccggactcttctttgcactcgacataacaatgtcctggccctttaaacgggtacttgagtgcgtacttaatattcgctttgttaccatatgcaaacagtacattatggtgtactcggtaacgcagcagaacataaggattatacggcacgacatgtgagttgtcgtatattaggccgtttacctctaattgggcaccaccatcagatggtgaaggccggaaatacatcgcgggcctatccgggcgtaaaacagtacattttgagtaaggggctgggaaccccttcttgcaccgcccgtaaattgggtcgctaggaccacaccaactgtcactgcatctgtgcagttgcatatgcattgtttcgcggatttcgcgatgcattttcgcaatgggcgtgtcgtcatctttatcgggcaaagatggaatgtgcgcccatatgtattcctgaatgacatgtggtactgcgtccaggtcagtttgggcaacaatgtgagcgtgtgggcctcctcgaccttggaactccatggattcaccatatccaaggattgttccaaagaactttttctcataaagttcttctcggaactcggcgatgttgctggtccagacacgcatccacatgtcaaaacggtcagtaaatacttgaccatttttatatatattctctttgaactcaggccattccctgttgttcgtgaatgtgatgaagagacgcgcctttttcgcgtcatggcaccgtgcaaaaacggtgttgcaatcctcatacattttcttccaatattggagagaatttacgttgtgctcggacagccgaacaacactgccaatgtcatcaacagttttctgttgggcattggggttttgccgtgcttgctgcctgttgtattggttgaccaaatactgcagcaaattttttggagtgctgatccgcaggtccatgtctggtctgcgcaa

SEQ ID NO: 28453 - DNA, 1294 bp, Heterodera glycines
ttgaaatttgtgactaaatttgaagaagcaaattttatagtaataatcagtttttgcaaaattgtgaatgcgaaattatgaaaataaattaattaattcattgaatgatttcccacacattctgtgctatccatttctgattcatcacatttattatcatttgatttaatagctaaatgatttgttatcaaatttattatttattgactttcccataaaaggcgaaaaaaaagttaaaaaatgaagaataaattaattctttttttttgttgtggaaatatgacgaaaaagtaaataaaattgtttgaaattggcaagtgaaaaataacaaaatttaggaaaaaaaattaaacacaataaaatagtttgtctttaatttgttaaaaataaaaatgtcgcgtatcggaaacgaaagtgaattctttcaaattttcaaaatatttcactaagaaaataaaaactattagagaccggacgggacttctggtactgagtcgcctaataaaaattttaaaaaattctcaaaatatctctcctgttaatattaatgcgcgctaaatttgttttatacccgattcttttaaagaaaagttattacgaaaaccctgtttttaaaaatccggaaaaatctcggttagcgctcagtttatgggtctttattctcctggtttaaagcgttttaaccatccgctggctaatctttacagttagaagactcatgaaaattacgtgattttagaaaatttcaaaatttaaaggataatttttaaaataataaaatacattaatttaaatatttattgtcaatcttttttcaaaaaaaaagtcatataaaattagcagatgctaattgaaattcatgtgttacttagaatacattgaaggctgacttctaaaataatttattggttgggaaaagccttaaaaacaaaatgtagaaaattttcttaaaaaacatataataacaaattagaaaattctggcaaattgatcaaaaatttaagtgaaatttttaaataatatattaatgagcaaattaaagttgcaaatttacttaaaaaattattaccaatttttcgttagacgacaatgcctagaaccaaagccttttggcacttcgcttcttcaagtggtttgcagaggaacacggtgtggtggttcaaacggctcactcaccggaaggagaaaagaggattggccattacagcctttatggatggatccaggccgagcggagggccatcgaagtgaatggtaattgattttttttttggattatgcgtttcatttgaaa

SEQ ID NO: 28454 - DNA, 1566 bp, Heterodera glycines
ttctccctcattcatttgttgtgttccaatttattgtgccctgctcccttccctcgctatttattatatttatttgtgtgaaataaatcatatttatttccttgactgttgaacggacacaacaatccgtttgattatattttgattgaatttatttaataaaatatattattaataataaataaaaaaatttctgctaaaatccttgttttcttgtacaatttttttgacattcttagaaaagctgtcaaaaattaatttgggtgtcaaaaagccagtcactaataaggaaattgtatgattaattgttctctattttaaatttatgccattgcttttgttcatgaccaaagtcatcgtctcaactcggtgggtggcgtctgagttcttcgccactcctcctatgaaaataagtcaaatttctggggctttactcaaacgaaagtttgagcttttttgttagggatccagcaggacccgcattgctttttggaatgccaaataagttcgattaaataaagccatttttttaaatccttaaatttttttcaaaagttgttaggtaaattttagttttttgggatatttttttaatttaattctaatttttttcgaaattttcaaaattccatgctggatcctgtaagttttaaatgcaggatttgcggaataatcacgcggaatacgtatcttgtttgtaaaaattttgacttaaccaatcccttgctgaatgcgaaaattttagttatgacttactaatattattgttcgatgttcgggaaaattatcatcaataaaaattttaaattaaaaaaacttttaaattgcatattcctaatgtatttggttgtctatttattgttcccattcactctccaatcacattttgtaagataaccatttttctcagttttatttaaggcatgagtcttttgaaaattcatgaaaataaattggaaaatataaccattagggctgccaaaaatatgtacaaaaagtggtcaaaatatgtgggtcctacccaaatcgtcccttccataacgtcaccacccaatacggcaccacccaaaatgacaccaacccaaaacggcaccattccaaaaggtcagcaacccaaaacgtcacaaatctagaccaatgattaaatttaagcaaaaaggatcagtcaaactaacattattttaaatcaaaaaattattacaatataaaattgacaataaattactagggcttgtaattatatggaaatccatattttttttcctggactgtgggaggcctgaaacgcacgaaaaacatgtttttagcttagtttgaagcctataggacgtatttctaggttcacaaggcaggttcgtacaatgtcgtttcgtacaatttcaaatgggaatggccataacttttttgttggtcagttaatttcttcaagattggtatcattctaatctcatgtgtttaaaagctatcattaagcagaagctaagcgattaatcatctcaccaaaaagttatgatttattgtttacaaaaattaggattttccttgaaatttttaaatcttaaaaat

SEQ ID NO: 28455 - DNA, 1162 bp, Heterodera glycines
  misc_feature (99)..(99): n is a, c, g, or t
  misc_feature (1104)..(1104): n is a, c, g, or t
  misc_feature (1125)..(1125): n is a, c, g, or t
  misc_feature (1141)..(1141): n is a, c, g, or t
taagtaattttctgaaagagctcaaaagcagctttcgaatggtgtattcaattaattgtttacttgaaaattcacagagatatgtccaaccgaatctgnaaatgaataatggcgtagtattctataaaaaaattttttcttaggaattttacagtgcgcagggatttgaattatccataaacacatcatagggtaaatatctagcaaaaagaaatttttttacacaaaatcctagtccagcagacagatgaagcgacttaataaatcgattatggatttgcaagagttaatttctcaactcacactagctaacacggaatttgccgcgtgtaggcgtaaaatgagccattatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaattttttcttaggaattttacagtgcccagggatttgaattatccataaacacatcatagggtaaatatctagcaaaaagaaatttttttacacaaaatcctagtccagcagacagatgaagcgacttaataaatcgattatggatttgcaagagttaatttctcaactcacactagctaacacggaatttgccgcgtgtaggcgtaaaatgagccattatgaattacaatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaattttttcttaggaattttacagtgcccagggatttgaattatccataaacacatcatagggtaaatatctagcaaaaagaaatttttttacacaaaatcctagtccagcagacagatgaagcgacttaataaatcgattatggatttgcaaagagtaatttctncactcacactagctaacacgnaatttgccgcgtgtangcgtaaaatgagccattatga

SEQ ID NO: 28456 - DNA, 1146 bp, Heterodera glycines
  misc_feature (6)..(6): n is a, c, g, or t
aaaaantccggatccaattttaaaaacgaaaatagttcaccaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatgcttagacgaaaagaggaatttttagaaaagaacgcaccccatctgatattcccatttttctgtttcacaactggccaacggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaagaagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcacccttttctgctccataagaggtcagaggcgactgtgctcattgacgcgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcattgtacatcataattaaaagcgaaaataattttcgtatattttttcccaatttatttcaaaaaacaacaaaaaattgataaaatggttgaaacgaaaataatgcacaaaaaggggagggatggttaaaacaaaaaaaggaatttttaagaatgggacgcacccccatttgatatttccccttttt

SEQ ID NO: 28457 - DNA, 1487 bp, Heterodera glycines
attaaatttcgtttccactgactgcgaagaagcgcttctcatccaccgctttgtcattggagtacatcaacgtgtcgtgctctgatgcgccgttaattgccgggatttgctggcttttcggctttacggccactgcctccaaattggccaccaccaccgtttgcatgacggcgccgttcgttccggcctctgcgctcttccagctgcggtagatgtactgcgagcgcaactcgcacccgcgcaacgcgtattggtcggccggatcgccagcgatgcggcaacggatgaccgtggaacgatccatctgtatttgaaagcatttcatgctgctgatcagctatcgactcccgccattaaccatccgcatcgctccccactgaatctgatcgattgatcacctcattttctttcacttccttcgggtcgcatttggcacacgggtgctgatcactttctcccatttgccacgcattggtcttctgctgatcagttgggctgttctgctgatcactttgctgctgggcccaataccttaatttgattggttatgccaaagcattgtcaacaacaacaaaagagagcatactgttggcattgtgcgcattgcgcttgcggctgatcagcctggaaaccgttggccacgtcggcaatcttttggcactttttgaagttgatcgtcttggtcacattgaactggtgctgctgctgctgtccaatgcgttgcgctttgttgatggtgtacattgtttggcacgcgccttccaaggtgatctgagcaaaggttgggggactgattagcaaaccacgactaaagtgacaatcacctcttggattttgaacgatttgctctggcccgtcgcctcctgttgaaactgttcgacacgcgaagcgccgctttgatgcaagccctgtgcattgttttgcttcaggttcaactaaaaggaggaaattttggcaaacgaacttcaagcagttcggcatcagatgcccagtcacctggatgatcttcaacaccgcttttttgacatttttcgaccactcctccgcgtcctgggggcacggcacgcgttcgatcactccgtccgcgtagctgaattggcacggggtcagcagctgctgctttgtctgctccgcaatgttcgtatgctttacattttaaattatctaagtcatgccattgttgcgtgttcacctcatcaaatgcttccattatctgtacttcttgaggctgcgacattttgctgttctgttggcccacccggcactgctccagtcgcagctgtgcatgccgttcggatgcgaagtgaatgttggccaagcattggatgcgcgtcaccgccttttgctgcgagctggccgcgctttgttccgccgattggagaccggaggcaatttgggcgttgtagatgaagctgtactcagtgtccttctgctggaacggctccagcaaccgggcggcgcttttgtcgcccgactttgggccaaac

SEQ ID NO: 28458 - DNA, 2199 bp, Heterodera glycines
tttttaaaattaccaattttttccggcggcgcttttcgccatcgtccgactccaattctttcataattatttattctcccacaaaagtccttttgacaaccattataagctgtggcaatttctaattttaactttgacctctcttttcttacatttttttgggttttttcggtgccatccgtcgctttttttttttggtaaattccaacgctttgtaattacttaatttaaataattaaaaatccgccagtgttcgtcgtattattattattattaacattttttctcaaaatgaaatgtttgcgtcggtcgtcgcaattattttcgcattgtctacagaaatttgacactttgtccccttttggcaaatgaattggcaaaatgtgttgacaaatgtccgtccgtttgatgggaaaatgcggtgcccttttcattttctgctttttctgtgtgaactttttcccttaaattttgttttttcatcatttttatgtttattttcccttttaaatacgatttgctcccttttaaatttcattttttaaattttgacattggcattttaccctccccctttttctctgatggcactatcctcccctatttctcaatgttcttctgctgctgctgtttttgtcgaccaacacaaactccaactgctccggcaaccacggcactcttccctttcttcttctccctcttcctacagtaacccttccccgtacagtacgccttcttctgatgacagtataacatcatcgttgaaaatgcaatacaacggaagagatgagaataacgacgagggcgggcgatgggttgcgatggcacgggcagcggcggacgacgggggcggcacgggcggaggcgttttgtcaatgctgcaaaaaggtggggaaggggggaagacaggtcgagactctcgactgaattaattggaaacaaaggaatggccgaaactgatcagtcagtcagtgattggctgatcggggagcttttggttaagaaaacaatacaaatcattggccgatcaaattatcggcctaattatttaattgatcaatcattaaatggatactcccaattggtaagcttttgtttgttaagcattctgctccaatttgttcgcttcttcgtcgtccgccacctatcggtcggtgctgacgcgcgcttcgatggactcgggattggaactggacgaaatggaaaagaacagaagagacgagaggagaaagcgggacaaacggagagagcggacgagagaggaagaggaggaaaagataatggaagaaggagagagtggcagagagcgagagaatgaatcggagaaggcgaaaagtggagagacaacggcggacgcagagagcgaagagacggagagagcggaagagaacaaaaaagtgagaaatttaaacgctatttgaaataaattttatagcattcaaaaaaaaattggccaattttatgatcgaaatgaacagaaaccttttttataatatcgcagaaaaaattattaagatccggcggaagtttttgtcccgaaatttttcggatgaatgaaaggcgggaacgaacgggccaaccattcccaaaatcaaaattggcccctttggcgtcacttatgccgaaatgagtcctaaaatgggcataatttgtgtcttatgttcgtcggtgttggatttgaaagtacaaaagccccccgagggccatttttaggggtaattttgaataatttagtgggagcattcattgtgctttttttattcaacaaatggaaatgctttttttaaattgggctataactgtttgggaacttaaatttctttgaaaaagacattttcaatttcaaaaaattaaaacaattattcaaataatcggccgtttccctcaacttaactgtttccttaacaaccttttcaaatgcgtttttacattttctgagtgtttgccgctttaaacatttaaaaattcattaggcacagtcacgtgaggtgagcacaccttttgttctttgttttcgacgttttgtcacctccgaaaaaggctttgctttttcaaacgaacgaacgcaaaaccatcgtcattttgagacaattttttgaaattcctttttaaattttgtgttttttgcttttttgaaacgttcattttagtttttctaattttgtttttgcttttattgtaattgttgcgtcaaatcca

SEQ ID NO: 28459 - DNA, 1111 bp, Heterodera glycines
tccagattgtgtggtggttggggttggtctgtgtagaattggtgacaatttcgtccaaattggcatcggaatcgtccgcatttggcacattcattgaggaaacgacaaccctgggccatctatgggacgaattgctccaatttctgaaccatattctggtgcatgaggaaaaaatgttcatactgtatcaatttgtgcggttgttgtactgtaacgaaacgatgcgaagagacaataaaaaatggacggcacagtttacgaatgccccatttatcaactttcttgtagaggtaaatataatgagttttcggcactattcctggtggtcctgactttttaaatacgtgtccttgtccttaattttgggataccaatattttttttttattttccattttcgagacaaattctaaatattttctcttttttttgaaattttgatttataatttttttttgatagttataatcaagcagggcagtcagatgtgatgatttattcatcattttgattatttaatgagtcaatgatgattttttaattatcaaagcgcaaattaacctaaattgccaattttcagtgaaaatttgttaaaaaatggtcaaacttttcaattttccccggcggtgccactaaaacattcatattattattattatcgctacaaattttcgttgaccgataaacggtaatttactgtattaaattaccatattgcaaaaaagtttgaaaaaaaattgattttcatatgtgcaattaaggaatttgagaagggcatttgcgatgatcatcagcagctcgggcattgggacattccaaaatttaacaaaaaggaggcaatgcaaatttatgagtcacttatggcacagagagaaagggccaaaacaattaatttatattgtattggcatgttaattgaaaggttcattaaaatgcgaatatttttttgcaaaatgaatgctgatcggttgctacaaagcaaaaagaagctaattacgttaattggggagacaggactggttcagttggagctaatgtatccggaagtgatgaaattctgtgggttcaatggttaaaacagcagatttacaaatttgagaggcataggaat

SEQ ID NO: 28460 - DNA, 1792 bp, Heterodera glycines
ttggtcaaatgtttcctaacgtttttgtcaccaacttttggatatttaaaattttttattcttcgaaattggaattgagttcgatgattcggggatataaaatttttgttttatctttcaactcaacaatttttgccaattttccacagaattttcgccatgaaaatgaccgcttctgggtgttggcttcgcatccgtcgttgaatttgttcgccgccgggcacgacaatggcatgatggtgttcaaaacggagcgcgaacggcccccgcactgtgtgcatgacaatttggcattttatgtgaaggagcgacagctgcgccgattggacatgaacacgaggtgagattggatgggtatattgcatcaatgttttcaaagcctttacaattagttaacgaaaatctatccaatttagttttccattgcatttttgttcctaaattttgattggatgacacttattgttattaggtaattgcgatagttattcaaaaatgggttaatatcaaattttagcccattttcgaattgaaaactttttacaatagccgtagtcagatgtcgtgtttatccaataattaaatttactatgaaaatagtcctcctttaggggaaaaactaatttttaatttccagcaaagacgtggcgttggctcaggtgaagctgaacaagttgactcagccgtactattcgctgcattacaatccggcggagaattgctttttgctcgtcacgcgtcccgccgcaaacattgagaacagcacatacgacttgtacaaggtttctcaaaatttaaacgcatgatgaaatgaatttttggaatatttaacattttttatgttcccatatatttcctcctaaactttgcacatttttcgcacagatttcggccaaggaaggcgagttggacccgctggacgcgaaacggtcgccgggccttgccgctgtttgggtggcgcgcaatcgattcgccgtgttggacaaaacgcatcagctgaccattcgggacttgcagaaccaggaaagtcggaaggtgagtcgtcaattaacttgtttatttatttcagacatttctgccaatttgaattttaaaaatgtttgtcttcctaaaattacctagaaattttcgaaattatgtttttaagaaaaatgctttaatgctatgctattttttcacttaaatcttatattttatcaccaattggtcaaggttgaatacacgggtgccgtcgacgacattttctatgctggcacggggctgttgctgttgaagaacgcggactctgtgcaaatgtacgacttgcagcagaagcgtgtgctggccagtgtcaaggcaacaaaggtgttgtaacacaaaactgggtgttcaaaattactgaaaatttgaaaaaaagtgtttgaaattgaagttttatccaacgataaacctaaatcgtcactctgtttccgcaatgtttttgctttcaggtaaagtacgtcatctggtccaagaacatggaatgcgccgctttgctcagcaaacacaccgttaccctcgtcaccaagagattggaggtggcgttgtactctttggtctcgtctttcaatcttttttctccaggtgctcggcactgtgcaggagtcgactcgggtgaaaagcggcgcttgggacgcgggcaatgaggcctttctgtacaccacctccaaccacatcaagtacgcgttgaccaccggaggtgaccatggcatcatccgcaccatggatattccgcggtacattttggcggtgcgcggcagccgactgtactgct

SEQ ID NO: 28461 - DNA, 1562 bp, Heterodera glycines
  misc_feature (115)..(115): n is a, c, g, or t
  misc_feature (160)..(160): n is a, c, g, or t
tgttttaatgagacgatgcctaatcatacccgattttatagaacacaacgctacacatcttggctatgacaaaaggcaggaaatacttaaacgccacgctgggtaaaaaattatntaaaatttaatgctaaaaataatttaattaaattgttttccattntagtcgttcgttttggattcaatgtcaccgactttgccgataaagaacaacttggacaaccttttgctggcaatttctttaccgcaacacaccaagacacggacctcggatattgatgagggacattgagtgaatttgtaaaagtagtagttttaaaaaatttaaagttgaactaacaaatagaaaatgttaatgaaaatagacttttcattttgacgtactatttctttgtctctgttcatagaaaaagaaaggtttcacttcagctttataggcttagcatctgtttatgagtcgcacatgtaaatctttttaactgggaggccaaaattgcaaagctgcgcagtagggataataatttaatgttcgacttgacttttcctccgatgtaatttgaataagtatttaaaagaaaggcaagcacaaatttgaaaaaggacaaattcacaaagaaaagatacgtttatcaattaggtcggagtatgtaaattggaaatacaaaaataatgaatgatccactttatgcgcgaaggaaggagcgagttgacacaaaataagaaataaaaaaacgaatatctggcataagtcaaatttaatccctattcaacacctccctccttaattcgagaagcccagaaaaatattcatttttaatatttcgattatggcatcgaaaaaatacatttttcttcggtatggagttgggtgattttagtgttgtgatctccccatcctccgccgtcgttatgttctgctccgccgttgatccccacatcctccgccgttgtgatctccccatcctccgaatgccagtaaccggcaatttggcttattttttgtaattatcataattaatataacatttattaacaaaattcgcaggaaaaatggaaaatatgtcaatttccgtcttgatggcagcaacgcgtcatttccaatcattcggttgcatgtgaaatctgcatataaaaaggtcaatttcaatcaattaagtcatttttgtattcaccccccccccccccctcccgtcctcccattcatccggtgacaggtgcacgtgcccggcaaaatgacattgtcacaaaaccaaaaaacggaaaggcggggggggggggggggaaacgaagaaaagatcgggccgtaagataagcgcatcaacggcaatgcaggggaaaaagcagtcgccattccctgttcgttcacctgcgtttgggtcagtccgagacgggcggctaattcggcacgttccggcaaagccaaatattgtgattcattgaatctgaacaaagaatggatggatattttcaagcagcattgggaactatgtagcgaaacgaaagtagtcaagaaaggcaatttgaatttttgcgcactttggcacattctacgaaagtgcccactc

SEQ ID NO: 28462 - DNA, 1526 bp, Heterodera glycines
  misc_feature (28)..(28): n is a, c, g, or t
  misc_feature (48)..(48): n is a, c, g, or t
taaaactccgaaactcatttgtcacccnataaaagggtaggattattntcgcagagataatcgagattttttaaaatgtacaaatttgtaaatttggttgggaaattagttgtgcgtccttgggtggaaagttttcacataggatatataccatatgaagaatataaatcggaatttaacaatttttcgggaatcccgcaaatccggtaaaattgaatgaatttgatatcgttgaattgagcaaaaaccttaaaaatttcatcaaattatctcatctttcaatttggaactttaaaaaacgtgtttgaacaaaaaaaaccaattgaagcagaaatttaaaagatttgaagaaataaaactgttgagtccaaatgaaattttacaccgacgattttttaattagtaattttttaaattttcaaccaaatcaaaaacaatctttgtatcattctaaagccccgcacatgctcgcttcataaaaggcacaaaaatttgctagcaaatagaaaatttatgaagaaaaaaaaattcaaaatttcgactttttcataattttcatactgtaacttttttggtaattatcagttttttctctattcacagagacaaagaaatagtacgccaaaatgagagatgtttttttctctgcactctcttatttatatgctgtacgcgtgctggcgcgtttgttaaaaactgccacccatgcgcgtttgttaaaactgccagcgcgtttgttaaaactgccaatgggtttgaaaacaaaaaatgggcaaaataattaaattaatagcttggctcaaattcaaccaaattaatatttcgtggtatcattcaatagctttaattgttctctttcagaatataattttcctaaatttttaacttaagtataaaaaaagttatggtcacaaaattgcaaaaaatcttatgtcagcattttttgatcagaacttttttgaaactcactgaaattttctagaaatgtaaatatagacagagaattctaacggctatgaatgtatattgtaactttgtctaaattgcattataaagactaaaggaatttaaaagtatctatgaataaatttattgatttcgaaaaccgagttagcattgtggtcatttttgtttgttaaatgaggctcattctcccacagttatttttttaattgcctacagaggttcacgaagatcagccgacaatcgaccaaatttctcggtattattatctctgtctcgtctctcggacatttatctcgaattaggtggagactatgttagctttgtggagccaaattaccgaaaaatggaaagctctataaaacccactaaaagacaggaataagtttcaacaaagttatggccaaaaatgtctaaaaaactgctttcttgagtacttttgtaaaaactttgtaacacaaatatttacctaatcagatttttatgagcaagggaatgagataataattaaaaaggaaaaatggctcgaaaaataatatcaaatttattctctgccggaaagg

SEQ ID NO: 28463 - DNA, 1798 bp, Heterodera glycines
  misc_feature (1742)..(1742): n is a, c, g, or t
  misc_feature (1766)..(1766): n is a, c, g, or t
gatcaggttgtactctcgtttatccaacattgcggacaaagattttgtccatccgattgtgtcccccgcaaattgtcctgtactcagcgtgtgatggcgccattctcatattatgttaaatcatactgggggtagatgctgctgtagcagatttcctttgagaattttcgtgcaaaaaagcaagccgaactgtaagtaaaaatattactgagtacaatcgcttgtaagaaggatcgggcagtaacactcggtcttcctccgatgccaccccttgcaaaatcacgcactcatccctttataacttttggatatgtgggtacgatccacttaggccctttgctacttataccgatctatttaggtccgatcatagcaggggttaataaatctctatcttgaccaaattgcaacaccatttaatgtagacatataaatccccccctcatcacgaaaaattggcaataaaactaattggtattgatcatcatattcttttatttacttcatcccgtaatgtgtattcatcctcacattgcgacaatacctgcgacgctgcactaaagtccagactatagggaagctatttccgaaggattcggtctccccataaatctgggcgcatcggttcatggggactgccccgaaaacccaaaaaaaaattttttggataaaaattatttaaataaactgactagataatatttaaaataggttatttctcttcctttcagtatccctgcaaagtttggtgcgcttctgatcagaacgcgaaaaactatgagtgattgaattttcactaaaaaagctaagcctaaagtttttcgctcgtttaaaaagcaattaaaaatttgtagaatttttattcatcgccctttttgatagaaaaagcatcagagggcttaattaacttgaaaataaaatttggtgcgtttcagagcactctctgaaaaaatattaatgaatttattttttcgaaaattcgaaatgtacgcaaaataagaataccgaaaaaatttcaaatgcaacaaaatggaaaggaaatttaaacctaattaccgcttcttctcagctgtttctttgcaaaatctgggatttttctgatcacaactcgtaaaactatgagtgcttgaattttcactaaaaagttaagcctcaactttttggcatatttaaaaaggaattaaaactttaaattggaacgaaaaataggaatattgaaaaatttcaaatgcaacaaaatgggaaggaaatttaaagataattgcagtttcttctcagctgttaccatgaaaaatctgggatttttctgatcacaactatacatctaaaagcaaatgtttttaaaagaaagtttgtcaaatcgtgctaagctcatttttccgttaaggatgtcttccgtccaaattgctgaaagcatgggatgactttaagaaggcaaagcctgaattggtggagaacgaccggccagacatttacgcccatgaagatctccatttcgcaatcatcggcctttcctatgggggaaaagatctggagaagtatacggttaggtttcaagaaaagaaaagaaaaaaactaaaatgaagttcttcatggataaaaaatggccgcgaatgttactccattttccatcaagtcgccttgtccctagcgatcgcagaagacgttctcgaattcgagcaccgggatctgcacgccgggaacattctcgtggagcagtgcccggtcgatgaaaaaattcngtaagcagcaaaagcaaacagtgnaaaaataatgtttttttgtaaggtacctttat

SEQ ID NO: 28464 - DNA, 1426 bp, Heterodera glycines
aaattgaaatttaaaatgccatggcatttgcctggattttacagtaccaccaaaactgtgccgttcaacacaatgccaaccaacgcaaccaaatatatcgcaacggccggcacaatcaaatcggcagacggaccgacagaacggtaggccaaataaagctgaaaatattaattttatgatgaaaatttaataaaattataataaattaaatatttctgttttattttatatttttattatttttatttctattttttaccgcattgtctaactgatgttattgagaatatttttgtgctgattgggagaaactttatatatttttttaattacatgtccttttatatttgtttattaattttaggaaattgttaatttttttcatttttgtaataataatttgcgtaatttttctttttttgtcagtattcgacactttttaaacattaaatattaatatgccaattaattaattcaaaatgcttgaggcaatataaatatttaattaaaaaaaataataatatggaatgaattcccataaatatttttaaaacttttttaaaataaattaatattgaaatattatctttctataagaatttaaaataaaatttttaaaatatgaatacaaaatttattaattcaaattcatgatttgccagctattcttaacatttttcctatatgaacttgattccatgaagaaacatttaggaaaaagttaagaactgatggcgcatcagacaaatattattcatattaaaattcaaatttcctgttcaaaaattttaaagggatatcaaatgttaaatccgggaattgcgctggagaaaattataagtgctttttttgtcggttttaaattttacttgtcaaaattaaaaaaattattccaatttatacattgcaacatatgcatgaattgaattaaggattaaaaaattcaaacaaaaattccgaataccgaattttaatgggattttcttagttttcttgcccaattttttgtttttataaaatccgcagagtttaaaattggatgcaaaatctcaatctgtacataccggagaagtatggtaagatttgaacaggacctatccgtgccgcccccccccccctcccccgaaatggaaaatgaaagatttttccagaaaaaagggcgaattttggaaaattttgcacaaaccattgttttttgaaaattagaccccaaatgggcaaatttatcttcaatttttgccaaaccactacaaattcctgccttttcgccccagcgctgaaaatttagaaaataaatcattaaagaaaaaattttttggccggaagagcaaaaaaaaaaaaaataaataaataaataaaagctcttcgggtgccctccccgaaatttttttctggacacgtgcctggatttgaaggcctaaattta

SEQ ID NO: 28465 - DNA, 1380 bp, Heterodera glycines
ccaacacaatttgcattgttagcagtcccattggggatttcattctgtggtcttttcggctgttcttcggcactttggccactgagaaggcgtccttccccctccgcttttgcaatgggtcgtccattttcggcacttttgtgccacccaaatgccccctcctccataaatgggcacatttggaggggaagggtcaaataatccgttatttattcccaatccccaaattcatgggataatggagagcacccatccactacccgtctctgtctcaatttacatttcaaccgcaaaatcccataaaaatttgaaaaattttattcgattactgtgcttgccgaatttgagtccctctaataaagcctcccccctccttcgagagttcttgaaaaatagggccacgagagcttatgtatttccggcaaatacaatatgacacaaatttttgtgattttaattcaaatttaattgaattgaattccagcaaatttcagtctgacgaataaaactgtgttttccaaagcttttagcaatgaatgaagaaggctcattagaatttggtcttcgaacacggccaaaaatatgtgattttttgaaattaaacaacaaaaattttgtgaaaaattaaaattatttggcacagacacaacacggcccctggggaagcaaattttgacaattgcaccatatcatcaacagttggcacatgttacagccggcacttttctgcaaatgttcggccaaggccaactcgtccaatgctccgaattcaaaggcgaaacaaaattttaaaaattttgtcagattttataaatccaaatgcattgcaaaaaattcctcggatttaactaattcaacggctttaaaattttaaaaataaattcaatttcaattgcccgacaacttttaaattgttaattccgccgcttttccattcgctttaattttaaattgtttttccccccttttttggcactttcccccctaaattgccaatttgttctctgaaatccatcactgaacacagaaatgtccaatttgtttggattaagccggcgccaaatgcttttttcacaaagtgcactttatttatttatttacttccattttctttcctcggccatttccgtccgtctcttttggccatggacttttaaaattggattttttccgttttacggcaaatatttttattttggtaagtaaattttaatttaaactttaatttttaaattgagattgatatttgatattaagtaaaatagtgattctcgagaccgaaaattttccgaaactcgaaaccgcgacttagaaaagtaaccgcaaatattcattattaaataaaataaatgataattattttgtttatcaaaggctaat

SEQ ID NO: 28466 - DNA, 1833 bp, Heterodera glycines
tttaaagaaagtgcgtcttcttttttgttatggtgttcttccatccttaaggctttgttaagattgtgcttcccccttcgcttctttctcttggccattcttccacaaatttatccgattctgatggatctgctgaagaaataacacttttcgattggatttcgtcaaaggacccggcctactcgctcagctctttttcgcaacatgtgctcgatcacttgggaaaaacgacggacgaagagctaagagaggcgcaacatttgttggctatggtccaagatgtgtcgcaaaaacctcagtaaaataaattatttataatttcaatacttacctaaattattggtttttgcttataaacaaatccaaaaaatttttatttttgaaatattattttgtttccatttaccgaggtgttttcggttgacacacgtttggccaatcccgaattctgaacccataatatttttaatcacttatactatgaagcaggactgtatccagtaaaaagtttcgggggagtgcaccaccgaagagcttttctttttttttttgttctccagaccaaaaaaaaaagattttccggtgtcatttttcaagtttttagcaaaaatacccataattaaaggtaccgtgacataagagggattgacaaacgcttgggcacattaaatgcacatcttcaaaaacttgaaggtgtgttctaatatttttgttcaattctatgccatcatttttgaaatgagtttttagcgaatctttctgaagttcgagaaacatctgtggcaattatacagccaattatccaagatggcacccaaagtgttgttgtcggacaaaggaacaaattgaaagaactgaggggaaagctgagtgagcagcggaattgtgccctctctttcatcagttctaaagaagaagtcattcaaaacagtgggtcattcattcatcgtttattctaaaaatgaatttatcttttctctccatcgttaagtttgtcagcgccttgcgacttggattaaacaagttattctattttttccaatttcttttctgttcattttcatcttttaggcgtaccaacgtctccaagatgttgacaaacgcgtgatgtgttttgaccagaaattcaatggtcttcgacagagaatggatttggcacgacaaataacggaaactccaagcatttatatgaccgctgtgccggaagtgatcagaagagaggcgctcaaaagggaattttcgtcgtggattaatttgcatattggcaaaacaatggaatttatcacagaagaaaacaaaattcgacagcaattctttgggaagttggagaagcactttctccgccaacttttccccgggatggatgaaatgatgccgcaattttcacctcaaattgctcctaaaattgaccaattgcttccgaaagtgcctttctcgcatttgcatgagctgagaagtgtaagtgtctcctttgtttaattttccttcatttgtttattttcagagattcccggagatgaaagagctgctttttgtgggtacgccgcggcttttctcccgattggcaatatccgacccaacttctccgattgcatccgcaccaattcggtccattcgtcgtgatgaaagtttctatgagcgagacaaaacttcgaatattgatgtgatgaatcggaaccttccgtccaccaattggctaaggcattattttgattaattacttttttttgtacattggtcacctccctccctatagtaaaaatatttttagaattatttaatggaaaaaaattctattaaattgtttaattttgtgtttgaggaatggaagac

SEQ ID NO: 28467 - DNA, 1553 bp, Heterodera glycines
aaaaactatttgtattatatttcgggttcaaaaaacccaacagaaacatataaatttgatggaaatacaataaatgctgtggatacaattagggatttaggagtaaacattgataataaattacaattttccgatcatattaaccaaataacaaggaatgcgtatttacgtatgcgttccttgtttcgaataattaaatccaaatcgtctaagatttggattacgttatataaaacttatattaggcctttattggaatacgctccggaggtttggaatccgtctcttcaaaaaaatattaaaaaaatcgaaaagtgtcaaaaatatttcaccaaaagggtattttttaaatgcagccttccaccaattccataccaaaatcgattagaatacctgcaactgccgacacttgagaataggcgaaagctatttgatctgttcatggcgcataaaattgtttatggccgaacagatctgaaactattttctatttttaatccatcagcacgctttaacatccccttttatagatttaacacaaaatacaaactgggcaaaaaattcattccctttgctgggagggtaacaaaattgtggaatcaactagataaagaactaataaaaacaaattctttaaatcaatttaaaacaaaacttaaaagttcattaagacaataagaccggaaaaacttaaaaaatggctacagaatatttaaaaaaaaaattttttttttttataagtgatttggttattgtgatctctttgactttgacctcattttatatttttcttggcgattttattttatttgtgcttgtataatccgatacttttggacgattaatgtatgtatatgtccacaaagtaagtggatttatcccttttgtggactttttcttttctttataaataaataaataaatgtacttcatttcggaagcccaatttccgaaagaaagccggccaaaaatcagaattcttaaatttaaaaaatatgtgaaaagctccccttaaaacacaccgctgtctcgcttcaccagcttaaaaacaaaaatgtgaaaaagtaaaaaaaaaaaaattcgatttttcactttttttgtggcattctttgtcggaattttcgccattactggcgtggcaatttgctgaagagtgtgcgccctgattgccgctggtggttccatcgtctcaacggcacgccgctttatgccagaaacgattttttgtgtgaccacatttgccgcgctgtggttgcacgtgtgttctccaacggtcttcagcacgacgtcatttagcgttgtgtggattcgtcctcggcatttgaattcatcgcgctgatgttcacagcgcccccaatcgggctatattaaaagatttaaaaccaaatgaaatgtttaaaaatgcaaaaacaattttctgatatgggagcacctatgtttccacccctgcacatattccctccgaaattaattaacccccctatttttttttattttctccaaaaaatgctttgtaacttttttccatacggtatggagttttaaaaaaaaaa

SEQ ID NO: 28468 - DNA, 1359 bp, Heterodera glycines
tttaccctgaatattctatttctttacaaaaacttaattgtaagttgctgaaaaaatggctggacccaggaaaaaccccaggtcaaagcttcctttgatgcgcttgcgatagacggacccgaaatcaccataaattaaaaataagggtaattattggaaaattagtgactgaaaatttaaaaaaatccgagtgcacccaccatctgtaataaattttctaaaaaattttcgcaaatttttcttaaattaattggcctttttggataagacgataaacaattacaatcatgattttcctatgtcattcctaaaatcctaattgtaagtaatacatttcatttccattcttagaattgtcaccgctttgcccgtcccttcccaacatttgttggcccttttgtttggcacttttcgcgtcatcaccgactcggcacaaacattcggcactcgaatgacgccggacgccatcggcatttcggttgcgccttcgctgttccacacgtgcattcatgatggacaacgggtaaaacttgtggaaaaatgaattaatttcaacccatgagtttctgaaaattcaaataattttcgataaaaataaattttggttaaaaatgatcgattgagtccctcattttttggttccctggcatctttaactcatcatcatatttttatttacaaatatctgcccaaatctgtaatctcgttagaatgctttttccaagcaatatattagtcttctaaaagcatgatcattttttagcatggaatttttggcgaatcgtctcatagacaaaaattgagccgaaatgttttcttaatttttttaaattatgctttttctgctacgtatgcttcaattccttctgtaaaaaatcatcctctcttttacgaaagttttccaaaaacaaatttttgtttcggctttaattgattttgtattcaggccaagcttgaggacataatgcgcttcaaattggcctcccaagtgatctccaaaatcatccaatcgttcggtgctgtgcgactgtttccctttgaatgttacgaattctatgcccggatcaccggcaaaacgttgcggagggacgaaaaccattggcacatttccttccatttgccgtcgagtgagttttattttttaaatttaccattccattatgaaatggtacagtgtctaatggtagcccatggtttaagcctcgggattctcttgaaatgataccattcattaatttaggttaaatgccaataaatttttaaaaaaatcgtggttttccatttttgtccattccattgtgcctccttttttgtttgaaaggtttgctgtgtgctttttttacgttttatttgctttgc

SEQ ID NO: 28469 - DNA, 1079 bp, Heterodera glycines
  misc_feature (13)..(13): n is a, c, g, or t
  misc_feature (1027)..(1027): n is a, c, g, or t
ccccccccccccnccccatcagtcccattgcaaattttgtatatgcgggattttaactaatttaaccaaaattgagtgttgaaatgcttagaggcatttatagcaattaccaaatgaattgatactttgttgtattgttatttttattttttttttaaattttctgtaaaaaatgttgatatttaatcaactgagacgcagttggcccttttactactaagacgcagttggcgagacgcagttggcccgtttcgtcaattctctgacattccaatcaccgggactcatttttccgatatcccaatcactgggattcatttttccggtagcccaataattatcagcttcttcgagcgttaaaaactctaaagctttatattttagcatataaaagctgtatcagagcacagtaagaatacgccatagaaatttggaatccaatattacaaaaacaaaaacaaaataatttttaagagggttattaattcatggaattattaccgaaaaatattatggaaataaataatttgatatattttgtgattttttactgtatatgcttaattttagttttaattttgttttttacaccactgttagagtgcattagcaccttgtggtttgttcgataaataaataataaaaatgtaacaaaatttccgagatttcccgaagcagcctgccggcaccgttggagccaaaattcctgccaaaatcccctaaaatttaggaattttggttaactttcaaaaaaaaaaaataattaattttataaatttaagaatttgattaaaaaagtgtgaaaataatacatttctagtattttttgactgattaaattttgataaaaaagatcattggctacattcaacaatattgcttatcaaattttccattattaacagcgaatgagtgaatcaaatagatttggtcgtaaaccagggatgttgctcgtctcgtttttttaggccgtctcgttctcgtgtctcgtctttgatccctgccttggttcgataccacacacaanaaattttattattcattttaatttgtatttttttgatttaattatgaaaatc

SEQ ID NO: 28470 - DNA, 2212 bp, Heterodera glycines
  misc_feature (27)..(27): n is a, c, g, or t
  misc_feature (60)..(60): n is a, c, g, or t
  misc_feature (2205)..(2206): n is a, c, g, or t
cccgtttttttggcaaaaacattcatntactacgagttatataaaagatgttatcccacncaaacatttttcgtggcattgttgcaaatggaaatttgaatttttgcactatttttgaatccggactaacaaaaacagagttttgaaattgccaaaatgaagaaaattctgcgtttatcatttttttcgatgttttagttacatgggaatcggtttgagcgagaaaggagtgtcactgaatcggttgcccggctgggacaagacgtcgtacggctaccatggcgatgatggcaatttcttcgcctcggtcggcaaaggggtggagtacgggcccaccttcaccaccggcgacgtggtcggctgcgggttgaactttgtcacgcgccaactgttcttcacaaagaacggaaagcatttgggtgtgtgcatttttgttttgtgccaaattcaggaacgaaaccccttgtttttttgacaatatttttttccgaatatttcgatgaattcttcgacttttctttaaaattttgagaaaaattcaaataaaatttttttttttttgaaaaatgaaaaaaaaaaattttcattctatttttactccaattttcaaggcgtggcaaacactgagcccattccactggtcaacgatctctacccaacagttggcatgcaaacggcggatgaaatggtcattttagggaacgcaaaatgattaaaactactatatctatctccaaatccaattccgggctctaaatcgagcattttttgtatttcatatttatgctttctataaaagctaaaaatttatagaaggctttcaggctttgttagtttttttttggttttgttacctaaaatagaaattcaaaaatatggatgaattaggggctcaactcaaaaagtgtttaattttgcgacttttacagattgatgccaactttggccaacgcccttttgtgtttgacattttcgccgaaatgaatgtgggtggcacttttgggctgtgaatcaacggatgaaatgttttaaaatataaaggaaaaacaaaattgttttcaggcagctgaacaggcgacaaaaaatgcaattgccgccattgaattgccacccgaaaaagtgctttggatgaacaggtcggatgggagtgagggggcgacgagcggagtcggctttgaaattttgtgatttttgtgttagtacttttttgggataatttttcaaaaaaaaaaaaattgaggacaagggatccggcggtgccgatcacttgacaaatggtcgaaaaaattgcaactttcagcttgatcgccaaatggatgacctacgaaggatattccagggcgttggaagcgctgaaccggtcaacggccaatccaaaatcgtccatttcagagcaggccaaagaagaccgacagcagcaacaacaacaacaacagtcaccaccgccaacgacggctgcggagactgtggccaactcagtgatgcaatccatcatcgtgtttggtggcggtggtggcagtgccgccgacggtggcaccgatgccgcggcgccagcgactacaacgtcggcgggcagcatggccaacaagcgccggaccgtagtacgctctgtgcaggaggcgctggacgaggaaatggaacaccacgacaaaatggaccagcgccggtccatcttgcgcatggtcaagcggggccaacttgacgatgcgatcagtcacattgaggtgtgttgtgttgtgttgtgtgacgggcggagtgagtgagtgcttcaaaaactgaaatttttaatttctttagagatttttctgcatatttaagttctttaaaccgaatttcttaaaccgattttttaaaattttcatttttcatacaattttcgaagaaaaagttatataaaaaatctactattttcaattaaatttttttttgtttttttgtatggatggggagcgtgcgtgaaatgagctgctcccttttttggttcttttgagttttcgagactggcacctattggcatattgcgttttaaaataaccatttaaatcatttatctgcactttggagggaatgaatgccaatgttttacacaaacgaatataggcactaatttccgattattttgcaattttttagcaccattatccaacattgatggaaacgaatcgacagctggcacttttactcaaaattcaacccaattgaccnntgcagg

SEQ ID NO: 28471 - DNA, 676 bp, Heterodera glycines
ataaaatttttaaaaatttttaattcctttttaaacaggccaaaaagtttaggcttatattttaaaaagtttcatcgaacctagcgcactaaaatcgataaaatctctccaaaagttgcaggccttctccattgtaaaggactaacttaacttgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataacatctttttaaaatattttccttatattttggttatttcgttctactttcggtggggtgcttggaaaattggaatcatgcgtacccgtccgatctgacaagttaagcaacgctggctgactagtcaaaaggatgggggccgtgatgaaacgaaaccagcactgcttaccccgcggcacccggcacggacccccgaaggaatggaattaattaaattctctcattcggggatttttttccattaggtcgaccgttagctttcgattggtctagtcaaatttttttattttaaaaaaaaatttgttttttgaagtgttctgatgaagggggggggggcgg

SEQ ID NO: 28472 - DNA, 1654 bp, Heterodera glycines
actcaaaaatatattttgtgttttttttcagtggcaatggacaaaaagccaaaagaacgcattaaaaggggacaaagtgtgcaaattgcaattgttgtcactgacgaagacgcagaagaaggacaaaagacggaggagaaaaaaatgtaaaggaaaaaaagaaaaacaaattaaaaataaaattaaaattaaaaagataaataaaaatataaaaaaataattacagtaatatttatagaataattaaacaaaaaataaacaattcgtaataaaaatatttaaatagaaaacataaatcaaacatttttaattttagcgctttttctgccaatcaaaacaatgtgaagccaaaaagcaacaaaaagcacggaagaagcaaaagcggcggagttttactcgtaaaatcggcgggcgttcattgggaagaaacaaagtgaaaagaaaggggaattaatttgaataattagcaattaattgttcatgatagaacgctttttaggtaacaaaacactttaaatcttaaatatttcaattgaaattattaaatattttaatgtttttttcgaatatgaacaaatttttaaaccaaaaaatttttattaagaaaaaaaaaattaagttttgggaccaatttttgaaaattttttcaattcttagggggtgtattttctgaaaaattttttgagtaatttcttaggggtgtatttttcgcttttattgcatttttgttaaggattttttcgaaaatcctaaaataggcacaatatgtaggcacaaaaaccccgaaatagtcaaaaataggcattataaaagtcatcgtagacaccccaaaccaagcggaaaacgcgtttttcgtgcttacctatgcgtatcaagtacgcaaaaattttagcatttgcctaaaaaaggaagccctagtaattactaatcataagctagcgcaaatatcttagctgacaattttctcatccaattttttatcattctttggaatgggaattgtaaaataagcattaaataggcacaaaaaacctcgaatagatagtaaagcacaaaaacttaatcatcaattgttaggaaaaattttcaatttttagaggtatattttctgaattttttagtcgattcttattcacgcaattctcatgtttaattattagctaaaaataataaagaaaaattttaaaattgtatatgagtcggggtcgttttgacgtcaaagcaaaaataaataaaaaccacgcactaacagaaatataattgatagttcatataattgatattcgcgaaatgctacagagcagggatggcattccaaggccccaaaaattttttaaatcggaattacgatgcccaaaaattttcaggaaatcggtaggcaaaaatttttttgaaattgggtttgcgacctcaaaaatatcggaaatctgctatgatgaaagggatttaaaattctactttaaaattttttttatttgtggttttttaatgtcgtatttcctcgaattgtgctccatcctcgattagaaccccactccgatatagcaccccccccccaaaaagaattttttttttaaatttttcaagaattttttttctcagactcttaacgaaacagagaattaataaaaaattatttaataccgtatttcct

SEQ ID NO: 28473 - DNA, 1184 bp, Heterodera glycines
aacatcaaattagtctattctaataaaaacaaaaatagttatagtacactaaacataaacggcaactttttatgcaacgacctagtagtttttcgatgggaattcaatcacaattttttaacaattaaaatatgtcatttttggatttttttttcacaaagtgcattaaaaagttcaatattttccccggcggcgcctatctgcaccgttatgagaaaaaacctcaaaagattcatttttaatcgattttttagtgtgtaagaaaattttttggagaaagtctcggtctcgactcgagaaaagtctcgggttttttgggtctcggtctcggtatctagtctcgggattaagttcggaatcggtctcgagtctcggggtcaagtctcggtctcgggaaatttttggtctcgagcatcactagttattagtagggaaccgactttgtgacgaaaaatcccgaaatagttaactaaaatagtgacgaaaaagtgccaaaatagtgaaaaaagtccaaaatagtgacgaatagtgacataattttcagccaaaaattgagcaaaaaaatctttattcactgattgcagttacaaatgacattcctttcttacatttttttttagcaaatattgaaatttttaaaccaaaaattttgtaagaaaaatttgggggaaaaatttttatgaaaattttccaattctaactggtattttttgaaaaatttttaggtcgattcttaggggtgtattttttgtttttattgcatttttgttaacaaattttccaaaaaatgtcgaaaaagtgaaaaaatagtgacaaaaagccaaaaaagtgaattttcactattttaagtgacgaaacgccaaaatagtgatttctagtgacgaaaaatgacgtccaaatgaaaaaattttaacgcagaaatgcgttttttgagctcctttcttcaaaacaattgagcaaaaaaaaaagttttttcactagaaatcggttccctagttattagtgactattaggtttttatttttagatcctaaatgcctaaaaaaaatttcgaaagacctatttttgattttatagataaacccttaagcaataaaattttctaaaaaattcttttaaaatttttttttttgaaaaaaattttttgtttttaaaattttttctaatttttttatttttttgaa

SEQ ID NO: 28474 - DNA, 1601 bp, Heterodera glycines
aaaaatgtgaaatattgctttaattaaatatataactcaggtgggattgaacctgggactcccttttagagagagatgagagagagtgagagaaagcaagagagacagattgaatattagaaattttaataagtttcccgtaataaattagtaataatttaataaatgctaaatttttcatttaaattgcttttcttcaggaaaatatccgatttttattaagaattttcttttattacttggcgatttaacattggcaaaataaatattaggcatttgttaataaaaataattttttaattatatttatactttactgctggtcagcaaaatttaatgctttattgaagaaaattggaagaaaaacaacgaaatgagaagaaaaaaagagaaataattcgtaaatattataaaataaagagaaaataaagcaaaaaggaagaaaatatccaaaaaagaacggaataaaatagaaggaaaaatatcaaaaaaattgggaacaaatcgcacatatattcaaaaatggatcaaacaattggagattaatcaaaaattacaaaaaagctataaaaaaagaaaacctaaaaatgagtgataatgcaattgctaaaattatgaacctttcaaaacagaatattcattattggaagaaacaatttggagaagaattgtttgagaattgataaatgatgattttaagaaattacgttgatcccctccccgatcataagtgaccttttcagaaatcgtaatcttatggtttttcatgaataaaaatattattttttctaattttttttctatttttctattaattaataagattaaattacagtttttttgttcacaaattcattgaaatgtcaaggcgtctgggtgaaaattaggtagataaggaaattggtggagaaggagaaattttttgagaaaaacaaatttatttcttttaaagcatttgttcttacgtttgtgtggtctagtgtaccttcggcgtttcattatttgtcgcttgtgttcaattccccaccgtgatagaatattttttactattttctttaaattattttaattggaatttaattaaaaaaatatattttaacttaaaattattattttcttttttaaacagcctaaaaccgcaaatttaaacaaagatttggtccttttgacaaaatctgttaacaaatctcactcaaaatttcaaatttttcccggcggcgccaatcagcattagagttggctatgaaacaattaaaaaatggaagaaacaattggcaataatagaacaagattaatggagaaagaaaaacttgaaaaaatgaaaataaaaaaagaaaatccgaaaatgaatgacaaagaaattgcaaaaatgatgaacattcatcaatcgaacatttcaaaatggaagaaacattttggagatgaataaatcagacaattttttttagaattaccaggaaaacttttttggaaaattttaccacgagaggaaaaggtactgcagtgattacaagagctacataaacagcgattagaagaagtacaaaagtgattagaagaggtaccacgatggtttaaaattaaataaataaggaaatgtt

SEQ ID NO: 28475 - DNA, 1315 bp, Heterodera glycines
gtttttagtgcacataaaagcatatttaggggttttcgagaataaatgcatatttggccatttttgcattttgagagcatatttcggtaatttttggcaaattttcataagaaaaatgcgaaaaaagcgaaaaatacacacctaaagatcgactttttggaatttttttaaatttacacccttaaaaatcggaaaaaaaattaaatttttgtcagaacttttggaaaaaaaaattatgtttttagtatatgctccgttccataattatagaaccaccattttttttttgcgttttacccacttcccatcatccgatcaagctgaagctccttagcccttgttttggtgttttaaaagtcaattcttaatttatacacaatttttggcattttttgagggttaaaagccattttggcagtttattaaggcatattttagtgcatattttatgtgcatatgtatttggcattttttagtgcatacattttgaattagcgcgcaaaaaattacgccaattacgctatttggcgaaatgagcaattttgtctaacactaggcttgacccatagtagtgaggcgccctttttaaatgaactgattgttagattcgtggtcaatcttcccgaaaacccactaaaataatttttatgacattaaattggaattttttaaactagaagctagaagcatcgtcccacttaattgtaaacaagaaaaattccttttttactttaaattttatttgaaatctcgacgttttaaaaaaatttggacatggacctcggaccgtgttggaacagaaaatgattttcctattttaggtagtctataagtgataatttatcactgttaattattatcattaacaatggtagccgcgccagatgaagcgcaatttcatatttcgttttacactgacgaagaagagtgagtaagagtcaaaattcattatcatatatagagagcggatatttttacaaaaaaaaacagccttgtttaggtgtaagaatttgttgcctgccgagtccatcaatgtgcccgcgtcttcgcactcggaccaactcaatgtgttgatcaaccaaatcgggtcgatgaacgatggtactttatctttaatgattttgcaaatgttttatgcaactcttgcaaatgcattcttcacttaaaatgttcggtgcttttcgggtttttcgactttcaaatatagctcgacttttcgacccccgggtacttggtttcaggactttttaaattaaaaacaaattatgtaaaaaaaaagtgaaaacattttcaaaatactacgctttgtaactag

SEQ ID NO: 28476 - DNA, 1847 bp, Heterodera glycines
  misc_feature (875)..(875): n is a, c, g, or t
  misc_feature (1790)..(1790): n is a, c, g, or t
gttattgctctaataaatttttttttctctgcggcatacaaaatataataattgaattttattatcataaattcacatttgataattaaataactaaacgtagccaataatgataatacattacttttactaaatttaatatttttattcatagcaaattaaaaactctctctctctctctctctctccgtgctgaaaaccgacaaaacaacgtgaattgacgtgtgcagactcaagaacgacgaaacgacgaacaaattggtggcatttgcagtgttgctgacgaagtaaatttatttgaattttgcctataaaaaatatataaaaataaaataaataaaacaaaaaataaaaaatctcttgtgactcattgggtacggtaattacagtatacaataaaagttggtaaattgaatttgtgagggttaaattgacgaaaacggacaaaacctcaaagggcaagatcaggaagaatcagtctgaaactcctgattatttagcaaggagattcaaagataagaccgagagtggtcgagaaagggaaataagacatttaaaaaggaagagaagtacaagtgtcgagcaaaaaagtaaagagggtgtaaacgaaatggctaatgcttttgacatggatttagaagtgaaatttgaagtattaaaaaccaaagtgaatgatttggaggaaaaattggcaaataaaatatccacaaatttaccctcaggagttagggtaccaaaatttgatgccaccggggatttccacagttttttacgagattttaacatcttggccaccgtttccaactggcatccacccgactgtgtcaggatgttgccactttttctggacggtgaagcaaaagaattatttttanatatcccaccggacaagaaaaaaacatggagagaattaactgatgctctggcagagcagacaaaaaaaattgatggaccaatgtggccaaagaaaatgctcgcgcgtgtaaaaatgggtaacgaaagtattactgagtttgccaataaagtgagagaattggttgaacaagcatccccaagccctaaatacacaaaagaagctcgggaggatgagagtgtccattttttcttaagcggtctaccgactgcacttaaaagaaaattatttttcatggataagccaaaatcattggttgaggccatttcccaggccaaaaaggtggtacaagtaagggaagagctcgcaaatgatgcgcgcggagatgagctgaaacaacaaatttccgaattaagtgagaaagttagcgcaattactgtgcgtaataacgggaataatgagagaaacggtcgagaattttttaattcgaattggagaggaaataataataattacacccaaatgagagggtatgcaaataacaattggcgtggaaatcaaaacatggtcaggggtcgaaatatgggaaattttaataattttaatccgagaaatgccaattttactccgattggtcagaatcggaattggaatcgaaattttggtaatcgaacaaatttcgaaaattcgcgatttcaacggggaaattttaacaataatcgaggtatgagaggaaggggtaatgaaaggcagaaataccgaataaatgcaattgggaataatgaggaaattccgtcttcttctacccgtaaatcgccaaccccaacaatgacatttctgacgatttcaatggttatattttcactgtttggtctaatcaatggccaatatcaattatgctccgagagagtgccaacaactcctatttggctcccanaatataaccgaatgttcaggggggagagtacaagaaaatggcagaaaccaaagtgac

SEQ ID NO: 28477 - DNA, 1126 bp, Heterodera glycines
  misc_feature (1110)..(1110): n is a, c, g, or t
aattcattttggcgaaaaatataaatttgaaatgtacgataacgggcaagtcaatcagcttttgtgcagttaaagccccaaccagcagaatatgaattgagggcgaacgacgcccaatggtcatttcgttgagttttcgcatttttgttagaatttgggctcgggattcgaatcagagactccaatttcaaaactttatcaaaccaaagccagaaatttttagtctggcagtgctaacagacttccacggaaagtttttgaaaattttatccactttgttagcatatttggcaccaaaaataagaaattatgaattataaacaaacatcataattttaataattttatttagattacactcattttaacaattttactgccaaccttagcaaatggctaatttgttacaaattgaagaggttattaatccatccaaacatatgacattctgtttctcattttagggggcaaacgaattaggaaatgtcggcgaaaatcaaccggtgatagggagacaaatcaacgagcaactgattaggccaccgttgactcttccgaacatttttcccacgacagctgccgatttgcacctcttttacagcaacacaggtacgcatggagtttatgtgaaatgaaattttctataaaatcggattctttttgttaaaatagaaccgacggacaacagagaacagacgcagccaactgatgtgacaaatacaacggcaaatgatggagagaatgtccagaacacaccgacggaaaatgatggagagaatgcccttgccgaatttccggttaatggttaagcgccaaatgttttttttattttgtgaatttcatttaattgctttttggttcactttgttaaaacaaaattgacgtatgtatggctcgcattgttaaagagtgtcttttatttctgatattttatatttctgttcatcttgcggcacctttgattattgttagtagttgccgttggatccattgcaccgtttaacgggaaaatgtggagaaattatattcttttttaaaattgcccccctttctcaaccatttgcccatcccctgggactcctcctgcagtgtgctgtactgctcctcaantgtcgccactgttctg

SEQ ID NO: 28478 - DNA, 1492 bp, Heterodera glycines
ctgagtccgtttgtgatgattttgaaccaagtgacacaacacaaaacatatttttttttaaattccatccatctgtttacagtattacgactactatgttgacgagtacactctgctcttggcttcaacggtcagtaaaaactatgtttggaaattaagcatcaattttgcgtcgatttttgacagatggagtggaatgaggccgtgggtgccaaaaaaatatattaattttcctcattttttcgtctgtgggatggggggagtggcccttttcttctcctgcggcgggttacggcattgcttggcttgctcccccccccccccccccccgcacagttcggacctccagttcagtaacgaggtggtgttaacgcagaagcgaaaagagatagagaaaatgtgaaataagcggacagacagtcatcagagttagaacgagtgtttcccgcttgccatacaaataatgccttttgcaggtgtacgcctacgccagtctgatcaccttttgcacgttcatctgcaagcagttctgcgactttctgggcatcagctgcttccgaattgacgtgcagcaccagcggcaccgacggaatctttcgtcggaaaatggcagcatgaaaaagctgttgctgaacagggccgagtgatggacagataattaaggcgattaattcctttaatggcggcggtgatttgcacaaaacaaacaaaacggataaaaaacagccacagacttctagcttttacaacacattttgtttacggtttattatatattgtcccacacattttctaatcactttgtgtcacttccaattccaacgtttgtcagttcgcatttcataggcacaacggtagctcattttacatattattattatactattatcattgactcaacatatattttaattttacaaaacatttataaatagaaaataaatatgtattcttttttagtttgaaaattgttcggcgtttcttaaatgggactttttcaaagattctcggtcttttagcagtgatttttttagaaagttttgtattaaatatttttaaaattgatattaatgggagcagctcgtccccccccccccccgagggaaaaatagtaaaattttaaaaagctttttttccggggtcaaaaatgtgctaatcacgaatctgaactcatccccatctcatatagctaacggattaataattaaatttcaaaaaaaagtaaaaaactaaaagcttgacttctccatatattcaatagctcatctcatccgaatgctctttttaagctctacaacatcggtgtatgagttgtttacaactgactaatttccttaaaattttggaaaaaatcaagtacatgatgaaaaatcataggcaaaaccatgatttttgaattctgagttcagattcgtgatcagtgcattttttaatcccggaaaaaatgctttttaaaattttactattttttccatcgggaccacaattctgc

SEQ ID NO: 28479 - DNA, 1545 bp, Heterodera glycines
  misc_feature (1418)..(1418): n is a, c, g, or t
taatttgagtaggtggtatgcacgtctaatgctactgttactacgactgttacatttatttcttagtgtttaaatccgaacagggggggggggggggtgggggaattaaaggctgataatttatcattgtataatatttaagtttcacttttaaaatgcataagtggccatattaattaatgaactgaatcgaccataaaatttaataattattttttaggtttattgtttaataatttattgctttggttacctttagacactcaattcttttgtttattgcagcgattcttctcaacagatgcttaataagttctaaatgataattcttattttattatctttattcaatttttactgtttttaatatttatttattgaatttcttatctttgcagttaacataagagctcaacagccttgtataataaacttgttgatgtgtgatcgataattacttggtttattaccaaaaaataaataaattttgtttttataaaatattggaattagctgttttaaacctctctattcctttttgataaacctatttttgattctgtcttaaaaaaatatttaattaacttttcattcattaatttaaaaattttgaaggttattaagccgatttggcgttttactctttttttaaaagctttcatggaaatgaaatttaatttttcgtgaaattgtgttctttccattatttccagtgaaaattttttttgagatccttcatccatccatatcgtaagccagcaagcagataataaacattttttagtataattattaaaattaaaacattaacgaattaaaaaaatcgaatatttgtaatatagtttatattttaaacttaaattcaaaaataagacaaaaacataaaattgttgcataaataaaataaaatattgagaaatgtaatccaaaatatcctttcaaaattgtttattaactcaaagtgccttgcttttttttgaaatttgactcggcttttattaatttgaggcctcattaaatatttaaaacctaaaccgtttatttaatatccatgttaagttttaaagaaatttatttaaattttaattaattttaggttaattattacgttgaatagttactatttttaaggaaaattattatgttaaaaaagcaattatttaattattcattacttttattaaggcttaaaatctataaaattttcttgtagttctctataagtttcttgcgcaacttttcatcattcttcgtctcatttattggattagaatttttatttaaaaaatatttattttattttttattgtacatattaatttattcctaaattgcaattattatttaatagataaatttattgttcggtctttcatatttctctgtaccttctgatacatcttaaatatattttttanattattcttcttttgcatatgaataataaatagtaatttttcacttttgcataattaaggatttaacatttttttcaaaaaaataaaaaatttaattactttgcttttcattaatatttcacatttt

SEQ ID NO: 28480 - DNA, 1039 bp, Heterodera glycines
aataaattttaaattaccaaagttcataaaaaataaaacaaacatattgtaattgaattattttacgtttattccattgactctttaaatttaaattatcatacattcgcgatttgagaaagctagaaaattttacatgatttgctaatatatttcactaaatgcttgggtttttgggtaaaattttgaaaatttcaacataataaatagtaattttgagagtttataggcgattaaaatacatttcacatgaatgatgttatataatagcactttcccatgagtttatgatcagccaataattttgatcatttcatccccttttctcaaagtcttctttgcaaacttcaatcattctgaaaaactccgaatcaagtataataatttatacataattaaaggatggtgcgagaaaaaattaactgcgagaatcagaaaccgaaaaaggcgagaacgaaagaattttttatttaatattcaaaaatttttaaaagcattttaaaaattattttaaaagaaaaaatataatatgtgttctaaggatttagcggaactctagttcagatatttttggaaggcattaattctcttctcaaatctttcgaactcaaatggttttggtagtgctaattagtgcaaaaacagaacagccataaaattggtaatttttagcaatcggctaaacatttccctattgagcttatttgtgtcgacggacaaaactaatcttaaaatcattttgaattcattattttaaggttaaaattttttgtcaagcaggcgccgagaggcgtcgctgggaaatttttgaaatttgttaaatgagtttggcaaaaggtccggcgttataatgagtcttcttaatatatatttttggagcaaactaattaaaattttaaattcgcctaatcttaaaattgaaacgcccggaatttgatttaatttgattcaacaaatttttaaataataaaaagatattttcgcaaaattaaagatataaagttcaacgaggaattgaaccaaggaaaagatgaagcaa

SEQ ID NO: 28481 - DNA, 983 bp, Heterodera glycines
aaatccaacgcaggattaaagtacaggctatagggagctatttcggaaggattcggtctccccataaatctgggcgcatcggtcggggggactgccccgaaaacaaaaaaatcgattttttcaagtgtccgtttggggtactcaaacaattatggggagcaaaaatccaacgcagaattaaagtacaggctatagggaagatattcccgaaggattcggtctccccataaatatgggcgcatcggttcggggggactgccccgaaaacaaaaaaatcgattttttcaagtgtccgtttggggtactcaaacaattatggggagcaaaaatccaacgcagaattaaagtcaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagggtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgcccgtttggggtactcaaacaattatggggagcaaa

SEQ ID NO: 28482 - DNA, 1295 bp, Heterodera glycines
atacaaagttaaatcatagtttgaaaatgttttaaatttcagttttgacccaatttttcgaagcgccccattttccgctctctcctaaaaagagaggggggggggggggggagggactcttatggccttggtgaaatggtcgtgctgaatgggactcgaaagcgcatcccttcgcctaatcagccccaattgcaggaggatgaccgcgatcggcttgcccctctgaaaagtgccacggacggtcggcattgttttacgcccgccgtcggttactccgctcgtccctctactgctgccgttgactcgtcccaatgccattcgacaagtggcggcagacattgcgccgatttttccaatggcttctaccgtaccaccaccgtcgtggctaacggcggcggacttttgtccctgggcagccccggcagcggcactctgatcggagcggagcagaagtcacggtcaaccggaaatttggacaagaatggtgaggaagttcgggcatgggtcttttgcggcgaattgttttttttactttggtcgcgtttccgcgagaaatgtgctgcgagaatctcgactcgggaaatccttgacttattttatctcgcttattttttggttaaattttgacaaattcattgtctctaaaggaatctgtccaccaaatgtcggtgccgttccctcgacttctgccggccaacagcggagcttttccccatcgtcgcgcggccgtgccgaacgcggcggcataggcccacgactccaacgagaacatttgaaatacggtagggttgtcacggtaattagttttgttttggtaatttctcttttgttcaggctcactgcgcaattgtgccttaatctcatcaagcagttcgtcaggcggtcaacatcaattacggcaccaattcagcacgacggtgcccccgggggacgaattgtgcggcgaagcagcgacggcagagcaacagcagcacttaggattcattttggaccgtctgaacgacgggcagcaccaaaatcaacggcacaaagacattgacgagaacggcacggacggaatgccaaggccaaaacaaacagcggaagaatgtgtgagttgctaatgaggggggaagtgggcaagtcggtaataaacattgaaccaacgcaaagaagcaaaggaccggaaactcgagactcgagcacaaaggcaatcattgcccgagaaaacacgacgatgcccaccccaggcacagatatcactttgttctattctttaattccttctcaattcaaataggcgtgaaggagggggg

SEQ ID NO: 28483 - DNA, 1488 bp, Heterodera glycines
  misc_feature (227)..(227): n is a, c, g, or t
  misc_feature (282)..(282): n is a, c, g, or t
caaaaaattttgaaaaaatagaaaaataaccgggaaaattaaaaaaaggttcataggcaaaaattcaaaatatttaaaaattttcataattttaaacattttccatgcaggaaattgcaatatcttttattacctcatcattattttcggcatttgagctgctgctcggatgactcaaccattcattgataaagccaaaagtgtcggctcaaccctgaaaaattccnaataattgagcgaattcaataaaatgtaaaaatatcgagaaaaaactcacaaagnttgtctgaatccgacaaaaattcggttcgcttcgcccatgtaagccatcagctcatctttgctgtaatcaccgctcattgaaacagcgaatttttgcaatttttgctggcgtaagtttttcccggtctccaaagtttttggccataattcgtggccatggccgtcgctgatcaacacgaaaaccttggcatttcaatatgttaaataataataataataaaggcttttttgcatttattattattttttctggcacttatagcacagaatgcccgctcgaaatgaaaaggagagtacaaagagtactctcatgcaactgcagcgaaaggtaaaatcatttttaaaatctaaagtctgaaaaaagccttaccggaggtgcatttattcttttttttaatggattgtccatttttggagaaaaattaccggcactgccggacccaaatctccagtattctattataaaaatagaattaaaatgaaaattttgaaaatatcccaaacataaatcgctcaacattgtgttatcaaatctttttttttctgccttctattttttcgaaaattctatggcacttttatttattatttcaattattatctttttgtaaacaattaaatatcacctctcactcgatgctacgtctaataaatgcttctcacctttaatgcgccgcttcgaccgaatttctcaaattccttttgccctctgtcaattgcgtcacaaatttgtgtaacgcttcaaatgaataaaaaataagtttttattaaaactttcaatgctttaccctccgctgaattgcacttggcccactcggctgagcatttcggtgccattcaatgtgtcgttaagcgaaaatgccacggaaggtttttctgcaaaactgatcagactgacacggagcgattggtcgccgatcgaattttgcaatttggacaaaaggctcttcaccaaagccacttcattgccaaaggtgtgaaaaatggaaccactggtgtccaacaaaagcacaaggtcaacctaaacacagaaaaataggaaaaccaattcacacatttaaatgcaattgtaacgaagcaaaaaattcaaaaaccttttaaaagtgaataatgggaaaacaaacaattttaattatttttttctttgttttttggcaattttctcacagaatttttgagaaaaatttttagaaaatattttttatt

SEQ ID NO: 28484 - DNA, 1267 bp, Heterodera glycines
tattacagctaacgtacagagggggcttgaatgttggtgtgagagatgtgtttcgtacacaattaagcgtgtgagatgggatttagggggcaaataaatcggctcaatcgaactgggaggcaaaagactattgccaagtcttcctttagatcgaaggattttatccgggtctaagaagagggccagtgcctcattgtccttgtccgcaggggggaacaagttttgctcttgttttatgagcattttggtggactttcggatttcagaaattgatatgggaagaatggggaaactcggtcgaatgttagtccgcgggtcggttttgacaataaatcgattaaaataggacactacacggaggaggggtggaaatcggctgaatttggataaattgaagacggggaattcgggcagagtttgctctgtatgcaaagtcattattggcattgtttgggtctcttggaccggccatttatcagttaaaaatggctttagttccgggttggaagtccatcgagaaggggggagaacaagccagggaggtccggaccaccataaaagagcggactttaacgattggatggatgggaggccacgagttcctaaatctgccggattttccgagccagatacatgtcgaacggtgagatgggggagggatcggatgacgtttaaacggtttcggacgaatatttcttgggcggctgctttttggtggagccaggcgagtacaatcgccgaatcggtccacaaatttaatgtaggagagagggattttaaggccaaatgggactgggaaaattttagggccttgacgcccatctcaacagcaattaattccagacggggaatagtcaatttgtcgcccttgtgcgtgggctttactttagatttagcaaaaaggagaaatgaagagggagttgcctgaggggagggggacaccctgaggtacactgcggcacacatagccattcctgaggcgtcagtgaaacagtggagctgataagatgtttcggccaagtcggtcccattaaaggaacggggaatttccatgatttcattgggtggccaattttgggttagtttggacaattggtctcgaaattcagcgggaattggctggtcccagctcaatgtggtgtgccaaagagactgtaggaaaattttaagtgggagtaggactgggacgagtaagccgcaagggtcaaaatgggccgccaaacacgataggacagagcgtttggtaagagggggaatcggcggagaa

SEQ ID NO: 28485 - DNA, 897 bp, Heterodera glycines
aatttaaaaattctctgtgaaattaaatggcgattgtccaccccgcttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagagcttttgtaacgtataaaatttctcaaaataagagatagtcatttttcttggatataagataaatttaaaaattctctgagaaattaaatggcgattgcgcaccgcactccctatcatgctcgagagcatttgtaacgtataaatttctcaaaataagaaatagtcatttttcttggatataagataaattttaaaattctct

SEQ ID NO: 28486 - DNA, 1140 bp, Heterodera glycines
gttcagtgtcgtccaaatagtgtttctccatcggcgtttaattccaattggcatttctttacattttaaacaaaaagttatgcttgatattaaatctaccgcagcagacatgttgcatcaaaagataaaccaaaatgaaagcacagaatgggaacaaaggttggcaaaaatgggagaggaaaagagggtaaaaagggggaaggacaaagacactgatcagacggagaaccaaatccaaggggaaggacaaagacactgatcagacagagaaccaaatccaaggggaaggacaaagacactgatcagacagagaaccaaatccaaggggaaggacaaagacactgatcagacagagaaccaaatccaaggggaaggacaaagacactgatcagacagagaaccaaatccaaggggaaggacaaagacactgatcagacagagaaccaaattcaagaggaaggacaaagacactgatcagacaaccataatcgtaattcactgatctgctggttgttaaggccctcctcctccgtttctgttgccgagcggcgtctgcccgactgtctcataatcggagtacgaaagggaggcacccgcgctttgttggatgcgttagctttgcatccgcggattcgcgtggctcggcacgaagtgcatttcttcgaccggacggaactcttccgacatgggattgaatggtaccgcaagcaaatgcctttagcaaagacggacgaagtgggcagaagagaggacaaacggtgggcaaacaacggcacttttaggtggtcgtggagaaaacgcccgcctattttacgagccctgcggtgccgaagagagtgcactcgctgaacccggggatgaaaatgattctcattgtacgcgagccggtgaccaggacaatcagcgacttcacccaggcgaaaaacgattggatgaaacggggggcggagtcgttacttaaaaaacaatcattattgattttgatgaaaaattatttataacttagctgaaaagcaactgaatttttaattcttgatatcattcgatagcccttagtgatctctataagtctacaaaattccaaaaagtttcgataagtttcaaatgaagttatggctagaggaaatcaaataagcttga

SEQ ID NO: 28487 - DNA, 1033 bp, Heterodera glycines
tgtctgagggttattgagtcaaacgaaattttgatcttttaaagaatacttcaaactgttctgtttcagcttcgatcccgggatttttccgctgaagaagacaaagatgtccacgaagagcgggaatttgtgaaacaagaaggcgccgagaacttcatattgtacattaatgagttgagcaaatattacgggaacgtgcccgccatcgatggcataacattcggagtgcagcgcgacgattgttttggcttgctgggtgagttttctcaaggcatcgcagttcagtacctgggtaaaaaccaggggggggtgaagtgcacgcggacgtggtttatgcagaaattcctattcgccgcttattcctgccaacagatggcagaaaacttttaattatgctaacaataaagcaaattagcactatcaatacgaagataaaaataataaaaaaaacagtcaaagaaaagttagttttttttatctaacaagtgataggcgtgaactccaaatcggaaaatgcattataataccattggatagtgctcatagcggaaacccagggagttacaggcctcgaaaagggaattttagttgaattctcgcttctgcgaggatgaacacgtgaagaaaatgagcagaattggtggctcattgtcagttggttaaattcatggttttagaggtcggattcaaacccttaaaaatgaaaaatcgttaaaaatgaaaaaaaatgaataaaggccttaaggcactaaaaattccgattttcgaggccctgtaactcactgggtttttggtatgagcatgtaaaattaaatttattttttaaagttttaccgatattccgaccccggtcgcttagtgttctgtcgtgggttttaatttagccctattaattgttgatcacgacgttcatttcaggcgttaatggcgcgggaaaaacgacgaccttcgacattctgtccggcattaaattcgccacctcagccaccaaagcaatttccggcgtttgcgtctccaaagcatccgcccatcg

SEQ ID NO: 28488 - DNA, 943 bp, Heterodera glycines
  misc_feature (43)..(43): n is a, c, g, or t
ttttcttaagaaccatgggtgctctatccacccaccaaatttncatttggaaatcccacggacacctggggaccttcctttgtgagcggctcgtcgcctataatgcgttgggacggcggcagccggatttggcggcattttgcctgccataataagagtctaccaattttttatgaaaattcgaaaaaaaggggcggatcaattcattgttttctaagcttattttagtcttaaaaaggtgtttatgtggccgaaaatacaaatttagcaccaaatgaagagatccaattttaacaaatcctaaaataaaaaataaaacaaaaagtttgatttccaaatgatcatcataaatcatctttttcctccgatcatgtcatgaagcagcagcaacagtttgtttccgtctcgctgttctgtcctccaacagtctcttttcctcctcctcaacaatttggagtcgttttgtgtacggcacaatgtgccgttcgtagtccccaaacaagtcgaaccgtgcctggccgtcggtcaaccgatgaatgcattcgccaagtctgatgctcgcccgaagatagtccctgtgggaatggtagggaaaattacgtaattaggcagactattaagaggatggtgccgtacttactttgcgccagaaacgtaagcgtcgcccctgaaaatgaaataaggttttttttattcaaaaaatgcctggttgattttctaggggtttttgaggttgctgataccaagaatcgaaatcaagtttataaatttctaaaaattttttccaattgtttgaatccgagttagaaatctccttaggatcattttaacaattaaacaaataaatgacatcaaaattgtttggtttgtgggcaacaaaaaaaaagttaccgtccaaaaactttggctggcgccgacttactataccaactttgattcgttt

SEQ ID NO: 28489 - DNA, 1779 bp, Heterodera glycines
tataaaataaattaacccctaatgacatgtttttggatgatttgggtgaaaaaatttttccactcaaaaatactggtcacccccctttggtcccgaaccccaaaatcacttttgtttttgtaacatctctcaaaaaagtgataaaaatgccaaataaaatttatataatagagcaaaaaattgcggattttttttgtatattacttttacagtatgacttttcagaaccgagttatgaatttttttctgaaaaatcgaaaatttccagaaattctggaataactttttttctttcgaacattataaaaccaaataaatctcataaaattctccttatttttctctatttttaaggctttattcctgtaaaattgatcaacccttcgatttgttatgaattttcaaatattaggccaaaatcccgagggccaaaaaattgccaaaaaataaagaatttttaaaaaattccaaaaattatgaaacttaaaatagacatcatattcgtattcagcaccccaaaataccccagaaaaaaattttcacccccattttcgtccgaaaaaaaatttccgaaggtgagtggcaattaaattttttcttaattgttgatcgaattatggacagggttatatgggatcgggatttcgtgaagaaaccaggagcgggattaaatctgaaccaaaacccgggatggggatctcaacgagccgggatgataacaggagaccaatcccagacgaagtgccgatcccgtgtgatcctaattatggagaattaaggaattgatggacccgggcaaaggattatatgacaaaaatgtggacaaattgacattggccattgatgtcacagtgccaaacgaaaggaaagaacgcatttacgaaccaaatgggacaattgaaatggaaattgaaaatttgtcggaatttgcgcgagaagcctttggaagcggacgttttagcgaatccattctgttcatcaaagaacttccgtggaaaataatggcacaaataaattcgaagaatggaaacactgatcagaaatggttgggcttttacctttggtgcgctgctgcagaaaaaggtgaaatttgaacttctacactaattaagaatctgggccaaaactccaaaaatccataatttttctataattttcatcgtaaaaatatcaagaaaaagttttttttttttttggaaaatccatgaatgttcagaatttctaaaaatcaagcggcccgccaaatgctctaaaaagcaccaatggcaaaatatgcattaattctcgaaaaccaatatgcaaaagcatagaatttatagtcctattgatattaaggacgaagagaagtcatttctttgaacgagtggaactcagattcagcttggggtaagcaaatctaactttataagtaaatttttcgactcgagaatttagactttttcaagactttttcaagactttttaaaattgaatttgtttaatgtcattattatctttttttatctcattaagaagaaaattggagttgcaaatgttcggcaaccctccgaattgtttcacaaaaaggcgatgtgacggatttcagcagagatttcagtggccaaatttttaaccaaacgtcatacagctcgggattcccatatttcatcacttttgaggtgagtgtaatattattgaccagattccattaattgatccattaattatgtatgtaaattaaggaattgatggatccgagcaaaggcttttacgacaaagacggggacaaagtgaaattgg

SEQ ID NO: 28490 - DNA, 1925 bp, Heterodera glycines
  misc_feature (15)..(15): n is a, c, g, or t
ctatttaaaaatttntggttttatttttcatattctcacctttttggttcagccttttcctcaaaataaaaaaatttaggccttcaaattagagcaccagtgctcgatatccttgagaaagatttcaaattttgaatcttctaactgacatcttttctcatctgtttgggcttaattttttttacacttaaagatttgtgaaaacgatttttccaaggaatgactgcccctaaaaattgggtaattattctcgcttaaaagctcgattatcgagtggattttttcggcttttcacatcaataatattgcccacgggaatgacgaataaaactgaccatccgttgggcgggcaaaatcagttccatgacaaatgtgcagacaactaccaaagtgccaccaatggacaagccgaccatgaagcgagtggccaacaaaaattgccatgttgtggcgaaaactaattaattaattaaattaaataatgcgccaaaagtccgcaattttttataaatcaaattacctgaggcaaggacagacgaaatgccaaaagtaagggcacaaattgcaatgggacgacgcccaaacgcatccgaaagggcgccggaagtgaaagtgccgagcagaacaccgccaaattgggcctatgtaatttttttattccattttgtttttggttaccgtatcactactgtaaccaccatttgttctttgtacagtatcccgggtaagaaggcacagaaaaaattgtaacattaaataggcttattatagaaaatccttttttagagtatctttcggatatgggcagtgtgcggaaataattaaactccggaaaaaatcggatattaagaaagggagcagagttgccttagattgttcccttttttgagccaatgatttttaaagtattttggcatttttcctaaaatttattgcaataaaaaattatacacctattcctacaagaaaattaccttttaaatgttcaaaaagcgccccctccaaaaaaaactgttaagattttcaacaaaaatataaattggcaatgaatttacaggagcaattttatacccccaaaattatataaattagggcctattttccagtttttttttggaacctaagccgtagaaattccatttttgctgtacccacctgtgagtagagggcacgcttgtacgcgtcggcaccgcatagccacccaaattggagtgccgttgaatggaatgggatcggctgctcaagtgcagctgatcggcgggacagcggcgaacacggcacaatcacgcgagaatttgtgccaattttttgtggaagacaaatcttgagaagtgccattgttggaggtcccggcacaatgccacacgcggcacaaagttggagaatatcggaaaaggatggaataaattcaaataaattttacaatattcggtgaagcattgaaaatgggaccaaaaacaatttcaaaaatttttacataaaggaaaataggaacattaaaggcgcaaataattttttcatttttattattttttaatagaaaaatttttgaaagtaaaaaataaagtcttatttatttcaaaaaaccaatcttcaaaaagctaaagaacaaatcatttttgagaataatcgattctttaaaaaaataaacattttctgcaaaatgtgtttattaaaaaatttaaaaaacctttctttaattggagcccaaaacatcaaattgaccatgtaaaattgggtttattctgtttgggcttattgtttttcattgacataccgggaaaagcatttgagaagcgaagaaaattgcgaattgccatgtgagaagggcacacaaatggaaacggttaatgccaaagcacaacaacattccgaagttggttgatagtcgcaattcggaaatttaaattttaaattcaaattaa

SEQ ID NO: 28491 - DNA, 977 bp, Heterodera glycines
tttttgagtttttctggccataacttttttgaagcttaacaaaatttttcgcaatttttcagatgaatagaggacacttagggctatcgaacgatactaaaaatgttggattgttggcaaaaaaaaaagttatagccaaaaacttgcgctcgtactaaaacggcccgtactaaaccgaccccgaccccctgatttcattgttttggctagggttcggaccccgtgggcgggggtggcttttcgcgggggcgggggatggcggggtcagagtcgcgggggcggggatgggggcacgaaaatttcgcccccgcggggacgggggcgggggtttgatttgaattaactccaaaaaattttacaaaaaattaattttttatgaatgatgtgatggctccacattcctttagtcaatgtatcgcctcaattcaattccttttggcataaattacacagattttgtctaaagaattaccaaatttagagatttttggctaattttttaagaaaaaataggtttttggggggccggcggtgccgataggccgcctggcgaattttgaaatttaagctcgatttctaacagattttacacaaaaaaaaaagatttttacgataaatttttgtttttttatatattagattatcatgatttactcaagcaaaattggaactcaaatttgtaacatattttcttgtggcacatttttcaaaaaaaaacttggcgaatgtgcagcgcatagggggcctggatgaaaaaaaaatccaagacacgcaaagtttgacgagctcattgaacaaatggtcacctgaaagagtattccgcaattaaatgcatttagcaaaaaatatccatttccggattcgagaagcgcgggaagccccacgcgagtcatggcatagcgagtgaccaacacatggcaggcattctgaagcacaagcaccagcagagacacgtatttaagcagaattggacggat

SEQ ID NO: 28492 - DNA, 1625 bp, Heterodera glycines
  misc_feature (1540)..(1540): n is a, c, g, or t
ttatgactttttttctatttttaaattatataaatgccattgtctcctgtttttccaccattctcccacacatctacaaatacccaccacacttcccccccccccgcattttatgggggccacagaaattaataagtgaagagcggcgacgatgtgccaacttggcaaacattcttcgccctttttggcggatttgagagaagcgccatcagcagaagtgccgtagacggacggactttgccaatggacggcgaaactctcgacttgggaaaggggagggggcatttgagtaataatggcatttcagggacaaagtcattctccaatcaagaggtgaccattttggcatggcaaatgaatgggggagagcattttgaactacggaatttttaataaatagggaaaaatgaatgaaacggactcagaatcagcagatgatattcccaaaatgatcagtgaatgagaattgagtttgactgatcattgacgccgtcgtaatttgatcggcgaaaattttcccgtaggcatttgcatttttttgtccaaattgccaaatttgcattgcactcactcattaattgccatccgaaaaattgataaatttccaaaacccagagaaaaaacaaaaaaatttttttttaaattttatttgaaaatttaagaaaataattgttactaaacgtccattatatgaaactttcccattgagcccatagaagcaataatttgtcatgccattttgcaggccaacaaatatgaaaaatatgtagaaagtgatgataaaaagaacaaaaaattggccgaaaacttccaaaaaaggcaggcggacttggccaaattggccaatgaaatgcctgctgagggatgcaagctcagtgttggataccttaaagaaacggtgagcaattcgtttctgttcaccaaggggttcgaggaggaggaggaggacaccaagaagggcagtgaccaagcaaatgcttctgcaggtgagttgacggcgggacgtgaaaaaatttcgccgcaggaattttttttaaattaaattttcaacaattttttcaagaaaaaatcttggtaaatcattttttataagaaaaattccaagaagaaaattttgaaaattttttttaataatttgttgtatattttttttttaataataattcaccataaaatacaaatttttcactttttttagaatttcggctgcgagacctttagatttctctatttttacataatttaaaatattttcttttaattttcagaaaaaagatagggagggtattaaatattctgatagaaaatgcttatagttaattgtccaaatgctgagtcggaattctgcatttttttggattaaaatttcgttgaaatttcggcgtggctttttttatatttaaaaaataaaaaattttccattttttgtaccaaataccttaaaatttcttgaaattttatgcctcatcagaacaaacaacggctgaaccaagcacaagcaaaaatcgtcgtaaaaaatcccaatttttgtacgacccanacgatgaggaggacacagtccaggacagtgatgtcgacgatgatgatgatgatgatgaaagcgcggatgaggtacataggatttg

SEQ ID NO: 28493 - DNA, 782 bp, Heterodera glycines
aaaaaatggctcgtttctgctcttttgttgaatccaaggaattgggtcgccttgctgctccgaaggggaaatttatgagttcaaattgtaggaatttccataaaatttaggctctcctttcgcttttaggccttttttacgcccttgaattctctcgcaattaccggttgattggaaaggggataacggaagacaaattccgctatctagtgaaaactgtgaaaaacaacgggaaatggcattcgaattgatggaaaaggcagggataagcagggaggaaaaaactttcgggctacaacaccttgatatcatccagaaattttgggacaaggaattcccggaaatgtttcgcattgttgcttttgaaacggtattaaatcccacaaaattatttatattgttcttttttagaaatctggtcttaaaataatttacaaaggggagcaaatctgcaaaaacgaagtgtgtgttataagagagggagaccactgggatgggattaaatctgtgacccaattcttctgtattcgatacttttgcgtcagctgcgaaatgacctacaatcgccaggaaagacatagaatcgaatgtaaggaacgctgcaagaaatgttgtaggatggggtttgggttcccttgtgtggatgaatgtgcggaaatttattgcgcggtatgtaaccgaaaattctacaacgagtcatgcttcgaaggacacaaaaggatggcatgcaaagagttcaaaaagtacgaaaaatgcggagagacacacaacacaaggaacaa

SEQ ID NO: 28494 - DNA, 970 bp, Heterodera glycines
  misc_feature (817)..(817): n is a, c, g, or t
  misc_feature (851)..(851): n is a, c, g, or t
  misc_feature (861)..(861): n is a, c, g, or t
  misc_feature (898)..(898): n is a, c, g, or t
  misc_feature (914)..(914): n is a, c, g, or t
  misc_feature (937)..(937): n is a, c, g, or t
  misc_feature (953)..(953): n is a, c, g, or t
aaaaattcaacaatttttgcatgaatacataataattatgtattttgcttcaaaaaatagttacaaaatccaaacattttccatgacagtgatttctcagctataaccaataaatatttgagtcaatgagacaacttgtacaatggcaactcttacaataaaaattaaaataataagcttaagtctagggctcgcaagcctaagcctggcctaaagcttaggactaagcataaaccttaggcctaagacctaaagcttaggactaagcataaaccttaggcctaagacctaaagcttaggactaagcataaaccttaggcctaagacctaaagcttaggactagcctaagccattgtacgagttgccttttgtacaagttgtcatgacaccaaaatttttagtacttttacttttcttggtgtgtcgatgtgtacaaatccatagctttttcctcatccgtttcactcattacaatttgaaagccgtgcagcactttgtcctgttcaaaatgttttgcccattttgtttgctgtgccattttgcatttggtcgcaattttattgtcctcctcataattttccatgtgatactgcgaattcagtcgtgcatttgccgggtccatttgtccaagaaaacaaaacgtaattctaatacatttttttgaatatatttttaattatatttgaattatcaaattttaatatttatatttattattattgttttaatgacttataataaataatacatcgctttggccgcacattctccaactcggcacacactcattttcaaatggcgattatcatgtccagnggtggtgttgaaatacaacgtggattggattggngcacaatggntgttgatcaagcccacttgcaagacactaattagcanaacttgatgataaaanacaataatatttttaatttgttntttttaaatttatttntcttacttatcagactc

SEQ ID NO: 28495 - DNA, 892 bp, Heterodera glycines
taccggaggcgcctatcggcaccgccggacccccattttaccattttttgaaaaatgagaccaaaatggcaaaaaatagtaattttttggtgaaaaacggcgaaaaattttgtaaaacacccccctaattcggaatttcaaaaaacgaaaaatacacccctaaaaatcgaatttttgacttctggcccccccccccccccgaagccaagggtctggctacgcccttgatattaactcttttgggacctactgaaataataggggccacgattgctttgaaaattaatatctgcttaattaatgatatttttttgaatctgctgaaaatatttttttgggaacatggataatttttccaggacctgataagggcttccatttttaggcaaatgcctaaaatttctgcgcacttgttacacatagataagcgcgacaaaagcattttccgcttggtttggggtgtctatgatgacttttataatgcctatttttgactttttgtgcttaatgcctattttttatgcctattcgccatttttggcgcttttttcaggattttcggaaaaattcttaactaaaatgaaaattacacccctaagaatcgatccaaaaattttcacaaaaattgatccccaaaattcaattatttttttcttaataaaaatttttgaaaaaaatgtccttattcgataaaactttaaaacaacaattgaaatataagcaaaattaagttttttgattaagtcgtttttacgtgatttgctacctaaatagtgttaataagaaaaaaaattttttgcccattttttgtgcctatttcggggatttttgtgtctatttaaggcctattttgcgatttttatgccttttaaggggctatttcccgattttt

SEQ ID NO: 28496 - DNA, 1589 bp, Heterodera glycines
  misc_feature (1569)..(1569): n is a, c, g, or t
gctcaataattagtgtaatattattacttcaattaaaagtaaaaagtattttttatttattttctaatgtttatttcttatttaggcttaaacaagttcagatgtccaattatttaaagttttttaaatgaatattgaagattaagattaagctgtactgatgctgttaattaataaaaaggataattaattttttatattattatttttttgcaattctttataaagcattttatcaagtcattcaaaaagagtcatttagccgagttaaatattcaattttgaataatttaacagaaaatagccgtttttatgaaatatccagctgatgctttaacctaaaaaactgatgtgatcaataagtaattggttttggaattaatctatatatttttaatttgatttattttaattaagctttgaaattaaatatttatatactatttttaatcttgtttccaagggcactccatgaatttcctgtgtaggcgccaaaactcgttcttttgtatttatgctatttttaacaatcattgtatttaattctattgactcgttttacacattatttttaatatgtttaaaattgtttttttatttaaataataattataataataataattttatataatatttattattcattcattataacattaataaatgtttaaattagttatttttcttttccaaatgttatttttttccaaaaaattaaaactcttaaatatatttaaataacgcttaatttattttaattattgttacatcttttctcaaaattccaatgtttttcttttatagattgaagattaattttgaggattaattaataaattttaatgatttttattgactgattcttcattttttcttcaaaaatatacttcctttataaaccattaagacaattttttttatataaattttaaaatttacttattttctggtataaaaagacaaaattcattcacaaagaaacaaaaatttagaaaaatcagtatttaataaataatttttaaaatctaaaatttttatcaaaaaaaataaaacaaataaatggagaagaattgaaaaattttgggatgcttcgtatgggatgtatttttcgttcttatagcatttttgtttataatttgaacaaaacgccaaaataggtcaattttttaaaaattaggctctaaaataaaacctagaaaaaaaggtgctaataactcgaaaagtatttactatttattgattacattattttttataattttttattgttaaagtgctaaaagattttttaataattcatttgcatttcaggttcaataatttatcatatttattaatttaataaaataaaataattaatactaaacattttattttttttataaatttgtaaataaaactgtttgaaaattaatctttttagataaattatatttaatttcgatgggcattattttgagtagaatttagattattttgagtctcttgccatgcttcctcttgcatacttttccattcaaatgtttttttttttataatttttatctttgttcttttattcatatnaaaattaaaagtcgttaaaa

SEQ ID NO: 28497 - DNA, 1396 bp, Heterodera glycines
aatcaaaaaatgattaggttttgaagacatattttcaattttcatattggctcttttgtagaccattttaggtcatttctagagatttatagttctttttacgtctgattccacgaaaaggtcagcttcatttcgttgtcttcattgtggagtttcttcaggatctgcttagtccccaccacaccaattatcgggttagaaataattcttcatagctaatcattggctctgttgcattggctttgtttgtcacaaaaagacctttcaatgtttagattggcccttacatggactccctataagattatggaacttggtaatatgagaaaaaaatgctgcagaaaaataacctgaaaatttaggagaacattattaaatatgtaaataaaaaatgataggttttgaagacatatttacaattttcatattggcttttttgtagaccattttaggtcatttctagagatttatagttccttttacgtctgattccacgaaaaggtcagcttcatttcgttgtcttcattggtggagtttcttcaggatctgcttagtccccaccacaccaattatcgggttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgtctgattccacgaaaaggtcagctttatttcgttgttttcattggtggagcttcttcaggatctgcttagtccccaccacaccaattatcgggttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgtctgattccatgaaaaggtcagctttatttcgttgtcttcattggtggagtttcttcaggatctgcttagtcccacacacaccaatatcgggttagaaataatcttcataactaatcatcggctctgttgcattggctttgttt

SEQ ID NO: 28498 - DNA, 1688 bp, Heterodera glycines
  misc_feature (11)..(11): n is a, c, g, or t
aatagataaanttcgaaaaaaattattaagaaaattcaaggaaatgtaaaaaagtcgtttttttatttttctggaaattcagaaaattagtttttatacgagacggcgacgttttaggggtgtacccggtctgtggatggtattctgagttattttctgaaacccgaccccaaaaaagttataaatcgaaaatttctgaaaaattccgaattttatcaaaaatttcggaaattggaattcagtgccatccctggtgtggccataattcgacaaatgattgatttttgttttccaatcaaattgtttagcattttcttcgtgccaatgccatttcttccgtcagttacgaaattcatttttctgttcgtgcgccgtcaatgccaatggtgccattcgaattggtgaacgaatggacaaaggaaaagctgacattggccaaagaaaacgaaaatgacttggagaattggataatgaagcgatgcaaaattggagaggccgcggatgttcagcttcagaaagatgaaaattggggcaacaattttaacaatgtgtccatttggcttttcagtactaattgcatcgggtgagcaattaaaaaagtcatttaattttgtttaagtaattaaaatttcgcttaattaaggccattgtctccgccatcagcagaagaacaacaagaagcaggacaaagcagcgaaaaaggggcgtcgtctgctgacaaatgagtgacggacaaacgaacaaaaacaatgatcagccgcagaagaagaaatgaattaattaagaatgatcgatcgaccgatcatattcatccgtgatcaaatgcattttatgaagaaaaacctctcaaatatatataaataaatcggatatataaaatggtttgctatctatcgaatgaatgaattttcctttcaaaaatgtgacaattatttttcgggattttggcgggggatttccgacatccattagcaatacttgttccgttgctgctcctttttctcctccattttcctctctttctcttccgtctctcctccttcctatgttcttgcttctgctgatgttgttgtttctgctggtgttcagctgcaattttctttttcctcttcttcagttgctgctcctttttctcctccctttttctctcttttcccccattttctcttccttctcctcccccttcgctgtttcctttttgctgttgttgatttcgtgtcacgacatttgcgccaccagccaaaaaacgacaattgcggtccgtcttttgcggcccgacatttgcgcctcggacatttgcggccccatttcttaagggccattttcggacatttgcgtcccgacatttgctgccaaaaatcaaaataggtctctcatcgaaaatcctttttttctcttcaatttatgccgaatttactcaatcgagtaattctttctcgaaattgggcttggttcaaaaccccctccaaggttaaaagttttttatttaaaagaaataattttgaactttttccccactatttttggccatatttagttattatttttgggaatttggcccccaaaaaacccgatccctacttctaaccttgcttttttttggaaattttttttgactttttttaccctttttcggattttattgacttttttggagttttgggaacttttggttcgggatttttttg

SEQ ID NO: 28499 - DNA, 1196 bp, Heterodera glycines
tgaggcatatattattttacaatcaaattaactcttgaactcgtgtcggcgcctcccacctctcgtccaacgacggcatcgggttgggacgacgaagcaaaaagaagggcatttggagtaaaaataatttgtgatcaaaaaaaagggggcgggggcggggggttggaatttttggaattttaagagatggacgcgaggcggaaaatgatccaatttcttatgaaattgggttctccctccccaacccttccccgcattggaacgggaaaaaccgtacatttagcaaggaaatttaaaattttaattgagaattcctaatttggctattactaaaaaaaatgttgccaaatatcgacaaggaatcggcactgatcattaaaattcactagagccacgaagacagctcaattagctcgtcggattttgtattatttgctctctttaaatccccggggcggcgcggacggacggacgaccaaaatgatcaaaatgaccaccgtggccacttcaatgacttttcaaatcacccactttaaattgtctttgtgtgttttgcgcatcggccaatgcaacaaaattttgaggagcataaaattggctaaaattagcacagaaattccggcgagaaaacgagttgagaggatttgttgttgccatcgctgcttatccatcgccgataatcagaatttattgaaaacgaaaatgtccattattttattgattttaaaagttaattggttagatcgatttgtcataattttacaaagtgttggccattttacgactatctctcgtgcctcttgagcaattttcaaaatttttgctctcgagaaggttttactaatgaagccatcaatctaatcggttcatcgtttttttcatttttcagttttgtctccgaatggttggtccgttacattgaaaccggcgaggactattgaccctcgggggacggcggtggaggcgctgatcggagagactgacagaagcaaaaccatggatcattaacacactttaattggccaacatttcattgtcccgctgactaattagtaaacttattgtattttaattatgtttggatatattcaaatttgtaaattattttaaagtaaacaaattcgctatttgccagaattttgtaatatttttgaaattttaaaatattaattagagaaataattaaatcgtaatta

SEQ ID NO: 28500 - DNA, 1756 bp, Heterodera glycines
gcatctaatttctctctctttctctttcttgcacttttcctcattttttttgttgataagcctgaccaaaaatatttaaaaattaatgtcaatgctttgtgtaatgcgttcaaagagcgagaaggatttaacgaagattagaaaaagtgcggaggaagcagattgcgaacaacagcaaaaaaatggcacaaaatttttaaattttcatttttttcaaaaataaatcgtaagtgtcacggggtggctggttttacactttgttgattaaattttttcatttattcatacgttattattaatttttttgaaatttccaagtctttattgaggtaataggcaaaggttgcaaaatgttgaccaattttaaaaatgttacataatgtaattgggttaatgaattaagtgatcgaaataaaaaggattaagaggctggcatcaaacatatactgataaatgttgtgttagtgataaaaaaagtcaattaccaaattttcgtttttttgccaaaaatattaggagctattataaatgcaataacgtccggactataaaaaaaagtttttttttgttcaaaggattaaacaaacataattgaaggtagtggcacaccattgttaacccggtagctgagcggtgttgcttgtacttaataatatttaataaataaaaacacacaatttgaagtcaactttctgttgcagctggggcgtccaccgtttcagcttgagcacgacgactgctaatcgtggagaggctaattttttggcaatatttgcgcaaacaataaggactccggcgcaacgaaaagtgattaataaatagcgaatacgattgaaaaggtttttcaaataaataacgatttattaaaaattaataacaaatataatgatattattaattgaaggatatgagttagatgcaaaattataagtctcctcaagtttatttctttggtctgaattccaaagcgcagaaatacagacttaagccacaaaatttgacatattgaagtttaaataaataagttacaatcgcacaagcgatatgtcaacatgtatttggggcgaaaaagtttccaggattgagtttttgaggcgtttggtttaatgtttatctcttcttttggttcgttcatgcaggaatcctcattatgcatcattatgaatgtgaattggttgttgcttaggtaaatttatgaatgaatttaaaccgtaaaaaatttttgttttatagatgccaatgtttgtttaacctagctacattttaaatgtcgaaggttgaatagttttctgatttattatcaaacaactttaacaacaacattacgagattaattttcgtccttgttgttttccatcttctgttggtattcttttcgctttctcatcaaaatttcatctctcttttctttcttcttggcgtattcacgtaggctcttctcaacttccatggcagcttttccaccgaaaaattcacgtataacctagttttaataaaataattatcgaaagacaaaaaaattttaaaaaaagttatttacgtttgcctcatctttgtcgaggaattcttgccaaatctcttcggcaggcatttttccatagcaacgctggtcccattcaaccacttgctccggcgtccatttcttaacttcttctcatcatcgtctgaatagtttaaaatgttattaaaataattataaatgttgaataaaatgatcatgatttctcgtttttatacaatttattatttgtttaac

SEQ ID NO: 28501 - DNA, 943 bp, Heterodera glycines
atcatgaattataaagtggtggaaaaaaggcttgactcaaactgataaaatttatagaattataaatcgactggaattttagctaattattttttgtatatttatatatatttatttaccccaatatatgggccgttcatacaccacaaaatagtttcaatccgctttaacaatctcgtgaataagtcgcttgatcagacttgactcaaaaaagggcggaaaaaagtcttgactcagacctgaaaaactatttcacaacttactcaaaattctgaaaaaatcaagtataatttttgtgttcaagtcatagccctatcattcaaaaggcaaatcggtagagaatttttgctctttgcaatgaaaattttcgcagcaccataggaatttttttctaaaattttcccgatttgaagcaatttttgactttccagatcaccatgaaggagtactctgattaaattgatgtaaaagacttgattcagcattccagccttttttgagtcaagtctgttcaagtgaatcaatctcgggaattaataagtcaaataaattattttgttgtgtatgaatgagccatatattgatggtaataatagggctggccgggtcccagacccggatacccggttttttcactacccggacccggacctggacccggttttttgaaaatccaatgcccgatccgcgtcccatagcgcgatagcgctttaaaacatcacactaatggaattaatgttttgtatgttttaaaataacaaatgagggccatatattaccaagccacgtatgcacaccatagccaactgggcaccctagttatatatacgttatattgacaaggcaactcatccttaaaaccaaaatctggcgaacgggaaccgggagcgccctgaaagtagaggaagggtcttacaactttttgaggcgcatctgggaaaaa

SEQ ID NO: 28502 - DNA, 278 bp, Heterodera glycines
tataataacgctgcggacatctacatttttgaattgacctaaattggtaattactctttctttttctccatattgaccatcatactcatactccccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 28503 - DNA, 1027 bp, Heterodera glycines
  misc_feature (25)..(25): n is a, c, g, or t
attaagatgatttaagcagggctcncaagtgtccttaaaaatgcaaaaattaaagatggtgtctacaaaaacctctaatcgtcctcaaaaaatttactcgaaattgcataatttggacatttttttgtgaaaatctgttaaccaatcacaccaaaatctacaaaaaattttccccggcggcgcctatcggcaccgccggactccaatactctatcttttggaaaagtatgccgcaaaaaagcagtttgaaaagcaaaaaagctcattccaatcgtaaattggatccgatcggttgataatgctttttaactgttttacaaggtaaaaagtaatttaaaaaaatcttatttttggggtcaaattcttagttttagcatcgtttgtcctttttttttaaaaaaaaaaacttgggagccctggttttaagcaaaaaaaaagaaagaaagaaagaaaagccacctgtttcatttgcatcagttggatcagcttgatgtaccgtaatatcatttacagtaagcatagcattgggaacaatctgtgagtgcagataacgtaaaaaaattgtcttttttccatcaaaaaatttaaaaaatggataaatttaccacttgaacatggtcaatggtccatggccgcatttcccaacctgggtacattgtccaataatatggacacagtttaatgtagctattatcatgaaatgatattcggccatagaatccgttctccgccatcaaaatttgcagtgataaaggtttatttgatgatatccccaatgaattgttttggattggccctttctcgattttctccttaaaaatgaaaatttattttttttattaagtcaaagattgctctgctgctgtcattatttcacaggtcttttacccaatcctcttgttttttcttttgtttttttttttttaaatttttcgaaaaaaccagtaatatatcatttaaaaaatcgctgaaaactttcaaaagttttgtcgatacattttcagtagaaaaattttagtacagattc

SEQ ID NO: 28504 - DNA, 1157 bp, Heterodera glycines
  misc_feature (18)..(18): n is a, c, g, or t
  misc_feature (88)..(88): n is a, c, g, or t
gctcgagcgctttgtacngtataaaattctcaaaataagagatagtcatttttcttggatataagataaatttaaaaattctctgtgnaaataaatggcgattgcgcaccgcactttcctatcatgctcgagagcatttgtaacgtataaaatttctcaaaataagagatagtcatttttcttggatataagataaatttaaaaattctctgtgaaattaaatggcgattgcgcaccgcccttcctatcatgctcgagagcatttgtaacgtataaaattctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataa

SEQ ID NO: 28505 - DNA, 966 bp, Heterodera glycines
tcagtgtaaaaattcgactggccattcaaatttctccctttccaaccttatgggaaagatattatggaactttttggttccatttcagttgtcaacgccgcgactgcatcgttattatatcagtcgatagaattttcgaatcgcttttaaatcatctcttttgcgttccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttatgatatcagtcg

SEQ ID NO: 28506 - DNA, 1405 bp, Heterodera glycines
  misc_feature (186)..(186): n is a, c, g, or t
tagtaaaaattgggtttgatatattataaatttaagagagtcccatttgtccttatttaagcccatcgtcccttttttcgtttgtttttacgatttactataaaatacaaaaaatggtaattttcgactaaaattcatttctatcgagttttaataaatgtactttttttactccaaacattttcncacctctcactgaaaaattattgaaaaataaatatttacagaaattaagagtcaaaaaattaatgaaactttagtgcaaattttttgacgaataagaatttttttatagaaaattggaatttgaataaattctagaattttgattattcttcaagcaaaaatctgaagaaataaaattcaaaaaatgattagttttaaagtcagcaaaatatttataaataagattcctcttaaaatttaatttcgctaaatttttaaaatattccctaaatttctctaaacatttttaatttttcaagtgaagggggtgaaattacagttttttagaaaggtaccgtatatgctctaattatagcccagtctctattaatcccgcagtctccaattatcccccaggctacgaggtgttttgaaaaataatccctctatcataatcctccagtctctaattatccccccttttctgtggaggttgaaaaataatcccccatgggctataattagagcatatacggtaatagcacaaaaaatataagtatttgcacaccttccccgaagaaggcgctgtccaaaaattagggtaaacccataagcgtcccactgcacggaaacctttagtaaaaggcgaaagatttcatcgtccgaatacaaagggaccagggatagacaagtggaaaaatagttttttttatagaatttttaaaactaaaatattatgggttgaaatgcatgccaggaaaagattttctctttactatatctctctttctgttattctctctcttgctttatctctcttttcctctcttctctgccaactctccttttacgctgtggactttcttcttctctctgtccatttgtttcgtcgccgcattaaacaaactggagacatccatgcactcttctttataaaagagaaaaagaattgaatggagtgctacggaaaggagcaaagaaataagatgaaaaaaatagtgcgtataattctctgcatttctctcccttctttttctcctcatcttttatttaaatatagtttatcatttattttttttactttacttccgttgttagccttgcgctcggtcaatacagcgagcaatgaggcctagccgagctgctgttattgctgattgaaaacttttaccaattacccgccttggcctgcgaaagcggtgccttgtgcaatttttggacgccctccggggcttaaaaa

SEQ ID NO: 28507 - DNA, 1042 bp, Heterodera glycines
aaaagcgaaatttgcgaaactgaaaaatgcgaaatgaaaaaaagcgaaatgcgaaaagcgaaatttgcgaaaaagcgaaaggcgaaagcgaaattttttctacaacttttattagttaaaatcataaagcaaaaatcattttttaaaattttattccaaatttaaaaatcaataaaacgcttttttgaggcgcgctttttccaaagaaaatttttgggaagagggggcaggtgccgccgggaaaattttagaaaatttgattaaaatttgttgacagattttcactaaaaaatgatcaagatttttatcatttttctaatgagaaataagtgttttggggcgccgctgagaacagtatttcatcaaattaccaaattttgcgattttgggccattttctaggaaaaaataggagttttgggggcacggcggtgccgataggcgccgccggggaaaaaaattggaaattttgatcatttataaacattcactgaaaattagccaatttataggtaaaattttgaaaaattttatgggaatttaatccaattcttaggggtgtaaaagtcgcttttcgcgccaaaaagcgaaaagcgaaatgcgaaacgccaaaaaatgcgaataatgcgaaaggcgaaatgcgaaaagatgtattgcttcatctccttccctcccaatgcttcatctcccctcttcccctccctccctttgatgtactgctttatctccttccctcccactgcttcatctcccctcttcccctccctccctttgatgtactgcttcatctccccctcttcccctccctccctttgatgtactgcttcatctccccctcttcccctccctccctttgatgtactgcttcatctccccctcttcccctccctccctttgatgtactgcttcatctcccccctttcccccccttccctttaaggaatggctcctcctcccctctttcccccccttcccttgaaggactggttcttcctccccttttcccccccctccctttgatggactggttctactcccccttt

SEQ ID NO: 28508 - DNA, 1085 bp, Heterodera glycines
acgatgatttgatccgacatattcattcattgcaataccgtgtggggattattagaatattgttgaaaatattaattttgttgcgttgttaaaaattagtatatgtttgtttcgcttatgtcaaaatagggggggggggcgcaagtgtcggcggcgcaagtgtcattttgactgggcggcgcaagtgtctgcggcgcaactgtcgcggcgcaagtgtcggcggcgcaaatggcagcggcgcaagtgtctgaggcgcaactgtcgcaacgcaagtgtcggcggcgcaagtgtcattttgactgggcggcgcaagtgtctgcggcgcaactgtcgcggcgcaagtgtcggcggcgcaaatggcagcggcgcaagtgtatgcggcgcaagtgtcattttgactgggcggcgcaagtgtcggcggcgcaactgtcgcggcgcaagtgtcggcggcgcaaatggcagcggcgcaagtgtatgcggcgcaagtgtcattttgactgggcggcgcaagtgtctgcggcgcaactgtcgcggcgcaagtgtcggcggcgcaaatggcagcggcgcaagtgtctgaggcgcaactgtcgcaacgcaagtgtcggcggcgcaagtgtcattttgactgggcggcgcaagtgtctgcggcgcaactgtcgcggcgcaagtgtcggcggcgcaaatggcagcggcgcaagtgtcattttgactgggcggcgcaagtgtctgcggcgcaactgtcgcggcgcaagtgtcggcggcgcaagtgtcactttggctgggcggcgcaagtgtcactttggctgggcggcgcaaatggcagcggcgcaaatgtcggcggcgcaagtgtcattttgactgggcggcgcaagtgtctgcggcgcaactgtcgcggcgcaagtgtcggcggcgcaagtgtcactttggctgggcggcgcaagtgtcactttggctgggcggcgcaaatggcagcggcgcaaatgtcggcggcgcaagtgtcattttgactgggcggcgcaagtgtctgcggcgcaactgtcgcggcgcaagtgtcggcggcgcaagtgtcactttggctgggcggc

SEQ ID NO: 28509 - DNA, 915 bp, Heterodera glycines
atattttttgaattttcctctatttcttagatattttgccaaaaataacgattaaaaattaatacaggaaatacaggtttttaaggcctgtacctgtacctgtacctgtatttccaaaatggcctgtacctgtattttctgtacaaaagtacaggaaaatacaggtacaggaaaaatacaggttgccgaaaaatggcctgtacctgtacctggatccaggaaaaatacaggcctggatccaggtacaggccgatctctactaattattattttttttttacttttcctttttgttgctgttgtttgatctgcgcaatttctgctccaaattgctcaatttgcgttgaaatttgctccattttctattttaattttaaatttatactttacatattttttgtttacattttctgcactttcatttctttgctttattaatgttatttctgtacaaatttgtcgcaaaattccctaaatttttgttttaggaaatcttttaaatttattattaatcaattatttaattaatacgttctcattttgatgcttcaattcatcaattccagtttgaattcgcccaaattgggtgaaaatttcccgcaatttctaaatattttttattttaaaagcgtgcttgcgcgttttataaaaaccgccagtcgcgttttataaatccgccaatgtaaacaaaatattgtacatatacgtgattatcaattttttatataatttaaaaatagtaaaaatgatcgagtaaaaatgcgaatttttattgctctttaaaactctctccaaaaatatgaactgacaagcataacaaatcctaaacataataaatattaaaaaatataaaaaactagcaaactttttgttagaaaagcaatcaataagttttataaagacaatatgcaaaag

SEQ ID NO: 28510 - DNA, 1850 bp, Heterodera glycines
tgcgcttacaaaaacaaatcaaacatttatcgttgaatatactcgaaaaaacagctaaatttcggattttctattgtaaatcttttcaatatttgcttttttcttttacgcataaattgctgagactttgaactagagaccggaaatttcaaatttgcggatcccgctgcgggactggaactcaaatttgtttgcgggacgggatcccgcgggattaatcccgcaaatcccgcaatcccgcaaatcccgcatttaaaatttgcgggatcccgtgcgggattgcgggattttggaaaattcgaaaaaattcaattaaattcaaaaaatttccaaaaatcaaaaaatgctgaaaaataaatttttaggggctggcgggatgcattaaaaggtgctgatgggtcgactaaaattttccgattggatccgacggtaaaatttgatcggaaatcaaattattaacggttcataaatttgactatttttttcttttcaaaaccacttttttgcggtgcagtttttcaaaaaactaggaacagagggccggcggtccttatcagggatggcattccgaggccccaaaaattttcggaagtgtcgaaaatcggatttccaaccccaaaaacgtcggaaatcggaaatttttcaaaaaatatacaatataataaaaaaaatttctaaatattttaattggctaaattttttaattcttaaccaagtaaaaggtatttcacaaatgtttttagtatattcgcttgaaaaaattattcaattattttatcaaaatctttttttgtcatttttcattattttagaacatttttgggaaaaggagtgactatttacacgttttttacagcgcgattttttcaaaaactttttgggaacttggaggagagtacggcggtgccgataggcgccgccgggaaaattttaaaaatttcagttcaatttattaacagaaattgtacaaaactgactagttttttgaaaaaaaattaaaaaaatttccaacttacatcaaaaattttggaagtctttccgtgccatacctggtgcctatcgacatctgcgaaaaacttcaaaatttggactagaacaaatttatacacaattatttaaatttttaagcccgtttaataaagaaatcaattttattgacaattcaaatttaaatttgataagaatatttgatttatttttggtataatggcaagcgagtgtatgcattacaaattatacaaatatttcaaaagaaaggcaaatcagcacgggaaattaagtgaataaaaacaacaattcgggcatgttttgatcaggtatgacatcatttgttcgcagaagtgggcagggacagccccggagagaacggaaggcatattaaggataaagccaacctcccccccccccaactcagcgaaccataacataaacctccataattaatgctgctcttgcaagtcactacttctacttcaccgactgcatgtacatgatcaaaatgtcggttactgcttgtttgatgctgccgctactgttgatgttgctgccaatcatggaacaatagaaattgatgatgatgatggcatcatggtcttctgctgccaagtgtgaacaccaccattaatgctattgttgttgccgctttgcggcggaggagatgacactgccgtcgattggagccgtgaaattttgagcaaatggtcaagctgttcacgactccggttagacatgcgatcaccgagcacgtccaaaagcctaacaaattcccattagtactattgcgatcactgtttgcataacatttatagtgagtaataactaagaaagagaaaaaattccatacaatcttt

SEQ ID NO: 28511 - DNA, 1503 bp, Heterodera glycines
  misc_feature (1399)..(1399): n is a, c, g, or t
  misc_feature (1416)..(1416): n is a, c, g, or t
  misc_feature (1461)..(1461): n is a, c, g, or t
  misc_feature (1483)..(1483): n is a, c, g, or t
ctatcaaatggtatcaaaaattcaaaattagttgttttgagtaaaataaaggctaatttttgtttaaaattttcatttaatggtttttttaaaatctataacgcccttttgatggctttttaactttggacattgaactttaacattgaaaccaatgcttccatcaaggctacacttggccatgcacgggcaatgtgtccaatgagccgccggatcggattgacttcatcttttacaaatgcgatcggcaacggcgaatgaaggccatccaatcgttcatttatgctggcactgatcacatggaaaaagcattgcattctgcgaatggcaccaacaggcaaagcgactggatctcagatcaccacgcggtggtcaccgattttgtgctgtacgcgccataaaagaaactaacgaagcgacccgcggataaaacgccaaatcagtcaaaaacaacgacaaaacgccaaaccgacaaagcatcgactcgacaaaaaaagaagagcaaaacaaaaaaggcgaaaaataccgacagaaacaaaaaaaaagggcttccttagccgaattttaaatcattaaggttatttaacatttaattactcttttggcataaaagattcattaaaactttgagaagtactaacttcctttcacgcctgcgctggtttgaaaatgattttgtcagctttcataatttattgaggcagatatttacaattggtccattttcaaaatcgaaaggatagactaataaaaatcttccaattcataacaacaacaactgttcaaacattggttgatcattcgaagtcattagctgtggccacacacattcattcattcattcagtcagtcattttcgtggccaaaaaatgtgcgaaagtgcaatgtattttggtgccaaaaatggtataaataggcaaaggcgggcatggaaaagtatcattttaattttaatattaatcaaataatttaaaacatttatccattaaaatgtttatcaactcttccaaaatgactgttttcctgttggccttcaccattttggccttgctttttgtttaaatcaaaactttaagcttggccaaaagtcggcggcaaatggcaaggaaaagcattcaaaaaagtaaaatgaaatgaacaaaagcggatgattatttgattaaggttttttgaaaaagtaacaaaaatctggaattatttcttagtttagtcgacaaaattagtgtttttctcattattatttttttattaaaaaagacaaaacatattatttatatttaaaaaataattaatgggcattggatgccaatttttctgtgcactcgatgttttcaatttggtttggggctcgtaagtgcctctcgtaatgtatatttttgttgatattttagggacttanagaaattctttaataanataaacaaaaatgggaaattaactactaagcattttaaaaataanatttaaagttttgcctgattanatgaaggttttcatattttc

SEQ ID NO: 28512 - DNA, 1019 bp, Heterodera glycines
atttttcatgcaaattcgcataagagcagctttttctatgttttgcttttgcaaattctttttcttttctgagtttgtctctttttagaggataaaataaggaacgaaataaaagagaaaaggtcaaagggaataaatgttacgatgggcgagggaagggacattcatttgggggtcattcgttctctgctgatgcccaatgtccattcttcccctagcaccaaccagcacgtccccttgggcgggatggactctttcaccgttttttttttgaggggtgacaggtcattgaacaccaaggaatgaagcaagcatagagtgcgttcagcttaaaccgtttacacccacactgccacacttggttatttttccacttttattggtacaaacatttcagtaagtcaaccacttaggtttacgtaggaggctggctggctccattgaattgtatagttgacggtgtgacgggcgggcgcgagaggggggcggggggcagtggtcacttcggagatttgggtcgtcgtcgtccactttattttgcatctgcatccaattcgaccatctcctgtttttgcccacatttgtttgttgttttgctgtttcgtcgttatgttccattgccctcttttgcctaaatatctctcccccgaggggaggcggtggactgaggtcggcggagggggaggggaggggtgacagccagtgtcctgtctatctccacagctgtccctcgtccgctgccgtcccctttttcgccgaatgaccactgccctggtcactctgccttcagcagagcagaaaagggcaagagaggtgggagtgaccaatgcaaaaacaatgatagagatggtgaaactgagagggtcagagaaaaaaggggagggcagagataacagcaaacaaacgaagaagaaaaagtaggaggcataagaacacaaagcagaacagaatggcagggtaaagacgacaaaataacaaaatatgcatccagccgaaggtcggtcggagaagcccgtgct

SEQ ID NO: 28513 - DNA, 927 bp, Heterodera glycines
cgggtgctcagtgtaaatatcgactggccattcaaattctgcctttccagccttatggaaagatattatgaaactttggttccatctcagttgtcaacgccgcgactgcatcgttattatattagtcgatagaattttcgaatcgcttttaaatcgtctcttttgcgtcccttaatcttcactctgagccgagttactgcggtctaaacacgtttttggtagagttgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttaggaaagatattatggaacttttggttccatctc

SEQ ID NO: 28514 - DNA, 1919 bp, Heterodera glycines
tcaaattggtggccaacaaatggcgaatgaaatcgcccaaaacactctgaaaatacgagcgaataatcagagggaaaggacagaacgccaaagggaggggaaagtgccaaaatggacgaatgaatgaatgacctgcagatagtcgttggccaccagtttcatgtacgcctccactgcttttgtggccagagaattgccacggaaaaggagatggtctaaaagaaggggagagggagaggtgaatggaatgccaaaaagaacagaatgccaatgaaatttctcaccattttcttgcccgtccacttcgaccattgccaaatcggccaatgcttcggccgcccgtcgttcgtgctgcaaaacgcggaccaacgcacttgcaaagtcctccttggcctttacgcccaaaatgggctcaaaagtggcacaaagtggcaaaaagtgaagccgaagatactaacaaatgagcgaaaaaaaagtgtaaagtaattaaaattgaaaattaaaatggcacttctctgagcggcgcgtacgcgcggagggggaaaatgtgcacggattggtagcgagctttgatgcgaatggacggcagagaatcagcgcaattggcatttgttgaggcgccgctgctgccattgccgttgagctcatttgaactgacagaatacctaaaaaacaaacgaataattacggtgtaaaagcggaggttacggtagccaaaagttgaaaacttttgcgatagaattatggatgcttataaatatgtaattctattataaaaaatatataaaataattgaattcactagtacaaaagttggacccccccccccccaaatgctcaacaattaattaattgttcagttgcatttctcgaccatttctcgacaggctgtcgtcctgccaattccgccaacggaatgtgcaccaatccgatcagagtttgtctgtcctccctttcggcgccgccgcgtgccctccgtgccgatgccgtctttttggcgtccaactcgcggaaaaggtcgatgcacagcaaacgggaaggagggagggagccgaactcgaaagactcgccccaaaagcaaatgccatcgctcatcccctaggaaaggcagcaaaaaatgattttatactcaattcattttaattgtttttattatttattcctctgattttattttgtttcgcttttccctcactttcgtcgaagtgcgtgccttcagttgcccgtccaaagacagcttaaatttgcgtaccgtttgagcagagaaaggtttacaaaagggagaaacctcgcagaaaaaccgtcgctttgccgggacgcccttcgcctccaaaacccaaatggacaaaaaattgtccacccgatggacacggtcaatttggggattcatccgccgtcgaaagctaaaagcaaaagacaaataaaataaatgaacggattctgctgctgctggctgattgtgaagtgccgtgtgattattactattattaaatgtttacggcggtgccctcttcccccccccccaaattcttacgacggcactttccgtgccattcccctgaaatgggcgaaccatttgcatattctgcacagcaataatcaatccccgtccgtccatccgtcaccggccatcaattgtcccccgaggggagagaaagctctctcgggggaagtgtcgagtggacggacggaaagggaaggaaagcggatgtgcccccgcggggagggtttgagatttgagagagcaatgggctcagagggacaaacctagcggactaagtaatgagcatggaatggattgacggagggcggggcgaggggaaggacggagagaaatgggagagggggaaggggtcatttgggatcagatggcattgccaaaagctaaaatgattttttgagatattttggagaaaaga

SEQ ID NO: 28515 - DNA, 991 bp, Heterodera glycines
  misc_feature (23)..(23): n is a, c, g, or t
gaaaattttttgcagacacccanccacttttgcacttaaaaaaattcaaagcgatttgaatgagaatagaaagagccaggttcgatgaagttttggtaagccaaaaaaatatccaaatatttaaaaatctgtaaaaaatttaaaaatgagaattcatgcgagattttctggaaataatcttaattgggccttgttaagctgtaagacacccaccacttttgcacttaaaaaaatttcaaaaaatttgatcgtccataaataatttgtaattgatcagcggctcaccaaattttgcagagatacgtatcggaacactacaaaagcttactaattttcctagattttttaaacccggtgaaaattttttgcagacacccaccacttttgcacttaaaaaaatttcaaaaaatttgatcgtccataaataatttggaattgatcaggggctcaccaaattttgcagagatacgtatcggaacactacaaatgcttactaattttcctagcttttttaaacccggtgaaaattttttgcagacacccacacttttgcacttaaaaaaatttcaaaaaatttgatcgtccataaataatttggaattgatcaggggctcaccaaattttgcagagatacgtatcggaacactacaaatgcttactattttcctagcttttttaaacccggtgaaaattttttgcagacacccaccacttttgcacttaaaaaaatttcaaaaaatttgatcgtccataaataatttggaattgatcaggggctcatcaaatattgcagagatacgtatcggaacactacaaatgcttactaattttcctagcttttttaaacccggtgaaaattttttgcagacacccaccacttttgcacttaaaaaaatttcaaaaaatttgatcgtccataaataatttggaattgatcaggggctcaccaaattttgcagatacgtatcggaacactacaaatgcttactaa

SEQ ID NO: 28516 - DNA, 1580 bp, Heterodera glycines
  misc_feature (501)..(501): n is a, c, g, or t
  misc_feature (520)..(520): n is a, c, g, or t
ggtcatcaattaacaaattttcgagtgttttaggctaaatatttgaaaatttcctatccgtagtccgcggcatttgtgctcactttgctattgtcctctattagtctattcgaaggttgaaaaaaaactcatccaaaattaaaaaaacatgactaaaaagtgcaaaaaagcgaatttttgaatttgtttttctgaactatgctaattgatgttcttggggctatcaaatgataccaagaatgtttaatttcgacgcttttttaattgcgcattaaaattgtctaattattttatggtcggtaaactgcaatagagccataaattctatgtcctataaagttgggcatgaattgttttaaaaatggctgaaaatttcgctaggtttcaaattggagttgtgaccataaatgtgagaaattgctttttgagtaaaacttttttacgagggttgataattagggctgggaatttaagtcaaattactttttttgctgactctanatggccttaaaagacttanagtgttctaaactttgtttgaagcttttaacttgcattttttgtgactttttttttaccttttttacactttttgtgactttttgcgacttttttcgtggtttttttgacattttgaggcaaaatttgaaattcatcaagaaaatgccgaaaaatataaagaaagtccaaaaaataaaatttttagtaactatttataaaattaagtgcctaaaaataagatcaaaatgtttgtctacaaattattaaaattgcgattttttaacttttgcctaatttttcagtacttttttttgcatttttacgtgtttttttttttttggatttttttgtgactttttggcgattttttaagacttttttagtcgactttttgaagatttttagtgactaaaattttcagccctaaatataagaattttttaattctttattcgttttcctaattgaattttaagaaataaaattatttccattaatagcttatttaaattaccaaattttattaatctttttttgttggcctgtgaccaaagtcaatatggttttagtaaaaattataatttttttgttttgttaaaaatatataataaatgattcttgaaaatttaatattttatacaaagtttaatatattagttttataaatttttgtaaatcagaatatttattcttatatattaaaaaattttgtttttcttctatcaaaattccaattttttgtttattttttgtatttattaatgactgcgattttgacaactatatgtcataattttgtattgcttatattatttattttaatttttttttgtttatattttttgaaatatgaatgttttattattttaattctttgaattaaaattttaaaaagtcttattttaatttaaatgtttaagttcgcaaaattactgattcgttgaactcattttctccgccttttcaatgattggcgtatgtatctaattttttataattttttctcatatgtttctcatgaatattttattgtcgcaatttccatcccttcatattcaaatattttcctaatttataaa

SEQ ID NO: 28517 - DNA, 989 bp, Heterodera glycines
  misc_feature (817)..(817): n is a, c, g, or t
  misc_feature (819)..(819): n is a, c, g, or t
  misc_feature (971)..(972): n is a, c, g, or t
tcttcttccggtacccctacgcccgtcagcgcctcttctgcccctccttttgtgtccacggcacttccaaacaatgccaatgctaacacgccgcttcctcaaaagaccatctgcgttaacaacttaagaagaccttcttcgatcccggaattgataaattctgtaaaggaggaaccggtcgcggagagttcaccggtggtggacatttcagtcggaccagcgaatgcattagttgtgaatcccatccatcagcagcaaaaccatttaataaatgaagtttcaaaatttggtgaatatttttgaatttgaaacagtgggaattctacctcgaatttagagccaataacgccaatcgcaaatcgaaaaaacgacgagggcgatggcaagaaaaacgtggcgaaacggagcaatgaacgcaaggaaaaagttcagccgacggttggcggaaaacgtggaaggcccagcaaagcggacaaaatgcttgggacgcatgcgagtccgaagatgccacggttgtcggacgacgcaaaggatggcatggaagtgatgcaccaaatgactctctcagtacaagcggtaataatccttgacaatgtgagcgtcatgatgtccggttcagggaaagcccattgaccctgctttaattttggctgacatggcggaggcaaaacgccgttcagtaccaatggacactatcaacatggctctgccctttcccaatttgagcaaaccgttcaccgaccaaactcaatccggaggagacattcaaagccatcattacaccgagagatacccgggcctatcgaaatttttaggngnttctttgttaaagtcctttttacagacagaattacagatggaatgagaggcgtgtttgaaaattggttcgacaatgtgtattcttcgaaacaaacagccaacgatggcggagtgggcattttgttaaattttattttgcactttactaattnngaatatttctttagtcg

SEQ ID NO: 28518 - DNA, 2002 bp, Heterodera glycines
ttaaaaatgcatgacattcaaaaaaaagaataatggaaaactcactaattaataactgtgaattaatgtatgtagaattaataaatctaatttattaataaagaaaatgcataatattatttttgcataatgagattgagttaggaatcaatgaacaaacaatctaaatttaaaattcatagttttttaacaaaataatatataatagatagaataaaatatgaatttatttttcaattatccagcaaaatgaataaatttttttaaaaattaataaattaatgatatgaacgtacaaatgaataaaattcaacctaaaaataaatttatttttattaattttgttatgtaaaaagttgaataacattaaaattccaaaccaaatcaaaatcaataaataatttaagaaatacaaaattacttatgattcacgaatttattacaaacagtacatcaaaagccttacaataaaatataatgaatgaataataagtattgataacataaacgggttttattacccatgtttgtgtttgaggtagctgtacgtgaaaaaggatgaaaaaataatataagaaatttaataatgctaataatatattttataattgatatcttttgtaaagaaataaagttaaataaaaaagcatacaatttattctatcatttgaaacaccgctaaaatttttgtgtgttgataaagccgatttgaatcgaaaaccttgatattaaaaatcaaaaaatgggtcatagagaaattgaaagtcacatatgaaaaaatatttttaaaatttaatttatttaaaaaattattattaactataaaatattcaatgagtccgatttcgttcacggatcgcccataaaatataaaatcgaactatcttaattttgttgatttttccaatggaaatatttatttctttttccgagaaatgtgctttgttgaccgaccttgaggctggctgtactaaaaccctaaaaattggagccctactaataattttgaccaaaaaaaacacccattttaaacattttgtttaaatatttagtacacattttggtttttttccatgaaaatctattgtaataagaatcgcaaaatttggcaagtttttggacaatttaagtttttggaagaaaacgattttccaaaacaatgtttttcttctgtattttgtgaacatcaatcaatggaaaacggcaaagtgtgctaattgcaacaaaaaatgaacagacggtaaggaattttttaaacttggaattttcatttccacttaatttttccaagtttcagttggatgtgcaccgacgtttggctgaacattctgcccttctttgaccatgctcaactcggcctcaatttggcattgctttctttccgtttcgatgttttggtggacaaatcattttgatagaaaaagcaaattgacaatttggagacgtatcacaattcgcaagagcatcaaaccaaaaccaatattatttgtcgattggaaacggaaacctctggatttccattgccaaaacggccgtggcccaccaaaatccgctttaacgactttcggattgcgtaacaatataaattttctgtatgtattaatgcattttgtatttatttcttcagatacattgaccattccgtgatcacatttctccatgccaacaagcaaatttgggacagcaaaggcaccaaattgtatttgaatctgttttcacccaaacgatggatttccacaacattcgggctgtttttgtccgtcaaatttggccaatttttatgacaagcactcgccatctgagctttgccggtcgtgattgtatggataatttgcgtcgtcgtatttcgccaacaattctcgccgatcttgatcatttggattcaatcgattccggttttctgtttccctatggaatggctggcgatgggccaaatgcaaatgctgccgggcaagcgttgtccaaatggttgcacacgccgagaaaagatggccaaccgaag

SEQ ID NO: 28519 - DNA, 1137 bp, Heterodera glycines
ccccctgaaaatcttttttaaataatattttcttagggtattttatgaattgaacacgtatatgacgtatatttttaactcttaagctttttacgagtgttacgtgaaattttttaaccagtcaactacagtatttcgtcggtaataatgtgctttgtcccaccccattttcgaaaaattaaagtcgtgtaaaacgccttctctggaggttttcaaggtcgctgatcacgaatctgacatccatttgtattaattccgaacccagaattcgaataaaaagttgaaaatacaaatttaaaaatctttcactattgctctaaaattgattaaaactagataaaaaattagcataaattactgaaacaccaaaaaatggttattctgtacagatttatcataaaaatgaattttttagcatttgaatttcgactttttgttctaattcgggtctggcgttcggaattgggtgtttagatcataaaattattcaagaaaaaaataatggaaaaaattttcaagggggtgacaaaaaggataaataccaaaacaatggaaacaatattattcccttttgtaaggttttttgggcaagaaaaaaacggattaacccaacaatacactcccccgccatttgtttgttttacccacccggaatggtgagaattgctctgtttacggcgtcccaatcggtggcttcagaagcgaaggatttaggaaatttccagtcaacctgtcggtttttaaaaataatgttcaacattgtaacagacaaaaacttcaaagattataggggatgaaaagcaaaactgtggaacttcatgaagtcaagtaaaagtggtggtggtggaacataacttttgaaatttaaaaaagtcagaacatattgcataggtgtttgtagacgaaataaatgtataaaaaaaatcaaggactcaaagttttgaaaacgcattttggactaaaatcaattaaagaaaatggactaaggaagcggaaaactcacgatgaaattatgattttctgtgagcacgggcgaacatttgaacattcgtaattgacactcgccacctgaatttttaagaatggtattgtgagaaaagtaagaaacaaaaaaaaagatgaaaattgttacttgtg

SEQ ID NO: 28520 - DNA, 1786 bp, Heterodera glycines
  misc_feature (44)..(44): n is a, c, g, or t
taaataaaactggaaatcttgaaaaaaataattttttaaatttntggtagacaaataatttaatcaaagaagtcaattagaaattgcagaaagaaggcatcgaaaatggcctataattccgcaacagatttggtagtttaaagaaaatttataataaattaatcgtttttaattgagtaaaactatatttagtggtaccaatattttaactctgccggttatcaatatttaattctgtcggtggtgtttggatttcgtgcattttttgccacaattggagcactgtttaattttggcgttgtgtacacaacaatcaaaaacaggcactaattaaatcaaaataaatattattttattttccgttattaaaaagaaatctccgagaaacttgcaacattttgatcgccttggaatgtttctttggcctcattttggacattggatattatgccagcccttttgtggcagtttctggccaaaaattcattcgttacgaacattgtttctgggctttaatcatcccatgtgtgtgtggtgacttggcccaatttacgatggtgaccatcgccatcgatcgactgatcgctgttgcctttccattatggtaagtacagtaatttgtgtttatttttaaatttcaattcaaggttcaaacaaagagcaaacaatcgatacttggccattgtcttttcatttattttcggctatggcatttatgatttgacacttcgcttcttcgattacacatacacaaaagaaatgtaatttataagaaattaagttttgatgattatgtatattaatgaataatttaattaaatattcttcttcagtatggtctcttgcgcaacaaatgaaatggcccaaagttttttaggaaaaatattcaaaatcaatggattggtgttaagcggccttctgatgtccgcatattcactctgttggttcatggtgttcaaactgcctacagtatcacaatgttctttatttttgaatatgaatcttataaaaataattacgtatttattaagtggttagaatttactgtttctctatgaaaattttagatgttgaggaatggaatcggaaactgatcaaagcattgtctttcatcattgtcctgaatttgattggggtgttcgttagaatttctgttgagctgattttccaggcttttgccatcgcggatgtgttcatccgaacaccgtactccatcgtttcttccttcttcactattatcgtatatagtgcagacggtccattactgtacatcgttaggtgacaaataacaaaattttgccaagattcccaaatgaacatttccaaaagcctcagttgacagccaaaaaagcttcacctattttgaaaattagcatcactaaactttaacaaattcagcactgagtaccgtactcgtctaaaccaacagtttccttggttaacaaaaatatttgggccaaatgagaggaacataatccatgtaacaccttcttcaatgaatttacaacaacagcagaggagagaaagaagtgtttgaattatacaatgtgttatgtaatttatttattgtatttataatgcaaaatgacataaaaattataaaaaaacaaaaaatttcgcaaaattaattaaaaaaaaccaaaaaaaatatagtttttcacataaataatggaaaagttattttatgttaacgtgaacataatcggaatcaaaggtttttcacgtaagcatatgcgaacacagagtgtgattttacgtgagctgtattttatatataggaagtttt

SEQ ID NO: 28521 - DNA, 1120 bp, Heterodera glycines
tttccagccttatggaaagatattatggaccttttgttccatctcagttgtcaacgccgcgactgcatcgttattatatcagtcgatagaatttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgttttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaaacgcttttaaatcgtctcttttgcgtcccctaatcttcactctgagccgagttactgcggtctaaacacgtttttgggagaattgcgggcagaatttaaaaatacaggttgctatggcttcgcatcacccgcttcaacgggtgctcagtgtaaatatcgactgggcattcaaattctgcct

SEQ ID NO: 28522 - DNA, 1590 bp, Heterodera glycines
aaaatacatatattatataatatcatataaaaattttgattaatttttgcttttaaatttaatttctgttttttaaagatttttttttatttatattcgaatttgtctaaatttttgataaatttgaacattaattattaacaaattttaaatttatatttttttctatttatttattttccttttaccatcataaagcactttcggttgatttgtggctctcgattcttcacacaatttatgcagtgcacctaattcgggcaaagaatcattgttcattgctggcagacgaaatgctgtgggtggcttcatcattatcactgttaggctctttaaaaaattaatttaaaaattcgaaaaatttcatttttggacttttaatgtgcccaaatcggccattttttgtatgtctttggcgccccaaagtgcgccggatgggatgaacacagagcgatttttgtgctgcttaaggctgtgctaaaatgaaaaaattaaataaattttttaattggaaatttacatgaatttcctttaatgtttgccgatttgccagtgccgtcggtgacccaacctatcaataaaaatggggaaattaaatgaagtaatgaatgaatatttaatgaaaattacaaaaagatccgcataagacagaatcagcttggcatgatcacgaatgatgtcaggatgtgccaccaaaaatttaaaaaaatatatataaattaatgattttttggtgcgaagaatttgatcattgcaatatcttttccaattttaaacatgtgattagattagaagcaacaatgattcaaaaaatcattaataaaaaatttgtgaaggttatttttctttttatattacggaaatctcaaattaaaatcagcaatttttaggaattttcgcgatattgaatcaattttaataacaattaggtgccgagagtgccgccgggaaaaaaatttttttttgagaatttaacgaaatttgtaaagaaaaattagctaaatttttgagaaaaaattatgaaattgaaagaaaaaactaagtcctatttcgtaaaaaaaacaaaaatgtggacttaatttcttaaatttttaattttttgaaacttgtctaataatcattatttcattaatttaaaagaagcaaaatggaaatccaaccacctcaataaccaagtccaagccttccaaagtttcggcattcaattcgcccaatcccaatacgccctcctcggcatcctcattccgattccaaatttttttcagcacgaattgctgggatttgcccagctcaaccttgagaaattggcctaaatttcactaaataatttctcagaaatttttttatgactaatttttatttcctttttatgatacaagcgatatattcttatgaaatatataaagcggtgtgtcgaattaatttttattatttcaaattggtttttatattcacaatttttaagacttgattttggtctatataaaatatttttagtaattaaataacaattaaaattttatttatttttaatttaaagtctctattaaagacatacccaaatgtccaaatgcgatgattccaattgat

SEQ ID NO: 28523 - DNA, 1031 bp, Heterodera glycines
  misc_feature (938)..(938): n is a, c, g, or t
  misc_feature (943)..(943): n is a, c, g, or t
actcgcggcagagaatgttcagaaagcaacagcaaaaagaagcaacggagaaaagcacacaaaaaaatgcaaacagaaaaagagaccaatcggagagaaaaaagggaagagacgggacgggactcaaacccaagaaatattcaacaacaattgtttgacggagcaacggaatttaagacaattattgttaaacacttttaatttccaaaatttccagcaccggagcgaaaaatcaggttttgtaaaatacaattttttgtctttttgggataaaattttcaaaaaatattgtaaatgtgctccggcgatgccggtaggcgccgtcgggggaaataggaaatgcgggattggcaccccttaaaaaccaaaatcctgtgaccgttcctgcgccagtaaactcataatcaacaaattttcccatataattaaatggggccaagaacaaaggaaagttccttggaaaacagaatctactactcataaaagaatgaactttgtatctgtttgcccattcgttgcataatttcaaaatgcccaccaaattcctttccgtcattcctttcgttgctccgttttttgttgcgtttcgccacttttccttctccgcctttactgtcctctccaagtcaatttcgctttgggcgcggagatcggcgaccgaacgttgccaattttcgatggtttccttatgccgtttttcaaactccaatttttcacgaatccaaatgcgttcccgcatttcgtacatattcagacgagtggaaatggacatggaaaatgaagaaaaattaaaaatgttaaatttgacataatatatttagataagataacatataatatttacttattttgctcagataagtcgctaaattttgcgtccatttcctcgaaacgcggtttaatccgtttcaattcgtcctcataagcaattgctctanacaanaaacaaaataggctgcagaatccggcaaagtatttttacttttccctgaattccttccacccgtcaagaagatccacgcattttttgg

SEQ ID NO: 28524 - DNA, 774 bp, Heterodera glycines
gggaggatgagagacaaggagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggaggatgagagacaaggaagaaaactaaaggagagaaaaagagatggtgagagataagcaaaagaggaggggagaaaagggggggatgagagacaaggaagaaaactaaaggagagagaaagagatggtgagagataagcaaaagaggaggggagagaaaagggggaggatgagagacaaggaagaaaactaaaggagagaaaaagagatggtgagagataagcaaaagaggaggggagaaaagggggaggatgagagacaaggaagaaaactaaaggagagagaaagagatggtgagagataagcaaaagaggaggggagaaaagggggaggatgagagacaaggaagaaaactaaaggagagagaaagagatggtgagagataagcaaaagaggaggggagagaaaagggggaggatgagagacaaggaagaaaactaaaggagagaaaaagagatggtgagagataagcaaaagaggaggggagaaaagggggggatgagagacaaggaagaaaactaaaggagagagaaagagatggtgagagataagcaaaagaggaggggagagaaaagggggaggatgagagacaaggaagaaaacta

SEQ ID NO: 28525 - DNA, 907 bp, Heterodera glycines
tggatttttcctggatccaggtccaggggattttcctggatttttgtccaggaaatccaggtccaggtcaaatgtgaaaaaaatccaggtccaagtccaggcaaaacacgaaaaaactggattttcctggacaaaattttagaatttattatttcaagtgaccgatgtttttttcacgttttcaaaaacagattagataaatttaaaaacacattattattatttattagatatttttagatgcttctaagcaaataattatttttttcaaacattcttttgatttttaaaataaatttcaaaaaatccaggtccaggcctgaatccaggtctcgaggagcctggatttttcctggacctggatttttgtccaggaaatccaggtccaggcttttttcaaaatgtcgatctctaattattacatttataaattcttaaatgtttaaacaaataaattaatcgtaaaataatgtgttgactgtttttgcctttttgtacacttttttttacaatatttacgttatttttaatgaaaaatgaacaaaaacccgaaattcttcccaaccctaataattgtgcatatattttcgatttccaatgtaatttcatccatcaaattgtttcactcctttttttaaaaaaagtttttctctgaaaattttcttctgtttagaaagaattgaaccggccaggccgtcaagaatttaatcattttaaattatcgatccaatccttgcgaaacaatttctttaccatctccataacagcaacaaaacaaaaaaacagaaattgctctttaaatttattccacacacaaccctaaattatatagcaaaaaaattacaaaattagagtctgattgtgaggcacaacattttgtaataatcaggccggaaaccaagagggg

SEQ ID NO: 28526 - DNA, 1190 bp, Heterodera glycines
attaattaaacaacagttttgtcagattatgtcggaggaagtcagaaaaatatacaacaattaataataacatcaacaaatcggaaaccaatttgttttccaacgagacaagaaaaagagaacaaatttgtataaatactgcccatgttaataacagaaaaacatccaaattaacacggcacagtaataaaacattaaagactctgaaaaaatatgccaaacattttcaaaatccttctcattgtgcttttggccgtcatctcattccgtttctcggcttccactgatggcaaaagtaataacataatggaatgttttttgaattatttataatgatgatccttcaaattatgttaattatgtcaaaatttcgccagtttaatggccatgaaaatccttattccgtggtgaacactcaaaataaatgacataaaattgttgtttgctttaagaaactgataatgatcggaatggaaacgactcatcagctgggattggtacgaagatcaaacgaattgtcaccgctgggctgctcttcacttccctggccacgggtgggacaggagcgattgggcgaagcaatgcccagggaggaattgccgccggcgcaatggtatacgaattgttagggacgctaattgtgccaagttaccacgatacgaatgcaactcagtttcaccaggctccaccacctcctcctgcgaactttgaaaaggcaaccccggtagaaaaaataagcacacacttacacgaactttctgagcgaatgctgttaaataaagcgcccgaggtaggaaaaaagtcgacttcaataattgtcttcttattctgcaatttagcgagtggtacctggtggacccaacccattacatcattaaccgtaaggccatggatggaactaactgaggaaggaaggatgtgttggttattttcattcgatctttttgttgatttaactaaagtaaattaaaaaatttatggcatggcgacacacaaattaatttattttaataaaatgcctgaaaatatcacagttttaatgcttttgtcagcaaaattggcgagaaggacaatgaggaagaaggggaagggagttcatctcccgagcgcgggggaggagtgtttgcgtttagttcggaggcgatagcccgggagctgtccctagaggaagaaaatgaatttggggggtg

SEQ ID NO: 28527 - DNA, 1013 bp, Heterodera glycines
  misc_feature (10)..(10): n is a, c, g, or t
  misc_feature (20)..(20): n is a, c, g, or t
  misc_feature (915)..(915): n is a, c, g, or t
  misc_feature (953)..(953): n is a, c, g, or t
tttctctttntgcggtaaancaatcggaagattaatccaatgaaaaatcccatcaaattaatttccctttcagcgatttgaacagcgctttctaccgcaaagtacaggacgaacggatgcgtgccgcgggtgtaatgccaaatgatgagctgctgaatccgttgttgccctacgggggcggtggcggcgacactttggaccgacacattccgacggcgccctttggcccaccgcagacgatgttcgagttgaagcactcccagcagcaactgcaccatgcacagcagcagccgtaccgattctgggaaagtggtgcgacctctgccgacacaatgcattcggctggcgtgggatggcatccgccgtattacgttcaacaacaaccccaaaagcaatcctacggcagtgcgagtgccaacaccgaaccaacccaagcggagccgtaccaaatcgcgagcatccaacaagaacaggtcggtgacgacgagttggagggcaggaattttacataattgggcgattaactctcgagtcatttcgttagttttttttcttgcatttagttgcgtttctcggatcagatgatcggcgaggacagcaccacttttttgacactgggagaatgggaaggggcaatgatcagcggtgccactttcaaggcatcaatcgatcaaataaataaaacctatcaactaatccaattaattttacctaattattaaccgttttttcctccaatttcgggttgccattaaatcgttgaaaccgaatgttccgcacatcgccgttgagcagttccaagaagagattaaagccatcggcatgttcgagcatcacaacgttgtccgcctgttaggcgttagctttttgcaggcccgggaaatgtgtgccgtgttcgatcacatggtccacggngatttggtggaatttttgaagtgcgggagccccgaggngggacagagtgagtcactgcaatggtacttctgaggaaaagcttcattttagcaatgatg

SEQ ID NO: 28528 - DNA, 700 bp, Heterodera glycines
aaaaaccgggaatttcccggtcccggtcaaaactgggcaaaaccgggtggcattttgtgccatttcacccattactaagaattttttttcaaaaaaatgagcattaaattttttttttacatattttgatatttttcttacatattttatgtacatattttaccactttttgtacatatttttgccagccctactcattatgtgttgtgtgtgtaaatttcaaacaattaaattaggtaaaccaaatcagtattgagatacataatttttgaaaccaaattatgaaaataataaataaattttggagatgaatttttagaaaattttacatttctagggcgtgtattttcagaaattttgggtcgattcttagcagggctggacgtaactgattttcagttacggccatccgtaatccgtcattacggcgattttttcagttacggccatccgtaatccgtcatgacgggggtcaaaaaaggccgtaatttggcgtaatccgtaatacgtaatccgtaattttcaaaaaaattttttaatttaaaaaatttttaaatttaaaaaatccaatctaaaaattgttaagattaatttatgatcagaatatctgcttgtttttttgaggtgaaaatcccaaaatagtttgtttcgcggtgtgctttttccaaaaaactggggaatgtggggggggtcagggggg

SEQ ID NO: 28529 - DNA, 1562 bp, Heterodera glycines
cctgttctctttccctttatctttcctctttcgcttcaaaaacatttctttcaaaaatgatcattaaaaactaaatttctccctaaatccaaaaaataagacgaaaataaggacaaagagcttaaataaggacaaatcttacaaataaggacatttaaaatttgtaagatttggaccctcaaaataaggacaaatcttataaataaggacaaagggtaaccctgttcttaattaattttattaaaattaattttctcccggcgtcgcccgcaggcaccaaaacttttttgctaatatatacggtaaaaaactctagtattctcaccttttcgggtttctttgattttttaaagctaccattataaatttggtgaactaataaaaaaaaaattatagccttggccgaaacgacccccgacacgtattgacctttttgaaatttttcaaaaaagtaaaaataacaaagtttattgatcaatgatcactgaggtcgtacatcagtctcaagcggtcgaatgacgcatttgctggtgtctaaaaacagggcaatctgtcggccaaagcgttgccgtccatcaatattggacatgaattcaacaaatttctgatggcttgagttcggatagtcccatatttgtcttcggttttgctttggctgcacatccgtacgcactgaccaagtctggacagaactctgaaaaattgacatgaaaatgtgcatgtttatgcattgaaagaaaggaaattagagaaagaataaaaagttgcaaatgataaaactaatttatttaaactttttttgttaaacctgtttattaatttatttttaatattccatgctaataactagggttgatcgttttttaggttacaaacacataaaaacttaatcaaaacacttaattttagttatatttcaattttagcaaaattattaaatattttaaagtttttagaataaggataatttaaacaaaaaatttttatcaagaaaaaaaatatttatatggaatcaatttttgtggaaatttttttcgaaaatcctgaaggcgccaaaaatggcgaaatatgcacaaaaataggcgttcaggctttgggcacaaaagtcgaaaatagacaaaattaggcattgtaaaagtcatcgtagacaccccaaaccaagtgaaaaaggcgtgtttatttgagcgtatcaagtgcacagaaattttaggcatttgcctaaaaacgaagccctactaataacaagggatgatattttaggtttttattagccctaaaaatttccgaaaaatacccactaagaagcattttttatcaattaaaaattcatccctactaataacacaaataagtttagatttgtgcatttgaaaaagttaaagttatgatcataatttccaaaataaatttttcatcaaaagcagcatttaattttaattgcttacgggtgacattcgtattcagaaatgatgttcagccgtgtatagcatcagccccaaaatgggtattctctctgttgcaaagttcactcaccggtccgtcggtgtccaattgccaactca

SEQ ID NO: 28530 - DNA, 1185 bp, Heterodera glycines
ttttatttttcgtaaaaaacaaaataaaaaaggaaggcttgcgttaaataataaaaattttcattattctgtaattagccaattattaatttatgtgcccttttttgtttgtgtgtcccgcctgcccatttttggtcctttgtgtgaattttgcctttatcatctcatcaatcagtcatggtccttatcaaaggtgccaccacctgacggtgttcgggagtccggactgttcgctcaactttttcaagcggcttttgctgtgttggcgcaacagtgttgatccaccgccaccaccagacgcggcactgcctttaccgctgccgcgttttgtcaactttttgcgcgttgtcaatgggtctgcgtcacgaagaagaattgggttgctgaacgcatcaattggcggtcgagcagcccttaattgtttttttcactgtctttcaatttgttctaaataaaatatcggaacagttggatcagaaaaattgcaattttcaatatgcggaaaaaatatttgggcaccgaaattccgatttttgcgacattttatttggaattttgaattttttttaatcctcgaaattttccaattcctctttccgaatttttggtcggaatgcgggcgtttgttatgagtggcacgacattctcgacacagcggagatgacatgaaatggccggcggcggaaagcccaatatggcggggattaggaggacattattcacttggccaacatggcacggtgttgataataatggccaatggaagcaaagggatgaccatgaaaagtgtgtattcattggcattaccaatcatggaaaaatgactcatccttttgaattgcctttgatttttcggaattttcaacaatcccacgaaaaatttttaagtgtcaatctaaacacatcaaatatttaaatttaagtaagttctcatcttcaccctttccattggctatttatgccaaagggacaaaaaagaaagagagagagagagagagaaaataaacagaaaaggtgcagagaaaaggaaaagaaaaagaggatgaacccttaggggaggagcaacggaaagggccgggggaagggaaacgccgggggggggggggcaaaggggcgaggggagggacacccgccacttctcagaaccgaaatcatcggagatgcgatgaggggcgggatgagtct

SEQ ID NO: 28531 - DNA, 1322 bp, Heterodera glycines
ataaagtcaatgtgactttcgacgacgtgcgcggggttcgatttgaattgaatgtatttaattctgttttaattgatagatggacgaagccaaggcggaggtggaagaaattgtcgattatttgagggacccgcgtcgttacacttcgcttggtgctcgtttgccaaaagtccgtgggtcaataacattttgaatctaatatatttttctcagggtgttctgttggttggccctccggggacgggcaaaacgcttttggcgcgcgctatcgcaggcgaagctgactgtccattcttccacgcggtcggctccgagtttgacgagattctcgttgggcagggcgccaagcgagttcgtgaactctttcgtgagttttcctttccgttttgttcctttgtcccctcatttgtcgacctttctttttcttaaatttgctacagatttctctcgcatttattaccatcttttcgttgaataattattcgcctaattttctgattctttactctccaggtttggccaaggagaatcagccttgcgttgtgtttatcgatgagattgactcggtgggctcgaaacgaacaaacagtgccattcatccgcatgccaaccaaaccatcaaccaacttttggccgaaatggacggctttgaacagaaccagggagtgatcgtgatcggtgcaacaaaccgagttgataatctcgacaaagcactgcttcgaccgggcagattcgatgtgcaggtcactgtatcgaggccggacttgccgagccgaaaggacattttcaggttaacaaaatcaaagaatgggttgaaagtaaaaagattttataaaactacttttggtcattcaataatgacccaatcgaacgcaattaccaaaaatactgttaagactgtatttggacaaaattgtgcatggcgacattaacgttacccaattagccaaaggaacgaccggatttactggcgcaggtgggaaattgctttacagggttggaaattactgaattttgttatttcaagacattgaaaacttggtcaaccaagcagcacttaaggcagccaaagaaggggcaaaggaagtggacatggcccatttggacgaagccagaggtttcaaaggcaaacacttaaataaaatttgttaaatttcagatcgtgttttgatgggacctgaaagaatcaaagggcgactgccggatgaggaagagaaccgatacaccggtgggtattttcggaaataggaaggaatggaggacaattggaagggcaaaaatattttataatggaattgtgaattgtaaaatgctgatgatgc

SEQ ID NO: 28532 - DNA, 1169 bp, Heterodera glycines
aagaaaggaaaagcaaaggaaagagaaaccaaagggagggaaaagcgaaacaatgcaaaaacaaacggagggggggggggagaaaaaagcgcaatttgagaaagggaaagggaaaaacgccctcgaggaacaacggacaaaggcaaggcaaaaagcagcgaaaggcgaagacggcacggcactgacctgaaggtcggtgttcaataccattatcttctcggttgaaatgaacaggtctatctcagtgctgggctgcaattcgccgtccggagcctaaaaaaaaagtccatagacagtccatccattagtatttaatcctcggatttccaatttttcattccaaatccccattccgtttttctcacttttacgcgtgccaccgcctcttgtgcctgtgccattcgcgaacttttggacggccgaccgtccgaactcatttgagttgagcccaaataacgcgcccgaaacagaacgccttcgatgagcactgcaggttcatgaatgattactgcaaagtagaaaaatgtaaagacggattacgataacaaagagcacagtaagcaagaaaagggagggggagcgatagtttgagaagaaattaaaggaaatattcgattagttactgatacaccgtagtgctatgattagtagaagttagctgatttttttctttttttaagtctgataagtgtttcggtgtgtgagaaattgtgtcaaacatagaagtgattggggtgaaaatgctaataattagaaatgctaataatcataggaacggtaattgttattggatgaaagtgacggtttagacaaaacgccatagaacaacaaacacaaacacgaacagagaaaaacaatccgtgaaaagaacgaatgacttacgtgaaagtgcggaagagagggagagagagtgccgttgtggtggaggggaggggaggggggtaattagtgattagcaaaaggcccaagtgtgaacagacggagtgcctcctgcataggaccatagggaaaaccagggggccaataaccattcagatgaaagagtgagtttaatcatttttgtgttaattggcacttgtcttggaaatagtgcccccccccctccggctgatcaccttcctttttgctgtgctttctctttgtgccattttctcgcagttcttcttcct

SEQ ID NO: 28533 - DNA, 1085 bp, Heterodera glycines
ttttgtcaccccattaaaaaattttagagtattaaaatggaaattaaatgtaatgaattattttattgtttaaatcgcttaaaagaagcaaacatctccattcgcaaaatgccatcgctggacaaagtggggcttttccgtggtttttattgcttttcaaatcccctgaagatgctcgaggacattgacttcgctttggttgagctggtagcccatgtcaaccgtttcctcgccgttctgaccgttttcctgccaatgttcgtcgtttcgctcactcttcttctgctcatgatcattgccctcctcgtgttgtccgtttttctccaattcaaacgcctcaggggacaaaaaatggagggaaaagccaatgctacgcgagtggacgaatcggaagacactgatcaaattgggcaacatcagcagcaggtgggagagagggccaatgggacgacgaggggacaaatttaggggaggggcgaaagatcgaattataatgacaaaccaacacggactggaaaatttgggtgttcaactcgggaatggggaaggaaatggcaaaatttgggtgatgaaccgaaaaaattgggaaaattttcaatgtcccatcaatttgatattaatttgcattaattagctttggtttgactccgtttagttgagacaatccttcggtcgaaaagatgcaacttttgtcacgtctttgcgtgtgattgagaagcccaaatggaaagcatcgcattggccgaggggacggagcagagagcgcgattttaacttatgagaagcggcggaggacaaagagagaatcgagaaaaaaggacatcgaatattgaagcgatgatcccttttaaaagcaaaagcaaaagcataatttatttatatttattattattttttacaaattttattagtgacgagaaaccaacgcaaagcatttcctacaaagaatgagataatttcatgcagacaaattactttttcatcgcagcttcagatttgcaagaattcatttcgaaagtgagtcaattgagccgaagccggatttgggaagaaaagcatcagcaaatgatcaaccagtgttcgtc

SEQ ID NO: 28534 - DNA, 1315 bp, Heterodera glycines
  misc_feature (190)..(190): n is a, c, g, or t
aaattcggtgatttttaggctgcttcgcggcttcagacgggcgcttcgcgcccgtttttaatttttgttgtgcttttcggccgcttcgcggccgttttttaaattgtgttgagtcggacgggcgcttcgcgcccgttattaaattttgatggactcagacgggcgattcgcgccctttttgtggcctttntaggccgatttgcggcctcgaacggccgcttcgcgccgttttttaaattttagaacagatacaaaagtgattagaagaggtagaactgtgattagaagaggtacaacagtgatttgaagtggtacaacagtgattagaagaggtgcaacagtgaaaaagtgatacaaaagtgattagaagaggtgcaaccacggaagggaaaggcacaacagtgatttgaagaggtacaacagtgattagaagaggtgcaacagagattgaagaggtacaaatttgatgaagaggtacaaatgtgatttaaagaggtacaaaagtgataaaagaggtacaaaagtgattagaagaggtacaaaagtgattagaagaggtacaacatggtttaaaattaaataaataatgaaaagtttttataaaaatcgattgcattttaatttacaatttttttataataaaatactctttttattcattaaatataattttgaaaattaataattgaatatttattttgaaatgaaattcattttttataaattcaaaaaataaataatgaaattaaataaattaattaaataatttataaaaatcttgaaattaattaaaacattaaaaataaccctaaaatacaaagaaaaataatgtacaccgcccgtgtccgaacttcgcctatatgaaattctttaatcaaacaaaaaattaattttaaaaaatttttcactaaaaaataatttaatttaaattaaaaaattaattaaaaaaacaaacactcttttaaatgaattaaaaacattaaaaataaccaaaaatgcatagcaaaaataatgtacaccgcccggattcgaacttcccccccctcaaaatgatgcctcagaatccccaatcacacagggattctgaggtctgaactatgtcaaaagtaaaatctgatcacgtattcgtgatcagcgtcataaaatacccctaaagacatgtttttggaatattttcggtgaaaaaatttttccacccaaaaatcctggtcacccccctatggtcccgaaaccaaaaatcacttttatttttataacaattcgcaagaaagagataaaaatgtaaaataaaatttatattatagagaaaaaaatt

SEQ ID NO: 28535 - DNA, 991 bp, Heterodera glycines
  misc_feature (928)..(928): n is a, c, g, or t
aaaaagaaaatgcggtccaaaaaatgcgacgacgtctcgaccgatgacattttgggtgcaccgtcccatgggccctttttggctttccgctgaccaaccccttgtggcacatcatccaatgaatcgtaccatcgaatggttctaagtaaatcttcgccaaatttcttcttcaaagtttctcgttggcgctccactaaacgctcggaactttcaaccaaataaacttcaacattttgtaataccttaagtaagagaattaaaaaaggaatgagtacggaaggaacatcaaattggcgcagcacattaagcacatcggccatcaattcgcccgagcccggcccgagttcgaccaattgccaccggtccttccaagaggtcatttccaactcatgaacaacccaactcccaatctaaatacaacggacacggcttacaaccaaagcattgcctactaattctccgaatatctgagtcagctccggcgaagttacaaagtcacctgaaaaagatgcacttgcttccgtttaaatccagaaattttaccacgctctccaaaaatttcattctaaaatagcacttgtgatgactgataagatcaaaagagaattacttgaccagcataataaccaagttgagaagtggcacaaatttgcatgtattcagcaaccgtaattgggcctgaggtgcgaattttgtcacgaataattcgaaacaattgatttcccgataaaattggtgaaggaatgcaattcgaaaatgttggtgttttggaagaataatgagccagtttatttgcaataaatgcacaacggagaggagttaaatccaggagacaatttcgaaacataataagctgaaaatgattgaataaaaagtttgcctgccaatttttgaatatttttttcgtcgggacaccaattcttgatgnatgccaatttggcattatgcaattttcgagtctgggacctagaacgatatttatatttaccta

SEQ ID NO: 28536 - DNA, 1113 bp, Heterodera glycines
  misc_feature (320)..(320): n is a, c, g, or t
ataaaaatgaaatttggttgggcacccgtaactttttgatggattgactgatcggaaagctcttttgccgttttttaggagtaatattcggggtttgttttggcatagaaaagatttcaatccaataactcatctcttggaaaaacgggtttaaaaaattttttttttttcatatacttttgcacctgactgtacctaacgtattaaaatgcgcacggatcctatgctagaacatcttcgtttcctctagattatacggcagcttcatcagtatgcagttgaaattcgcgggggtggtggtcaaggaacaacccacggcngggttttacgcggatgtgagaagaagggatttgatttaaatttggcgttccgtctgatgttcattgtccattcatatcccatttatcgatttaccctttgacccagtcaacatattcccccgcccgtttcccatattcattcgtaattgttttattattttctcttcatgttctcctttcccaatccgtccctcctccaaataaatatatattatttcctacttgttcccaaataaataattattctccaagtccatcgccaattgactaagtgaaccgaaccctgcaaaaacccaaacccgagccccaacggccctccctcgttttcctgacttggcgctcctggccgacaccgaactgcaccgccttttggaagacaccgaattgctcgacgattgccgacaagccagcaaagcacgtgaaaaaacagcgccgtccgcccactcaattcgccgaaaatggaagaatattttggtcaggcaagttttcgaaagagaatgttggcacaaggccaccgactgcgagaaagtcttgcctgtgaaggcaacaaaaaccggattttggctgaaactgcattcggtttcggcagaaatgaaggaaattgtgaatttggggggccgtcagtgcattccaatttcggtgagaaaaggatcgaaagatccgggtttgaaggccgaacagagcaagagaaaaatttggtagaaaggctgaaagctgaattggtaagagttaaggccgaacgagacgaagccaatgcaaaaattgaaattttgcgagagaaattgtcggacag

SEQ ID NO: 28537 - DNA, 1037 bp, Heterodera glycines
aatacaaacatatctttctatcttatttattttatataattaggaatttatttttctatttaattttttttcataataagattattctattttatttatttaatttttaataattccaaatttttctcaccgcccttccccaacactctgatcaacgcgaagttctccatggacaccttctgctgctgttgttgctgatcatctccatcaatgtttgtccaccatttgaagtcgtcatcatcggaggccaatatttgcccaaaatcctgcgcttgctaaactgagaaatattttaaaaaatttaatttttttttaaatttcggccgatagaatacaattcccgatttttttttaattttggaggttcgacgaatttcaatttctaatttctgaaacataaaaattccgactccgaaatttctcgagggttttagaattccaattatgattatttaattctcagaattcttccgatttcggagaggtttgttgttgggccttaaatccctattgcccctattataagccaaataggtacaaatccgtttcctaatccaggcattattattttccgaattatatggcttcattatatgctgtagttgtccttcacactcagccgctaaattggcttttctaatccggattatcctctccaaaaaagggactcaatccatgctatggtcttgtccttgaaatgtccttgaacatgcctggtccttcttggccagcagtccgttgttctgttgtgactgttcactttcggcatctgtgccacccccgccgccaccaccaccgggctccatcgatgacgtggatgtggttgtgtttgcggatgaagcggatgccgatgtgctgggcggacaacacggcatttgcagtgacgccattttcaaatttggcagttctggcattttgtgaaagaaatgtgttttttttccttcgcctcaaggggaaataaggccataattattgtgcttctcaaatatgcaaaaaccaatcaaacaaatgatgtaaatgcgcgaaggaaaacaaag

SEQ ID NO: 28538 - DNA, 934 bp, Heterodera glycines
  misc_feature (842)..(842): n is a, c, g, or t
ataaagcatagagaagtggcattatgccgtcgaaatacaaaaaaaagacagtacatcaaatcaaatttcgcatcgtattgtaactgtaccgtaccgtaccctttttcccatcgatgttcattggccactctgtctactcctcattctcctcccattccatccctcctccaccggcatgtcgtcggcttctgtcctcctcctcccgcttgctccagttgctgttggtgctgctcccgctcgcggacagtgacacggagggcgccaacgcggcagcagccgcccgctccgcaatgccgagattcagtttgccgctcgcctccaacgcctcggcggaatggttggcgaaatagtctgcaaaagtggtgacaaaataagaattactgctccaatttgtgatgccttccatggaaatcgtaaaatttttagggaaatttttgaaaaaatgttttccaatttattttttttttcagaatttaccaacggaatccccaaatcgaaagcggaaattctttcaaaaatgttttgggtcaattctttcctcaattttcctacgatttgccattaacccctctccctccgttaattgtgccggtttcggcacactcacagtccaactgcttttccaagagatgcagatggttgggctggtcgggcaactccgtgcgcacaatttccttgatgtcctccaatcgtgtgcgcatgcgcttaaaatgggaaaataatgcgttgaaaacaaagagacacacacagcagggccaaagccgaatcgcaactgatcaaagacgaatgaatgaccgactgataagccaaggccaggctcgtaaccaaaaaatttttgaggngaaccccagccgggtgcacttcattccccccccccgtaaaaatttttttaaaaaaaggtgcaaacctaagaaattttttataaaaaaattct

SEQ ID NO: 28539 - DNA, 2042 bp, Heterodera glycines
cagactaaatttaaaaaatcattaaatcacaaaactttttcgggattttccactccaatcaaaagcttatcacattagtctaattggcgttttaatgcgtaaaaaataaattcaaattctgtttcttcacatttgataatataataaagtacaaaatttgtacagtatgaatttgttcatgtctttcctattgaatgattaaaaatattattttaaccaagaataaagcaaatttaaaataattcttttttatacattacaaaaagttatacagtatgaatttggtttttatttgaattttattatttttatcaagaataaagcaaataaaaatgatcaaatatatttatttatttttgtaatttgatcatttcgttgtggcccgaatttccgatgtctttttgctgtacgcttgtatcattatatcgaccacaaatgtgataagatgtgtaaatgcgatgcatgtttcgactttgttgtccatttcaagtcgtgcaataattgctacaaaataaaatgttacagtaacagacaaaataatttttgattcatgtaaatacatattaatttgaaaaaaacattaaatatttggcgctaattaagaaaattgtggcttttgattagaagaacaaaatattttattggattattctgcaaattcactttttaagtcaaattttaaaaaggcgtaaattaaattttacaataattaatacttgcctaaaattacatcaagttaaattttctaattcattttaaaccaatattttatattaaaaattctcccacctaataattgttgttgaaaaaggtccataaaatgttgcttaagcccatactgggcataatttgcatgcatttcgccaagatgtacacatgcatcgtacattttatcctcatccattttgtattcattgatcagtttatcgaaaaacttgaaaattgcctgactgaaaattgaataaatagataatttataataaacttttatatttttaaattattatcatttaaaatattttagaattgttggcattttcaatttgattttcataataaataaatttaactcattaagaaaatatggtatgaactttgggtataacttattaaattttatatgtttagaacgcaacaattttgtataaggtcatatatatcgaaaaaggcaagaaaaaatatagaacataaaagtttactcgcttcgatgggactcgaacccacggcgcccttccataccgtggaatgctctacccgactgcgctacgggcaactcctttaaggggtcctcccatgttttttatccgactttctcccacactccaattccttctttcaccacatcaaaagaatcatttttttaaattgattatttattaaccaaattctgttaagttttggccattttgtcaggtctctatagcaatagtggccgcacgcgataatttcgttcatctttgggctcgcatgaatgcaataatgcattgccttgtggaacagatcgcttcgacttgtcacaatgttattgtgccaacacaaataaattctgaaaaaaaataaaaattttattaataaattttataatatagtaactataaaataaaaataaaaaaacaatattatattgatgtaaatatttttttctaaaaattaatgagccaaaaattcttcaatgccatgattaattaataataaataatcaaatatatttttcttattatttgttaaactaataaattgacgtacaattctcggtcttttggcgacaaaaaattagtgtccatcctccgttcaggcaaaacaattgcagtttctgtccttggtttactgagcatttttgtcagcgttcgtttgttctttaattgtcgtttgatgaggatcgttgtattaactaaaagataattaattcattttaattaattctttatttatttttattactcggccgacgcaaaactgcgacaaaatcataggacggcggcgaaattgtgtgtcctcttgttgaatcagaaattaagcatgaatcgcccattttattttaa

SEQ ID NO: 28540 - DNA, 1557 bp, Heterodera glycines
  misc_feature (12)..(12): n is a, c, g, or t
ataattaaaaancagggctgccaaaaattttcaaaaccagcatttgccgacaaaaaccatcatttaggggccaaaaatcatctgaaaattttagtcaaaatgaaaaaaaaataaaaatgttttttcgcgtcgcgctttttccgaaaaaattttttgaaaacagagggccggcggcgccgattaggcaccaccgggaaaaaattttgaaaattgggagtttttggtggtattttttttttacataaaaatggccattttaaggatttttttctcaaaaatcaaagaaataactgatgagtgtccaaatgccttcagactttaaaatactccgaggggaattgaaccaccgaaaaaacaaacaaaacaagctctcccaaaataagtaaggtttttaccgccaattgcattcaaaatgtgttagatgttatgattaaggtatcgattaaacaactgataaaaatgtgtaccatcgtaaaaatatttattaataattttttaacaatcgccgaattttcgaatgattttttcgagctaacaattcttgttaggagtttacgagagaagtcacttataaatttttgaaagcagaaaaaagctagggcttctttaatttgcctgggacgcaattcgctcgtttcgcgcaacccaacggtcggtcccttgtaagcctaatttaatgcacattattaatttcttcacttttcattttatatttatgaaaacaaatataaataaaaatatgcaagcaaaaagaaatgatgacaaaacgttgggaattttgtggaaatatttaaatgccataaatgataaatgatggtaaaaaacaacgcaaaacccgcgcaaatgatgatgaatgaaggaaatgaaacgaatgaatgtgaacaattataattaaacatatatgcaaagagagagaaaagtaaaaaatttaaaagggcaaaaatcaaattatgcaattaaaaaaatacaaaattggaatacaatcaattagcatttaattggcgtgaaattttatgattgagcgtcagtgtatggttgttttatatgctcaaaaatgcttggaatattttatttaaatttttttttatttcagtaatctcttataataaaataaacatttttgagcataatttcgagagacttttttacaattttatttgatcaaaaattgctgctattttttttttgcccatcgtaactaattacgggctattaaacatgtgtggaattgcgggaaattgttcgttgctgttgctgctgcagttgctgctcatctgccaattgcatcattatgccggcagatgtgaaaaatgtgccattgtccgcatcggtggaatcgggcgtgtgcagcagcacttcctccggcaccgtctccatgatgataccgtactgctgctgctgttgctgtgacagtcgattgttgtaaggcggtgacgaacggttgccgttcatgccagcaaatgccaatgccgcagcattattttgtgatgccattgttgttgtgtggggcggcgatccatcaattgccatcattcctccgtcaaaactgttcggtga

SEQ ID NO: 28541 - DNA, 1516 bp, Heterodera glycines
tgatgtcataccatcaggagtgaatataaaattatatgctgatgatgttaaaatctatatttgttataaagcaagaacagaaacggaaattatgcataaagcattgcataatttattcgaatgggcaaataaatggcaaataaaagtttcaattcaaaaaacttttgtactttatttgggttcaaaaaacccaaaagaaacttataaatttgatgggaatacaataaatgctgtggatacaattagggatttaggagtaaacattgataacaaattacaattttccaatcatgttaatcatataacaaggaatgcgtatttacgtatgcgttccttgttccgaataattaaatccaaatcatctaagatttggattacgttatataaaacttatattaggcctttattggaatacgctccggaggtttggaatccgtctcttcaaaaaaatattaaaaaaatcgaaaagtgtcaaaaatatttcaccaaacgggtgttttttaaatgcagccttccgccaattccataccaaaatcgattagaatacctgcaactaccaacacttgagaaaaggcgaaagctatttgatctgttcatggcgcataaaattgtttatggccgaacagatctagatatattaaaaattttcaaaccttctgaacgctttaatgtccccttttataggtttaacacaaaatataaattaggcaaaaaatttattccctttgcggggagggctacaaaattgtggaatcagctggataaagaaatcattaaaataaattctttaaatcaatttaaaactaaaattaaactccttaacgtataaaatgaccggaaaagtgaattatctctttaattaaagatattatatattttatatagtgatttggttttattaatcattgacctcattcttatatttaattttgttgtgatttctttttttgtttaatgtttaatccatattactcgaggacaatttaatctatgacacgtccgcagagtaagtggattactcccttttgtggacttttttcttttttgcataaataaataaataaataaatttgacaaaagcagaaaagccaaaagaaagaagatatatttatgtcaacaatttttttataaattttgtccataaatttttattaaatcaatttcctaattcttaaaaattttttctaaaaattggctattttcaaaatttcttacaatgtcttggcctgccaatgacgcgatgtgcagtgccgtgttgcccttctttgtgcttgcgtccacagtcgcgccacgtcgcagcaactcgcgcacaacctctgtaaacggaaaaatttttcttttggcgaatggcgataaaatggccataatttgagcatgattatcttaatttctccttggccaattcgaggaatgttttaagtagggatgatatttttagggttttcactatttttttcctgagctccccgtagcgggaaatgcacgaaaaaccatgttttttttggctgttgttaaa

SEQ ID NO: 28542 - DNA, 1305 bp, Heterodera glycines
tgcctttgcatttccaatgccaaaattgtctttatttgttttttggctgtcattccaattttgaattattgagaaactaagagttttagagccaatttgactggaaaacatttgattaatggcaaaacacttctcttggaatttgtctcgggggacaaaaatgaatggctttcttcggacggcactgactcattgtcagccgcttctccctcgaggggcttttcctttcaaatgctttgccaacaaatccttcttagcccggttatttgctaagaattatttgccaatggaaaaacagcaaaaaaaaaaaaatacaataaaagtgccaatggattccttattacttttaagtgctttaataaaacattggttccctctcaacaacttttgttttgccaacttttactttggcattaaaatgccattgctccccttaattgtgccgtgtcgcattcactccaaaacgcatttggacttaatcccttcctaattataatttattgactctctctttgagtgcaataataattagatttaaataatatattttctgatcactgacgcctctcacaaaagagaatttcttggataaataggtttattacaaaaggcgtgcagaaatgacaaagtgactacaatttataggcaaaaatgatcacagaatttagagggaacaaaaggttaaattataaaaacggaaaaatgacaaaggacagaaaataagagtgattaataaaattattcataagacaaaagattaaatccaaatttataaaattaacaaatgtcaaattagtaatttcacgagcgaattattttggtcgtgacataattatccttttcttatcaaatgttagctcatttccttctcatctttgttttacattggttaatcaaccagccaaaataaaccttcatttaattaattaaaatgttttttacaaaattttcataattaaaattaatatttttcgctattttgagatttattaatgtgtcataattcttttaatctttttttcagaaacaaaaaatactgaaaaaggtttattatgtattcaatccgctgaagagagagagagagggttttggacagtttttttttggggagagcagtgaattttgagtgccgaagtgacagaaaagcgaacggccgaaagagcgaagccaacggacggatggcatcatttcgtattaaatcctttcaaatttttatcagttcgcccccttcccatctccatccctcctctcccctccctcctctcttccctccctccccttcccctctctctatttaatagatcc

SEQ ID NO: 28543 - DNA, 868 bp, Heterodera glycines
aatagagtacccattctcggcgatttgtcaccaattagccacccggggggcaaagtgcgatcagtgatcgcaaaacgtttagtgggaaagagggcgggagggggaagcatttgggcgggcggcgaaccgagccgataaaagtgtataggaaagaatgaaaggaaacgataagagggggggggggggggggagacggaggacgatgttattaacaattggtgattattaccaggctgaactcgagtgactttattatcaccgagaatattgtgcaagggcaacagagagagaaagaaagagagagagaaagagagagaaagagagagagagagaaagagagagagagagagagaaagaaaagagagagagagagaaaagagagggagaagagagagaaagagagagaaagaaaagagagagagagaagagagagagataaagagagaagagaaaagagagagagagagagtcattgttaagtattgtttttgtatttgtgaataatggccaaaatgtgacaaatttccatcgaaacaacaaataatatttgtctgctgatgtttggtccctaacatttgtgtaaaaaatggcaaattaatccaaaaatacaaaaaaaaaagatccgttggaactggaattaaagaaaacaaatgatcggaagcatcgctttaggtcagctgatggccccaacgttatttttaaatcgcaattagtgcttactaattaccttccccattattcgtttttttataattttgtcgtgttcccgctgctgtcaataacagttggtttggcttccaattatgctttaaattggacattttcgtgtgttcgggcgaatattttccctttccattagggggggggg

SEQ ID NO: 28544 - DNA, 539 bp, Heterodera glycines
caaatgatcagatttttatttatccaacaaatgaatgatcgaagaatggactcaaaaccacaaaatgatcagcgtatcaatgaatgaaatcaaaagtgtccaaggcaatgaaaaggaaaggccattaaactttgtaaaacagcagaagtataatggaaatgtatgtgcacaaacaaatcacagcagcacgaccacaaaaataaggcacacaaacgcaaaatgggaggacaaatgggcgaattgggggggggggggaggaaaagcatagcattagcatcgctaaacagtccatccaaacccaacccatccaaatacaccacagtctcgaaaggggggaagctgttgagatgtagtgattggaatggatgaaaataatgatgaggaagaagacgatatcaatgaggagatgatgatgatcatcctcattatgaacagttaacaatccaacaattaaggaggcgaaaaaattaataatcaacggaaagaccacatgaatttgttcatatcttgccgcaaaatttgcctattggaactgagat

SEQ ID NO: 28545 - DNA, 763 bp, Heterodera glycines
ctatatttataatgtaattttgtaaaggtccaactggaatgccagctgttgactgtttgaatgggtatcgcagttacactgatcgctgtggggagttttttatgggggacccattggacccaaatatggagacagacttcgattttgctggaaacttggcgctttttgacaaggctgttagtaattaatgtgatacttatgcagttttaaattaaatttttttttaataatatatatttagtacaaaaaatacgctggctcattttgattcctttccacctgctaaattaaaatcttcgtttcggaataatgttattcaaaaatatctacttgtaacaatgtagtttttaatatcaaagattgtatatatccttcattttatttttgaaccgtaaacacacacattaatagctttatttttgaaaaataggaattcaaccgcgaaactgaaaacgtcttccatgggcttgactcggccggcgattgttctcggaactatcgcaatgatgagaatgttcttcaggtatgtaaattattgtttacttctgctctattcatttcgcttaaggattcttcccgtgttatctcgtggaccaaaaataccactgctgatgatgatgacaatcaaaacaattctacctcctctccgatcgactgacctcataaaacgatttgaacatcgcccaatttaggttgttgcctcgtgcaattgttgtcgttttttctaacattatacctatgtggatagaatccgatctaacaa

SEQ ID NO: 28546 - DNA, 1366 bp, Heterodera glycines
tgaaatttattctttatttgttgttgatttttggcaacttggcatagcggcgattacaaagagaagcaattaagggggggggggggggaatttgggcgaattggaaaagctaaacaaaataaaaaaaggaaggaaaagaaaggcagtggaaaatggggaggagaagggcacgggggaggggagggcaatcgctactgattttctgcgttttcttcccctgatcagaatagcttttttcaacgtcttcgggtgccgtcctcgaagaacactccgccgtccacggcacagtatttgggacagattccgcgctctccggggttgccaggctgtccgggttggccgggctggcccggtgctccgccgttgcctggctgtcctgggcctccaggcggtcccttcgggccgggctgtccggacgcgccgggctgtccaggggctccaggctgaccgggctgtccgggtgcaccagcctctcctgaaacagagattaattagtccgttaaaaattaagcgaatgtctgtgtcggtctaccaggtgggcctggaggagggggctccgtctgcggtgggctggcaggttgtccgggctgtccaggcgctccaggctgtccgggttggccaggctggccattgggcccaggtggaccgggctctcccggttgcggctgtcctcctccggtaccgggttggcctggtgatccaggcgctcccgggggtcccggtgggccattgtttccgggctgaccgccagggcacggggtgcatggaggctgagcatggaaattatgattacacgtttgatgccaaattcacgggactcaagactaaacccaacccgaatttaccgggtgcacttgctcacaaggcgtctgcggggtttgtccgggctgtccgggtgagccgggtgctcccgggtttccgggtcgtccaggctgtccgggttggccgggctggccttgggcaccgccggagcaacactcttggcagctaccgtatgcgctacgcgccgtacggtttccggagaccagcagaggcagccccttcagctgactgacttcggaccaaatgtctttggcattgtgctgaaaatggcacttttagcacttaaattgtgtgccgtattctttgcctggcatgagctgagctcagagtccattttcatgcccacgttcgacacgtaactcttcagcattggcagtgtcaagcacaccgacaaaagtgagatgatggagaaagaaacggtcgtgtaagccacgaagcggtaagctttgacacgcccttcgaagtcggccattttttgctaagttttctacctgaagcgccagggggagggaattgttaattagttgggacaatgcttaatagt

SEQ ID NO: 28547 - DNA, 1263 bp, Heterodera glycines
tattacgtatataaaatataaaaattgattgatgcaaatatatttatttgataatatcaattaaagattaatttccggcatctatttctaccaatcaccgagccccagacccgaattcgaacaaaaattcgaaaagtcaaattttatgaattttgagttttatatcaattaaagattaatttccggcatttatttctaccaatcatcgaacctcagacccgaattcgaacaaaaattcgaaaagtaaaattacacacacacttattgggctttactaattgtatgtactttgtctaatattcctttggtaatttatttaattaaaaatatattttattgaaaatatttttctattaaatttaatttctcataatttagaaattgccagttgtggagatttgattgcattactcaaaacctaacgatacgatgtgtttttcaagagaaagtttgtactcacaatcagcaaaatctatgcttttaaaatgcttattttaatccattaacttttgatttttccaactctctagaaatggcaccaagaatgccgttaacggctgtcggtggaataccaaaaagcagtaaaaacgcttctttgtttaaagcaattacctatgctttaatcaattcagatgcaattggtctctgtttgatttgcaaggaactttcttttggcaaacactacggtttgtttgggaagaatcatttctcgagaattgacttcaatgcccttgtttaggttgtataagttgccttggttgtaaaactttctttcgtcggtaattattccctttttatcccttttgcattttatgctttcttttttgaatttcgttttagtgctgttatgcacaaccaggacactgtgtgcaaaaagccaggcttttgtgagttcgaagtgtcggctcgtcgactttgtcgttcgtgtcgatttcgtaggtcctcgatggacaatgaattttgtcgtttatattttgattatcataggtgtctcgagatgggaatgagtcgagaagcactccaaccaaagcgtgatttgatcggccggcagagacgtcgtcgttaccaagcagttgcatcttcggtcacccctcccaaccaattctctccttgcacttcgtctccaaccgggagcgaagatgcgttaaaggtgaacgaatgaatttgggtctaaatttacccattcaatattcccttgccgatatttcttctaaatttcagttccttaataattcccctgcaaatgaaaccggtaatgatgcc

SEQ ID NO: 28548 - DNA, 855 bp, Heterodera glycines
aattacataaaataaatttaaatgaaatgtagggcaaagccgcaaatgtcgggccgcaaatgtccgaaaatggcccttaagaaatgggccgcaaatgtccgaaccgcaaatgtccgggccgcaaatgtcgggccgcaaatgtccgatttggctggggccgcaaatgtccgagccgcaaatgtccgggccgcaaatgtccgggacgcaaaagtggggtaaccgttgttacccagcagtgggaaaaaagttattggttaaatagcaaaaaaaaggtctttaggtcgggatagcaaaaaaaaaaaaaaaatcgtctttaggtcgggtcccccccccccccccgaaaaatgtttctagatacgcccctgggggaaaggggcaaagttttggccctttactaaccaaatttgagattcttgcaatcacattgggtttttgggtgttttgccaagtcttctttcttgaattaaatcagacatacgtttaaccatataaattgagtgatttcaatttgtcccagcaaaaattgatgaattccacgccttaacacaacacacattaagggaaaagcgttgggtgatgctcaaggacagcagcatcagtgtgtggaaatgggtgccggtgtcgtgcccgcccggcggtgtcgtggcacccaaattaatcaccgcgcaaaagacagcggcggcaaatgacgaaaatggcagcgccaatgggacgccgacggggcaaaccgcggctgctgccgcggcggtcgcttccgcggatgaaacgacgatacaaagcggcgtgtcgggcgagaacaattccaacgaggacacggggtgggaaatcaaaatggaatttctaattttgattcaa

SEQ ID NO: 28549 - DNA, 1112 bp, Heterodera glycines
  misc_feature (20)..(20): n is a, c, g, or t
actaagaaaacgaaatttantcgggtaaaaattttaatatttttgttgcgaaaaaccgaatttcatgggaaggattctgaagtgtttgaaaacatttttttattttgatggaattcaatatttacggtgaaaaaatttatgaaaatttgaacgatcgatctttcggagacgttttttatttaattatctacaaatttagcataataaagccacagaaaaatagccttcttataaaaaatgatgcctactttcataggctccaaaattatttttattattttatttatttaaaaaaaaattcggccattgactaaatttaatataaacttttttttaccttccaatcgtttcgtaaatgcatcttttccctccattagtttgttcattgcgatttcgtgcaaattaaacaaaaactgcaaatgcttttccctggcacatggattttttaaatattttggcgcaattttttcgctgaaaagttcatttttcttttcaaataaatcggagagtaaacggtgttcgtttcggtcaatctcctccattggaattgcttccatggcaccgttcattaaaatttccaactcggccaaacaattgtccaactgttcacgttttccaccattatcagcagaagcagacaaatggtgttcattttctttaaagcttaacagaggagagttaaatgactgtagaaatgtaaataataataaattaattaaaaataaattaatttaagtgtgccgttagagccgggattaattaggcgccacaaatttaccataacgaaagattatggacatattttttaaaatttcgaaaaaaaagacttttttatgtcagttttaaaccgtattccaagaaaagcaagctaaatgttaggatagaggctttggcaagcctggcccaggccctgttggtttctctcgtttttcttaagcctaggttttcctgcaggaccaagtcaagcatgaaaaggtcaagtccagcaagctttttcaaagatggttgattcctagtcaatacttttattaaattattttaatatattaattaagatatttgttgtcgtggagtgggaggagcatttgtcgaaaaaattttaatcaaaataa

SEQ ID NO: 28550 - DNA, 1200 bp, Heterodera glycines
atctactcaaaccgcgatcacaattcaataaaaataaccttccggtgcgaaaaatggggcttgaaaagtttttttgagcttatactttacaaaataatacccctgggagaagggagtgggaaacatgatttcaaaattttccattttttctagactaatctactccaaacggttcacaattccataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggctcagaattcgataaaaataacattcacggtgcgaaaaatggggtttgaaaagtttattttggaaaaaaagactttacaaaataatacccctgggagaagggagtgggaaacatgatttcaaaattttcaattttttctagtctaatctactcaaaacggttcagaattcaataaaaaataacattcacggtgcgaaaaatggggtttgacaagtttattgggggaaaaaaagactttacaaaataatacccctgggaaaaaggaagtggggaacatgatttcaaaattttccattttttctagtctaatctactccaaaacgggtcagaaattcaataaaaataacatttcccgggggccaaaaaagggggtttgacaaatttatttgggggaaaaaaaaattttacaaaataatacccccgggaaaagggaggggggaaaactgattttaaaaatttttaatcttttctaagttaaatctactccaaaacggtccaaaaatcaataaaaaaaaaactttcccgggggcaaaaaaagggggttggaaaa

SEQ ID NO: 28551 - DNA, 898 bp, Heterodera glycines
gaagagtgattagaagaggtacaactcttcaattttgctctaaggcattttttggctaaaaccgacccctgacgagttatgggcccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaacttggtttgatagcctttcaaatactacacatttttgctcagaaacaatttttcggtcaaagcaacccctggcgagttattcgcctggtactgaagtgtactttttgagcacacttcagttagccaagcgtgcaggccagggggtggctctaataaaaaaataaaaaataccagcatgtagaggacagttgtggggagtgccctcacagcgggcactttttgattcgggttttagaaaaaaagttaggggccctaaactgcaagaaaaagtgaaaaatcggtccccgggactcagtcgtccgcgctgaatttttctctatagttttcccggatgctcctcaaaaagttgtaagacccttccactactttcagggcgctcccggccttcggccgggagaaaatggttttagcaacgaaactcaaaacctatataacatatatataactagcgggtgcgtgaaccgtcggctatttagctgggaaaaagcgcttcgcgctttgggagcttcgctacctagattagctctggttatggaaattggaatttttaaaaaattatctggagacttttttttgaatttttaaaaaa

SEQ ID NO: 28552 - DNA, 1264 bp, Heterodera glycines
gttttccaaaaaacaaacaatccaaccttttgttcagcacggtttccaactcaacttcggcaaaacggtacattgttttttgaaattgtttatcaaaatccaaacggattttgacaaaattagtgtgttgttcatcaaaacgctctcttgacttcgccaactgttgtttgaaacgagcccttgatcgagcctgttgctgttcgaaacgctcattgagatgcgatgtgaaattttttgaccacgccgtgaaatcgttgttgatttgcttgatatcgttgaaatgtccactgatcatcagtttgaacgatttgtgcttttcgtccacgtgcagaaacaattgataagtgatgcataccatgacaacgcacagacccagagcgccgacgacttgccagtatttgctaattccttaaaaaaaattttaaaagacaaaatcttgaacagattggtggtatgctatgtaatttctaatcgagaatttaccatgaattaaataattttgattgttccgtccacgattcatgattaggtagagacgaaaaaaatgcaagaattttactaaagaatcaaaaaatgagaattaggaattaaattcattttaaacggataatgtggatatattagcttggtatatgaggtttttttaaacaattttgaacataaattcacatcttaagcgaccggctgagttgtattatgcctttttcaagattttcgtgcctttaatgcctttttggcattttgctattttggtgcctttttggcatttttccgaaaaatcccatttaaaaatgcaataaaatcgggaaaatacacccgaaatgacctgaaaaattttcagaaaacatagatggtacttgataaaaaatgttaggtttaaaaatttttttccttaatataaaatatttttaataatcattcaaatgaccaaaattaagttagttggttaagtattctagtgccttttgctaaaacctttcataaacaacaaacaaaaacaaaatatggctctagtgcactttatgagtccaattgagttttatgagtccaattgacaatccctgggttgttatacaataactttgttcatgttcgaacaaaccctatgtttttggtatcattcgaaagcacacagtctgaataatgataaacatttaaagaagttacaaccgaaaataataggcaattacttgattaatcagatcttttttcgtaatcatgttggggttgagattttatatattttagctactttagactttgt

SEQ ID NO: 28553 - DNA, 868 bp, Heterodera glycines
  misc_feature (838)..(838): n is a, c, g, or t
gaacaaaaagtcgaaagtccaaattttcgaattttgcatttttggttcaaaaacggcatatatgctctcttattgaaggattgatggatcagtttgtttccttgtatttaaaccgattttgaagaaaaacactaatttcgaaaattttgactttcaactttttgttcgaatacgggttcggggttcgaaattcagaacaatattcttatagaattatacttctgtattacaatatcaatactacaaaacttaatattaaaatatttgtatcactgacgcattttccggtcacgccccgcttaccatgttaagcttcgggtcgggtgcaactgcgtcattggcattcacaattggaataatgttcagacgtagcagactttcaatggtcgcctgcagatttttgcgtcgctgcgggtcgtcaatgtccggtttggtgagcagaacctgcaaaatgaccatggaaattggaccatattccatggggatagacaaatggttggacaggacagacctgggctacggtgataccgtactgttggaacagctgttcgtacagactcatcagtcccggcattccgctggcggcacacgcccttttgtccgtctgcatgccggcgggcccgcgcaaagtctgccgcatggacatggacatgaccaactcctggcgcaacttttgacggccaaacgcaacggcgcccgatgaaaccatcagcatttgacggccagtctgttgcaattcggacacctgagaaagagggggaaggaaattggatgaaagaaagacaaacaaacaaaggaagggagaggaagtcatcagactatcaggtaaataatggtnaattgatcagaagggggtgatcggacctat

SEQ ID NO: 28554 - DNA, 810 bp, Heterodera glycines
tctgttctctgttctgccattaccgaatgtgtgtgtcccgtccgttctgatgattttggataatctgaacaacgatgacaaagacattcgccggtcgcttcgtcccggcatggcgaaggtcgatcatttgccaccccgaaggctctgtgaaggaaagggacttgggctcgtccaaatccaacaccgaagcgccggtctgaacttgaattctgaaaaaacaaaggtaaaagcaaaagcaacaaaattcaaagttcacttggagggagtgtacgactcgtcgagtttgtagtccaaaaacatcagcagaaagtcaacttccgttttccgttggaattctatggtgattgagtgcggctgaagaccatcactttgcctgaagggaaggaattgacggaacaatcgccaaaaagtttcgcttcccttcccactaaatgtctagtgtgccacccccccccccccccttaccaataagtgtcttcgcggtcgttcaacaactgatgcaccccaaggccctccttacagctcgaaagtgtccaaatggcatctcccgaaatgtcgttggggtgaccaacgccgggcgggagaatctcagcccaaaagtgactttgtcgctggtgagaatcatcgacaattgaggacaaaccgacactcattattcgtatttgggccgaaagcagaaaaatgtcttttttttctgccgactaatcagataaaattaatcattataaaaaagaacaagtgattatcggagcccttttttgaagcaaatagtgttttaatatatcgaaatcctccatccctggaaaaaaa

SEQ ID NO: 28555 - DNA, 1190 bp, Heterodera glycines
cgaactgaggtagaccgttgagggggtattcccgcccgtaaagttcacagggctgaattcgaaatcagttgctaaacgaattgctcagaaattgccttagggcagcaaattgttgttttgaacattttgccttggacacataaatgttagcccgagaaatattaaattttaaaaatgccagaaagtttttttaattcttaatgattgccgcttttctccttaaattgttttaattcctttggggcattaaaaatcttcttctttttttctctatggttttttatgtttacaaaatgccaatttaaaaatgtttaaataaacaattgtgcttgagattttttcagattaacaaattttgaatatttaacaaaaaaagtgatgttaatggaagctctttgttgttgtgccattttattaattcattcttgtgcccttgccgtgtaatactaaaaagtgaattaattaaattcaaataaataaaaattaattaaaataaattaccatccaataaacgaggttgaacaagccaaaagaaattgggaaacatttttggcaaaatctaaaaatggaaatgatcatttaatgattttgccaattttatccttttaggggaaaaaattaaaaaataagaagaaaaataaatttgaaaatgatttttgatatttaaataatattagtttttgttaattttcttttaaataaatgaataaattatttttttataaatgattaaatgaaaagaaaattaatttttgtacatgattttgaacaataattacaattttaattttaatttcaatttaaaatattaattttttttccaatttcaaattatttttatcattataaacaattaaatataattttttatatcttttcacctgtccaagtcttcgcccgtccatttgctgaacagttttggcacaggctttggcttccgtcgcttgcgcgacattgcccggttcatccacgtccgtgccacaaacgccaccgcctgcaaaaaattataaaaaaaaaaaaaattttttttttgtacctgggaagggtctgtggccaagccggcacgggggtcttcggaagggcctctgaaaattaaattacaaaaatttttgaaaattttttgtccaacggagtagcaaaaaaggtcgccggacgaattgttggaccataacttttttctttctcaacca

SEQ ID NO: 28556 - DNA, 316 bp, Heterodera glycines
cccccccccccctcccctttcgctcgtttttcccgacttctcctcgtaataacaaatccagtttcggttccttaataaaacacataaacttttccaaaagctgctaaaccacagcaggagacggctgacgtgcagaagcgttgggaagttaagcggagtcgtcaaattaatcgcgtctttcgtccccccccccttccccccatttcccccgtctcagtcgtccgttcattcgacagaatgaatttaaaggattttaggaaggctttagcgcatttatttgcgacgaaattttatccccgcataatcgttctccatt

SEQ ID NO: 28557 - DNA, 925 bp, Heterodera glycines
attaaaagagaaaaacataaaaaagcacctttttgttcccgttttttcttcaaaaaagtgaaaagcagaagaaaacgtttttcggaaggacaaacgacgtaaccctaaaaagtaattatttcagatcggatggacaaaaagatttatttgaatatttacaagcaaaacaatttcaacaaaaaattgcaattaaatgacagagtcccgctagaatccattcgctgacctgctccaacccctcaaccgtggccatgtcatttgggtccctttgctgctccatcactccgattttcagtgggtccgttttcagcgcagtctttaccaactcgtcaactttgggcgaacatgtggcggagaaaagcatgctctgccgtttctttggcaacaatttgacgatttggtgcatttcctgctcaaatccaatgtcgaaaattcggtccgcctcgtcgacaattaaacacttcaaattgcgcacgacaaaattggatgtattctgaagcattaaataatgggaaatgaatgctgcttttcccttcggttccctcttttcaattcaacaaataaatcaaaaaataacaaatggatgagtcaggacggaattgcccaaccctctcccctcatcgcccgtaaaaattctcattgtactaggtcgttgcataaaaaagggcgctttttcaaaatgactttttttaggacttgattaacgctagctatgtctttattgtgtgtaattcttttatctgaatgatctcgtcatgcttttgccaaaaatattgattttgtccttttatatctaaagttacagtccaaaaaattgcgtaaggtcaacaaaatttggctaccattttacaccaacgtccataacttgaggtaaaattgtcaaaacgacttaaaacttgatcagattatgagatttgatgagctt

SEQ ID NO: 28558 - DNA, 791 bp, Heterodera glycines
ccgaaaattggaaaatgttgtcaaactttcactggtaaccttttgcatatataaaagtggataaatgtgtacacattttctgtttttgtcagcagcacaaagcctttgttttcgctaccgaaaaatcgaaaaaaaaaaacaaaaaatatttttagaggaaaaattaatcattttgagaaaagcgaaaggcgggcgaaagagcgcaaaataagcgcagttgaggaaaaggggagaagcattcagagaactaaacataaaaatggacccaaattgctaactaattacttaattaattatctggattgtttgatgatgctaaattttaattttcgtgttccatttaatataagcacccaatggacgtgattgacttgacgcacgaatggtctgccgatttgtgggattggcctttacaggtaaaaatgagaggtgactatggaaaagaaaaacgattaaaccggtggtccatctgtccgttaattacattattttttgggattttgtgcaaatcattgctctgctaaaatgccggatttgtctccgtccctaaatgctctcccatttgaagcacaaggatggcgttgtgcgtgtcgacaatggccacgaccgctgggaggtcggcttagacgcggccttttttcgacccgacgaaattgaggcatttaaaaataattggtttaataaatccgaatattttgtaccatttttttcttctttttttcctccgcttagatcagtttggccggtgaccatctgttcgtctatttcaccacgaagaacggtcggatgag

SEQ ID NO: 28559 - DNA, 1379 bp, Heterodera glycines
  misc_feature (1262)..(1262): n is a, c, g, or t
taaatataaaattgtttagcagtcaaacggaccccagagacttcaccgacattgggttggacaattcatttaaattttcaattttcaaattaattatttagcacacaaacaaatggccaagtcattggccactggcgtcttcaattggggttgtcatcatcgtttcggtcgtttgctgtacaaccaattcggccctttccgtattgccctcatgttgcattacatccgcgggcctccgccattttgaatttggcatttcgcccatttccattttcaccaaaagtcatttcgtcccctctcgctgatcacacctttttgttaaaccttttccatcacatcgaaatcactctgcccattcgttttcctatcaatcttttgttttcggctcaatcctttcaaaatccgccgccatctcttttcaatctcaaatacttattttgaccgaatcattttccatctcccacacactctgatcgccttgtatttttaaaccgcttttcgttatttaattttgctttaaccattttaattcacttattctctatttacattaaatgttgttttctttttcaattctttttacaattctcatgttttattatttcatttaatttatttttggttttttacaatcaaataaaataaacagcgaatttgagttgcttggcattttaaaaaatgaacttactggaatttctattaaataatggtaatttagtattcatgtttcacacaatagcatgaaaaataaaaataagtctgatcaattacaataacttttttgttccaccccagaattatgctaaataaatttttatcagatttttattgcacaatttgccttctgtaaaagtgatttttgttaaacatattggctaattgaatccacagaatttaaactccttcctcaaccagttgaaattaatataatttcgcagtttttgatcatttccggaagaacaattgacaacagttatttaataagtaaaatttaggaattttaatatttgctttttccattttgctgcttctgatttttaagaaatccagcaatttgctttttttctttgtttaaatggaacccaaaaatttataattaaaaagtaacaaaaatgagaattattaaatttttctaaattttattccaagttcctgtttccatcggctgattttttacaatgacaaaacctttcgcaaattgcttttgtttttttcagacattcttttaaactcatcaattcgttcaagaaaacaataaaatnctctttggtgtgctctaatcaccatgatttagctagttcaaaaaatttgtaaaataaattcctttttttcttttcataaaattcttttcctttgtttttattttttctgcattttga

SEQ ID NO: 28560 - DNA, 1871 bp, Heterodera glycines
taaattaaattaaaaaaagcaatttatatttattcaatgaaaatgaatattttaatattgtattattaagccaatttataaaataaaatttaaaattttaacaatcgtccaaatacacgacgaactttcaaatagaataaaaaacatttataggctaaaactgacaattctaggtccgatcccgcaataaaataaacctttaaaaatacgacaaataataattcaagcatgttttgtttaatgtgataaaccgctaaaagttatatttaacaaattttataagaaacgtatgaaattgcactaaaattaaataaattttcaaaaaaaatataacaaattttcattaaaaacccgaaaatgaaaatttaaaacgccaatacagattcgatcttcgggattgtcaacaaataaatcttcgatgatcgttaagaaggtataattatcttatataattaaataaatagaaaaaaatacaaactacaaaaaatgaaaaattattattagcagattaatttaataataatttgtatttattcattaagatttaaacttttaaattattgtaacctaactaaacaaaatcaattttacaagtctaatttgaatactccgcagatgagtttgaaaaatatattatataattaaattaaactgaaaaataaatttactaaaaatgataacttatttattcacgatgagcgtaacttttttttaattaacgcatttttttagtaatttgcaggcttgtagaaaacatttagagctatcgaatgatattaatattacttaattttgtcattattatgaaagtttcggtcagaaatttttcatgataaaaattattttatgtttaatgaaaaattttcgttataaattgtatttttttattgaaatcattcgatatcactaagggtatctactaacctgcaaaatttcaaaaaatttggtaagtttcaaaaaaattagggccaaaaatattcttaaaagctggttccttgagtacttttggccagaccgacaaaacgttattttctgtgaaaaaatgattatataggcctgctgtatgagttatttattattacatatagattaaattataatgaataaaaatttgggaatcgtataagaactcgcatttctcaggtacatatattttgataatatttattgtgattggttttaccagcataatttaatatctcattttttcattatataagaaatataatttttttcatcatttttatatatttagagataattttttaatatttgtttaaaatttttaaggatctttttgtataaagcttttttaaattatttctcgtctccgtgagtatgagtagtttctgctgttttttactcttagcttatttcctattaattttaaataatttgaataaattttgtaattttttattgattctttttaattgtttaactctttaaagcaatcaatttttcaaacaattagtccttttttaatttgagattttttaatgttctatttttcctagtgaaaatctttctccttgaataaaattaaaatttaaataattaatcatcatcatatatttttatctgtctttgatatttttatatttttcattatttttaaacttgttgaagaccgagatgatgtgcattcttcttgacgggcaattcaaatagtaattttcaaaaatataattttaataatatttatcttcacaatttaatttcgattaatttattttcatttgatatttaaaatttaatgtattcataagatttatttgtaatgtgctgattacatcaggctttataaataattaaattaatttattacaaagaatttctatgaaaattaaatcaagcaaaaaataattaca

SEQ ID NO: 28561 - DNA, 730 bp, Heterodera glycines
gaataacagtaaaaaagtgaaacccatcacaaaaaaatgacgaaaaatcagttgatgaaatcatagattagatgatttatatgacaatctgatgtcagattcgtgatcatcaccctcggtaacccccgagtaattctcagaatcgcaaaaaacgaccgttttttgccttttaaaacacctcataatcgtccccatgtttgctgatcatgtgctcgcaatactgaatgtccgtctccaacagtttgtgctcccgcggctttcgttccgtcgtccgccgagtgatccgttccaatcggagcggctcaattttgatcggctttaaaggtgtcgccattctctgcaacggtcgttcgtcataatgtttgtttttttctggtgacgataataatttttacttggatttcgtccactgaagtggccaatttgtgcacatccagcgcgaattgcgtcgtcacgcttcccccgttttgctgctgcgtctgtcgttggtccgtccctaccgtatccccaccaccgtattcccccgccctcttcgttttttggtcggtgtttctctctttctctgctgctccttttcctttctctcctcctatgccattttccattaaatgtttcgtctgtcccttctcttcccctctcttcttctgctgttgcttttcctctcctttttccccttttcctctcttcttttttctcgtccaaatcgctaattcgcacagtttttcttctt

SEQ ID NO: 28562 - DNA, 746 bp, Heterodera glycines
ctacccattttggacatattcaaacttcttggccttggtaaatttggccatccgatttttatttgtaataaattaattatttttaaattaattatgtgatttaatattcccattttggtaatactgccgatgtgtttttgtaagtcgtaaaaacatgtttatcgggattataaatgccaaaatttccaaaaaactattccaagattccaattcttgtgctcaccgacttggtacggtataagcccattgtggcgcttgaagctgtcagccttgtggcgtgttggctgttgctggtctttgggacaacacttggacaaatgcaattaatgcaaatttgtttcggtgtgctctttttaattgttttaaaaagaacattaaaacatattctatttatatttgctactttaattaaatttacaaaattaatattgttttccaatttagctgttttttagaaaatcttttaactttgtgacagggagcaagcagttcatttcctccttgaaaatgttttattgtttaattttcaaaatccgatttttttttttaaatcacaaaaaattttctagcgattttttaaattttatgtttattaataagttttttaaaaaattttcaaaacttttttgcttgaattttcttataatttttttaaaatataagtttgggcgattttctttttactgcagcgccattttaatattttttttcttgaaataggcatttcaacggctgccggcattgcc

SEQ ID NO: 28563 - DNA, 954 bp, Heterodera glycines
ggaggataaaatttccaaattttttgactcggtaaggcgctttgataaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaaaaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctcccacagtccaggaaaaaaatatggatttccatgtaattctattccctactcataacgccaaatagcgcatttggcgtaaatttttgcgcgctatttcaaaatttacactggaaaatgccttttttgtattttttattttgatctgccataactcgcttcattcccaactaaactgaacaaatttggtatctaaaaaaaatttgaaaaggggaatctttttctaagcgaatgctaagtaatttgacatctcagaaaaaagttgtgatactttcaaatttttatcacgttataactcaagtcctaatgcgaaattttcatcacactataatttaataaccgagcgtaaaaaattaaaattcgagcgttaaaaatgttcttaatttttttctctacctctatgcaaaa

SEQ ID NO: 28564 - DNA, 575 bp, Heterodera glycines
acaaataatacccctgggagaagggagtgggaaacatgatttcgaaattttaaattttttgtactctaagctactcaaaacggttcagaattcaataaaaataacattcacggtgcgaaaaatggggtatgaaaagtttattgggggaaaaaagactacaaaataatacccctgggagaagggagtgggaaacatgatttcgaaattttaaattttttgtactctaagctactcaaaacggttcagaattcaataaaaataacattcacggtgcgaaaaatggggtatgaaaagtttattgggggaaaaaagaagcaggaacaagtgatcagctttcttcgacagcagatccgcaacatagacgcactgatcactgcgcttcggcggcagttggaggaaaagatggcaccaccgatggagacaccgaccaccaggaaaagtgagtgaaactaaaatcccctttttatctttttcaaataatttctcttttttaattttagcaattccaacaggacgaccaaagatgaatgtcgatcatttagctgaattttaaggtgatgaggcgctccattccg

SEQ ID NO: 28565 - DNA, 1517 bp, Heterodera glycines
tcacttttgggtcgatgtttagaatattctaaatttaaaacttttaatcattttatatagattcgaatccaaatttccaaaacgttaaagccttaataaaagataactcatccatgtataattcatccacatacctaatattttaatggacaaaaaataaaccctaaaatatttaatggatatttcttgatgttgatctaaaaactaataacatccaaatttaaattcatttttatttaatccatgcttttttctggtgatgagttgttcgtaacccttttccggccgtccaaaacatttcccatataaaataaattagccatgctaatatccgtgccaagtgttttcgacagtgggtttcgacaatagaattttgccaagatttatcgcttttttctatacaaacatctcttgctggactgcattcaaaaatacaacaagttttctagataagcttcttgaatcgcgtgggaattgctaataattgccgggtttgggtgccaagattcgaaactgcaggctcttatagcagaattcgaaaatcgaaacccctctaaatgaataagagtatgagcatatccttttaattccaaaagttaacgagatttataccgtatagaaaaagttttttaaaaacaaaattttactgtcgaaatcaatcagtgtcgaaaactaacagcactctaataccgataaaaatgtaagaatttgttttggactatggcggtatttatgacacgactaatctaaataggtatggtatattttgttgcaactttgtcttacccccaagaggaatgcgatgtccggcatttggtaccatgtgctaaggatttgaatgatcaccacaaaatatctttcccaccattctttggcacccggacgcgcacttgtgtttatcaggtgcaatttgattagcaaatcatccgtaatatcggcttccaaattcaatgctgcgcttcgatacaattcgcttgctaattcaatgtttgtcgctatcataaaaatgacaattcccgctgaccaaatgtccattttcggagttacctgaattatttaaataaacaaaattaaccatattttaaaaaaacctcaattttatatggatactcaaggtacccatgataagcaaggccatcgaaatcaggcactaattgctgaaagaaaggggaattatttcaaatatggaatgcgagataaaagcagaggacacccctttttaagttgctaaaaatgcgcataaaaatgcacaaaaatggcaaaaaaaacccccaacaaaactcggtaactttttagccaatttttcaaggtaaaaaaacatttaatagcacatatttatcagcacttttcacgtgttttaacaccaatttttaaatagttgaaaataattgtattttttgaaccaatgagatttaatcaatttgcctatttattaaaagaatttgcacaaaaaatattttggatttattattttttaatcattttaacaggtgtattcaatgtaaaatattaaaccc

SEQ ID NO: 28566 - DNA, 1082 bp, Heterodera glycines
tgccattactccgtttggtctccactcactggtgagcaaagtgatcataaagaggtattctgcgtaggaaattattccgttgtcgcccaattcgcgaaacattcggtgcgtgccctttcgcagtggcggcgtaagggcaagcatttgccgcaactgcgactcgctgatgacaatgcgaaagacacgctctgaaagaatgagtcaaaaaaacggggaagaattaatggacgacacaccccgaggctcgtcgagagtcaaagagtcgagaaagtcttgcggtgtcatgaaaatctcgccgtcaaattcaacggaagcaaattttcgaaatctaaaaaaaggaattcgaacaaaatgtattttcaccaaaattcactgcttttcaaattaaaaaaaaaaaaaaattaaaaaagccccccccccctttttgtttttaaaaaagcgtcccacaaaaacagcaacagtgcgcacctttgtagcctccgcgggagtctgaaatgtgcctcttcagtgtgttcgttttctgcgctttttatggaggccattctggcgagaaaaagcaccggcggggcactcgccggaaggaaaaatgccaaaggttttcgaaaaaagaaacagcgaatggccggatgaattttgaagaaacgttgaacaatatttatgaagacaaaccgacgtaattgtaaaggaaaccaatgccgaaagaacattttgatcaatctaataagcagaattagagcccggcgcgggattttaccggatcccagtccaaatcttgtcggattgctggatttatgccagcgggatcatatccagcaaaaattttgagttcaatcctgtagcgggaaccgcaaatttgtttttttttgtgcggaatctcacgggacccgcctgcatttttttgaaattgaaaagacagaatgccaaaattttctgaaataagtttacaaaaaaaaattcaattaattaaagccatttttatggcaaattttccaaaatttgggacatttttcctgacgggtctaccggtccgccgaaattcaaagttttctgtttcaaaaatcccgcacgggatcccgcaaatt

SEQ ID NO: 28567 - DNA, 951 bp, Heterodera glycines
atacagcaagcagcacgtcattccactaggttgggacagctttgacagacatatacatacatgaaaaatagttaatgcatacaaggtacttgctagtttaggcccataaatatatgtacatagaacatgatgggtttgaattatttcgaaatttttatgttcaaaattttgcatttcatcatagagttatattgtcgtatgtatgtatttttagaggaagtaaaattggagaatttggaggatgagggcgactcacgcaatggatggctgatcaaaacgcgcaccaaatcttttgtcgtttatgcggccactcaaattgaaaaggaacaatggatgtcacacatcaggcgatgcgttgaggagctaattgatagttaggattattccatcagacattttatcaacaaaatatttttgttgtttttgatggaaaagtgccaccatcggattatgccgcactttgggtacctgacaaagaagcaaccaaatgcatgtgctgtcaaacatcacattttggtgtcatccaacgtcggcatcattgtcgcgcctgcggaaagggttcatcaatttgttcaaaagttttggtactaaaaccatttaacatttttattagttgtgtgtagtggctgttcatccaagtcttttgtgcttgatggtataagtaagaagccggttcgcgtctgtgatacggtaggattttttttattcatcattttttggaaaatgaatttaaaacaattccttgaaattgcaaaaattaagaaaaaagaacttaatttcgtttacatggaaaaaaactaatttttttttgtggtgggcgggaaatgattagaggagagcagaggaaaaataaacgtaccgtcacactatgcgccaacaattatgggcggaaaatttttgtgtcagattttttcttaaaatttttttttttctcctttctgtggggagggg

SEQ ID NO: 28568 - DNA, 1087 bp, Heterodera glycines
  misc_feature (77)..(78): n is a, c, g, or t
accgatattttgatccatgcacgaacaatcctaaaatccttaaatcataaagacaagaaaacgaaaacagagcaagnncccttaccatccgccgccgatccgctaaagtccaacaaaaacaacaaccaaggtgggaagcaagggtggtacaaatccatgctttataaatggatatgataaaaaatataattaaaagtttatatacctaggtaacaaaaaataaatttgtttattaaagttacagtaatatttttggtgtaagaggcctatatttaactctctcacggtctgatcacttttcactctccaatcagtgtctcatcacttttcactctccaatcagtgtctcatcactttttcactctccaatcactgtctgatcacttttcactttccattcattgtcagatcactttttcactcaccacaatcactgtctgatcacttttcactttccattcattgtcagatcactttttcactcaccacaatcactgtctcatcactttttcactctccaatcactgtctgatcacttttcactttccattcattgtcagatcactttttcactcaccacaatcactgtctcatcactttttcactctccaatcactgtctgatcacttttcactttccattcattgtcagatcactttttcactcaccacaatcactgtctcatcactttttcactctccaatcactgtctgatcacttttcactttccattcattgtcagatcactttttcactcaccacaatcactgtctcatcactttttcactctccaatcactgtcagatcactttttcactcaccacaatcagtgtctcatcactttttcactcttcaatcactgtctgatttactgtctggcaggagtgggacgcgacagcgattcgcggcttttctttgcgcgaacctcgattcgcgaccgcggcaatttgaatctgcgatgcgcaatccgcgccccgcgggattttctgtccgcgccccacccatgctgctgtctgctggtcactttttcactctctactgcaagcgcgcccctaatcaaaaacagaaataaaatgcataagcgcta

SEQ ID NO: 28569 - DNA, 1216 bp, Heterodera glycines
  misc_feature (1195)..(1195): n is a, c, g, or t
cgcgtccccgcgacttctttaagggcgtccgtgtgctgttgcggatcatcttcctcgtcctgttgccgcttctccaaatcgctcatcaagaaagaggttgtgttgtttggtgcccgcggtttgagcgcgttgcgcgactgcgcctgatggtggcgcgcagaaatgacactgaaagcattcgattttgatgtgtttttattgcttcgctttttaaacggaacaaattgggcggtggttgcgcggtttgtttcaaaccgacgcctttgcctgcgaaaacaattcccaaatttcgcttgagatttggaaattttcttgcaacaagtcatatttttgtttttggtcataagaaatttcaaatcaatttattagtagggaacgattttgctaatggaagttgaaaagaattgtgaaatgaaacgaaggaaaaggcagcgagagcagacaaaggaagagaaacggagttggtggtggtgtctacccctttctgtgcctaaaagcaatgagagtttaggcgagaaattttgaaattagaaaggaagagacggaagagaattgattgcctcgcatttaatgcgctatttccttttaatttcaccgtcttttaatattgaaaaaggaaaataattaagggggagagtaatgaaatatatttatttttttggcatccaaattttatttttttatgaataaaaaaaatttaaaaaaatttaggccaggaaaaattcaggcggctaaaattgtcttgtggcctggacctagggacagtcccaggggcgggaatacgtgtggtacgtacccccccccccccgcgcacccgaaaattttaaaggaaaaatagtatttttgttgaaaatttttttgatttccgtgttgataccccccaagacgacctacctcaccaaaattccaaaaattacacgaaattttttcccggcgtcgcctatcggcaccgccgaacccctccccttgttccccaaaaatagtaattgcatcgttagaataattacggtaatttttaaatatatcgtattgtaatttaaatatttatatttaactaaagactatttccaaaagacgaaggtacatagaaaaaactaaagtgaaacttgtgaattgataatcaaaaaatatttcaatgcaatttttagcccatcggagaaaataaatggtccttgtggcacatggccatctttanaaagagcaaattacggcttgc

SEQ ID NO: 28570 - DNA, 2168 bp, Heterodera glycines
  misc_feature (68)..(68): n is a, c, g, or t
  misc_feature (664)..(664): n is a, c, g, or t
caactcgtgcgcttaaactccgccccaccagcagaaaatcctttaacgtacaccacgttgggtacggnacgtccctcccctcctccgtcatccgtcggcggtattttgccagcggcaattgatttgcgttcgttcgtcaaattccccccgctgctggtgtccccccgccattcgtcggtgaacgaacggtcgcactttttctcgaaaacattgcgaaaggttctaaggtcctcgagactgttttttgccttttgccccttttggtcaatgccttcccaattttgtcaaatgcaaacgcaaatttcccactttaagattttgcggtgagaagtgccttttgtgcctttttgtttctttttttgtgcctttcctttggcggaactccaaaaaaatgacagcggaaacttcgtcgaagtcgtcgttttgttgtgtggcagcaacgacggcagctgcggaggacacaaatttaataaaacaaagcgaaaacaaaacggaagaggagggggaagaggatgaagaagcggaagagggggtaattcacctgggaggtgcccaaatcatagatttggtgtggccaccgttggcattgaaattctatggctgccgatttcctaagcagtttgacgatcttcttaggttggtgatgcgtctctgccgcctccgntctgctcatcgccctcctcctcctccttttgcgcgttgcccaaagagtcggaactttcggagagaaagcgaccggcggccatccaggaactgctggagaagaagcgggcacgacttgcgcacaacgaaagtggaagtaaaagtgaacgccgatcgatgacaccgacgacggacggaggagcagagacaaaattggcacggggagaggggacgaacggcggaggatggaggaggagggagagggagaagaaaggggggacaacggacggacaatgccaatgccatcgaagggagaaaatgacggcacgggagggaacggcagcaacagttattggtcaacggaacgtgaggacagcgaagtgagcggtgtccataggacggcaaaaccgagaattaagagtagggcgaatattttgtccgtttcggttccatttgtccgtcctccctccgtccgctccctttcctttccttccgttcatttcccccctcttcagactgtcagcagttgcggttcgtcttcagcgttcggcgcttataatggcggaattttctgcaacagcagcagtaaatcgccgttcgcttcatccgccatcggcgagctgaacctgggacaactgctgaagcgcgcctttggcgagtcgagcagaattttggccgacccgcaaatgttcgctgccattcaggcacggcaagaaatgaaaatggcaccgattaattgggccataaataataatttgtcaggagacaatgttgcaaaaatatgccgttaatgggaccacggcggcgctggcggccgcacttttatccaacaaaatgccaacggacgaagcgacgtcgacgagaaagacagcaatgaaggcaactgggacaccgtcgccggtgaaaaggggcggcgagagggacggagcggcgacgagcaatggcacaacagcggcgggcgacggagtggtggcactgaacattgtgccgaacgacaagtacggactggacaaagggagggggagcaaaaagcagggcaatgcttagcacagactgactgattagtgttttctgctgggattgccccccccccaccatttggcactcatttccttggccattaattcctttttcgcttttttcagagttttctcccaagtgcccggccgtctctcactgttgtccaatgttgttaagtacaaggtaacgctgcttcatcccttggttttcctccattatttaatttctctttcaggtcactgtcggagagataaaacgtcgtctgattggccccgaatcgttcaactttaggtccctcctccttttcctcccaattcattggccttcaaaccaaccgcacattttcagtcttctcggggcgatgttacgacgtgccaaaatgccagagaaaagtgcgatgctaatgggcgaactgaaccaagtcggcctgtccattccccgcgggcgtcggcgcctttcccaagtcactcttttgtccgcgctcaccggtaaaaaataaatgaatt

SEQ ID NO: 28571 - DNA, 1036 bp, Heterodera glycines
  misc_feature (52)..(52): n is a, c, g, or t
  misc_feature (62)..(63): n is a, c, g, or t
ccaaattttgcaaggtaacagctgagaagaagaggtcctttaagtgaaattncctttccatnntgtggatttgaaattttttcggtattcttattttgcgtacatttcgaattttgaaaaaaataaattcattaatattttttcagagagtgatctgaaacgcaccaaattttattttcaagttaacaaagccctctgatgcttttactatcaaaaagggatatgaataaaattcttaaaattttttaattggttttaaatatgcgaaaactttaggcttagcttttttagtgaaaattcaatcactcatagtttttcgcgttctgatcagaaatgcaccaaattttgcaggataacagctgagaagaagaggtaattaggtttggatttccttcccattttgtggaatttgaaattttttcggtattcctattttgcgtatctttcgaatttttgaaaaaataaattcattaatatttttcagagagtgctctgaaacacaccaaactttatttacaggttaattaaggcaccctgatgcttttactatcaaaaagggcgatgaataaaaattctaaaaatttttaattgctttttaaacgagcgaaaaactttaggcttagcttttttagtgaaaattcaaacaatcatagtttttcgcgttctgttcagaaatgcaccaaattttgcaaggtaacagctgagaagaagaggtaattaggtttaaatttcctttccattttgtggaatttgaaattttttcggtattcttattttgcgtacatttcaaattttgaaaaaaataaattcattaatattttttcagagagtgatctgaaacgcaccaaattttattttcaagttaacaagccctctgatgcttttactatcaaaaagggcgatgaataaaaattctaaaaatttttacttgctttttaaacgagcgaaaaactttaggcttagcttttttagtgaaaattcaacaaatctaagtttttcgggttctggttcaaaaaggccccaaattttgcaaggt

SEQ ID NO: 28572 - DNA, 997 bp, Heterodera glycines
tgacaactcatccctaaatggaatttgttaattaccatttaagagcaattataattttgcgcccgttggttacgccttggaatgggccgtgttggccgaccattgcattgaataggtcagttatgtgcccaactccccactcacttctgaactaaaattgctgaaattttggtccctttaaagccgtcccggcgagtgaagaagtgtctggccatttgagcaattgtttcggtgggatatgcaacactttgttgagagtttgtccatgtcaaaatgtcggaactaagggcggacactaaaaattggacataaatgaaataagaaagttaaaatttgagtgagattcgttactcggagagtcgacgcgtgtcccatttgcaccttttcggtgcttttgagcctttttcttcccattttggcactttccgatggcatttcgctttgctccgtcctcctcattttgcccttctccatcggtcactctcctcttgtctattgtttcactggctatttcttctcggtgttttttgcaaatgttcgtctcacaaatttctttggacggagtcgtcggagtgctctttgacccatgggaagtcgatggcattctgttagttgccattttgttaaaaataccctcccgcgatcgattgttacaattccattttcccataacccccccccctgatcttccgtctttctgtgcccctccgttggtcctgcctttccctgccaaatccgacctgtccgtcgacgttgtcgtttcccttgcccccttttccgtttgttgctgcgttttactgtcaatcgcttctcctccatggtccgccatttgttgcttatcgcaaattgcttctcccctttcctttccgatttcctccattggtcggtcggacgattgggcgaccattggcgggggaaaatctgaaggacagaaaaagtcgttgtcgagttttggaaaaggggtcttgccttttggtcccgttgcctttctctgtcc

SEQ ID NO: 28573 - DNA, 1663 bp, Heterodera glycines
acgagttcagtcggagagtgagttttttttaatgtgtgcgttaaattatgacactaatacaatttgtgccccctttttgaattcggatagaatgctaataccctcgtgagattttccgggttcactgcgggcgttgtcttttacatgtttcggatccaaattagttcaggggttcgtattggttagaaatggtcaacgaatgtcaaacatttatggataattgactgaaaacccacaaatatttcggcgctatcaaagttaccgattttgaatactttgatcaatttctaaacccgaacttgtaaaaagtcgaattcaaatatttttattttgttaaaaattaggttggaaatctggctttgctaaaatatatgtgaaattcgtgatcgtggaccacaaaaaatgccgggaacaaattttattgctagacaaagaaaagggtcccccctttgattttaagaaaattcaaaatcggtaactttgacaatgcgataatatttcgatgtcttatcaaaccgtcaacatttgttcaaccaacttacataattcgctttcccttttttcagtcgcacttggtcaccaggaaattgagagcaaacgaaaagagttggaacaattgaagcagaaatttaatgccgaaattgaagtgccggagattgggccggaagtgaagcgcgagatttggtgggtttgatttgtttgcattgattgccaaaaaaaataatgcaaaattttgtgggcatttagcgacgactgcaacaaagcattgaaatgtcagcgcaaacgattggtggacttgaagatgctcaaccacaacatgaagttcaaattggagagtgcgcacaaaaactgaggcgacgggacgaattcgatagcgcataatattgtccattatttaatgatgtaataatcgccaaaacgtataatatgtccattgttcattatgttttaatattgctataaattatgtaatttaatgaaatacttgccactaattgtaagtccccaagtgaattgaagaatatgagtattgtgcaaaaccgatagttgttgtttaactcgaaagaagtcgttcattttttgctgaccatttttttgaaagtgaggcctcggggcttatctaattcgtagaacacagccagtttacacgtataatcaatttttatgcggtaattagtgcaaaacaaattcaggaaaatacgtcattggacggcatcaaaaaaagagaaatggaataaacgcagagtcaaaattagcatatttctcttttcctcctccgtcctccctcttttgcgcgtcgtctttctatgccttggaagcgcagtgagtgatcagatcgaccagacggcaggagtagccgaactcgttgtcgtaccaactgaccagcttgacaaagtgcgggttcaacgaaatgcaactgaaccaaagggggcgggaggcaaatgtaatggaattataattaacggtaaaacttacgcgccaacgtcaaaaatggacgagtgcgagtcaccgagaaagtcctgaaaatgttatttattgtatgaagcaaggcaagggaaaagaacaaaaacgtggtattatcaaaaaatgaaatgtcggattgaaaacggaacacaaaacccattgtaaaatgagtccgttgagagtattgacgtaccgcacc

SEQ ID NO: 28574 - DNA, 1043 bp, Heterodera glycines
ccgattgaaataaatggaaaaaaaagcaaagtcaaagacaaaacctttaaagcactagccgattgaaataaatggacaaaaaagcaaagtcaaagacaaaaccttaaaagcactagccgattgaaataaatggaaaaaaagcaaagtcaaagacaaaaccttaaagcactagccgaagcaaagtcaaagacaaaaccttaaagcactagccgattgaaataaatggaaaaaaaagcaaagtcaaagacaaaaccttaaagcactagccgaagcaaagtcaaagacaaaaccttaaagcactagccgattgaaataaatggaaaaaaaagcaaagtcaaaacacaaaaccttaaagcactagccgattgaaataaatggacaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgactgtttatttaaaattaaattaatataatttcatgaaata

SEQ ID NO: 28575 - DNA, 949 bp, Heterodera glycines
  misc_feature (792)..(792): n is a, c, g, or t
  misc_feature (930)..(930): n is a, c, g, or t
cttgtcatttaaaacccatactcgtataggatataggctttttctgaaggcttttcctaataggaacctcagaggttgtacaaagcacagtacgcaaatattttatattattgcagactcggtaattaataacttaattattatttattttgcttaagtcaaagagatgtttttatttgtatgaatatcggttacttatactagggattataatcaagttcacaatatttcatggaaatgtgtctgtaatttctggataaattcaacatacagaaaagtttctttcaaaaatattcgctgaaaatctagccaaagctgaaattattagggattttctacataacataggacttttgtgtcagcattttaatttaacatatatttatcttgtcattcaaaacccatactcgtataggatataggcttaatctgaaggcttttccttaaaatgtgtctgtaatttctggaaaattcaataaacagaaaagtttctttcaaaaatattcgctgaaaatctagccaaagctgaaactattagggattttctacataacaagggattataatcaagttcacaatatttcatggaaatgtgtctgtaatttctggataaattcaataaacagaaaagtttctttcaaaaatattcgctgaaaatctagccaaagctgaaattattagggattttatacaaaacataggtcttttgtgtcagcattttaatttaacatatatttatcttgtcatttaaaagccatactcgtataggatataggcttaatctgaaggctnttcctaataggaacctcagaggttgtacaaagcacagtacccaaatattttatattattgcagactcggtaattaataacttaaatattatttattttgcttatgcaaagcgatgtttttatttgtatgaatatcggntacttacactagggattat

SEQ ID NO: 28576 - DNA, 1004 bp, Heterodera glycines
agaaaaaacacccttattgaatatttattataaaatgaagaaggcaaatccgtctttgagcgacaagaaaattgctggatttttgaaaatctctttagccaacctaagcaaatggaaaaatcaaaaattatcgtaaattttcttaatttctttttactctcaatgacctaatattgttttttaattcattttgttcatttttccaattcaaattttggttgtaaattattatcaactgataaagtttcgaagaatgaattggctattaaaaatattaccaaataggaattataaatttgcattttctgaaaaataaaataataataataaattgtttttgcttttttattaatgtaatggtgacattaaaaaaaaataaattctgtaatttatgaaaaatgatcaaattacgtggaaaatatttattaattgattatattatttaatactgttgaaattgggtaatatagaaaaaatggtttttttttacaatataataaatagggaaaaggaaataataaaaaattttcaattaccattgaaaataattccttatttttataacttttgggagattttataatttattaatgattaaacttaggatagagcggtaccagtactggcactgaaaaacggtacaactgagtactgagtaccggttttgaccagtaccgatactagtaccggtttttaccggttttcccagccaaaaagtaccggtttttcaacccgaaaattaccggtaccgggtttttttacaattaccgattaccgctctaccctgaattccttcttttttctaataattcaatttttaatttatttttcgccttagtccaaattctttttttcatgcgtaaatttttattcggttgatttcatttttttttcttttaattttttttaatattattattaaaatttggcatttttaaaaataggtggcggtgtttaatggccaaaagcaggctccaggggcggcgcgaattacttacataaat

SEQ ID NO: 28577 - DNA, 884 bp, Heterodera glycines
ttgcttaattaattatttctgtttgatgaaggcactcgccgctcgtgccgtggacaaaatcaaccgacagacgaacaatgccttcctgtttatccctgtgaaagtgctcagtgccaaagcaatacccgtagctggagtaagatatgaactgcgcattttggtcggaaagtcaaaatgcttgaaaaaggtaagtgcaaaatggggagaaattggcacaaaaatgggcaagtcggcactgtaatttttaagaaggcgtataattttaagagggggatataatttttgggggaaatcgggatcaccaaagtcggataagccgagctcagcagtagaccctggactgacagtttaaatcggatttgtatcgggattacttttttttctcaaaagtcggattggaattattgggagggataaatgtgaaatttaaaaaaaaagaataaaatttaaaactccaatgaaaagcaaagtaaaaagtgaaacaaagcatgtatacaattttaatttaaaaaagtgatgtttttaaagcagccaaaggcaaagcgcgcaaactgtgcaacggaaactgttccggcagagcgaaaggcatcgatttcttatttaattatctgctaattagcctaattatctattctttaggtctttgaagtgagtgtgttccaacaaagttggaaaaatgttgaggacattacattcgtacccgaagaacacatgggcaattcgacaaaaaattgtgaataaaatgataagcaataatcgtgggtgaatacaaatttttaatttggtgcaatttttaattaataaatttgtgtaattggcttaaatccgcaaagataatttttatttgaaataactgttgtcttcgtttattgttttcttgattt

SEQ ID NO: 28578 - DNA, 285 bp, Heterodera glycines
taataacgctgcggacatctacatttttgaattgacaataaatggtaattactctttctttttctccatattgaccatcatactcatactccccccacccttttcttcttccgccacccacctcccccgctacgcgccgctcccctccccttcgtgctcctctcttgatagtttaaactgagggcgggaaacgacaatctgatccccatcaagctagcttctgcaggtcctgctcgagcggccgcccggggaccgatccccgatctagtaacatagatgacaccg

SEQ ID NO: 28579 - DNA, 1053 bp, Heterodera glycines
cgtcaattgatccgtcgtgagggcattctctgcgccgtttcttcgggtgccaacgtttgggcggcactgaaagtcgccaaacaattgggggccaaacaaacgaattgtgaccattttgccggatagcattcgcaattacatgtgagaaattggagcgaaaaatttaaaaaataaaaagcaattaaaaaaacattaggagcaaattcttcgacgacgaatggatgaaggcaaaaggattttccacgggagaagaagaaggagtgagtgaagcagctgaagaatgaaaacggagcaaagaaagcgaagggggaaattaagcaaaggcaaataattaattagcccaacaaattaattaacttaattaccccttccctcatttttgtttgaattaattactctttttgttccatcgttttgcttaattaccaaactcatcaatggcaaaatgggcttttgtatcttatttatttacttcaaatatctttcattttgtaataatatttacctttgaacaaaaagcgacaaaaacagaaaaaattaaattaaaataaatttcacttttagaaatgacagatttttctgtggatggattggcatttttagttcttgtcattcagccgggcattacgcgttaattatgaggagaggagagagggggggggggaagaattgatggatgaaaatgatatgacggacgaaggccggtggaagtgaaatcgcagcaaatgacgcaatgtccggacaaaatgaagacaagagagacagagaaagagagagagagaggaaagagagacagagaaagagagagagagagaggaaagagagagagaggaaagagtgagaggaaagagagacagaggaaagagagagagaggaaagagagagagagtagaaggaagaaaaaaaaggaggaaaagatggaagagagaagggaagggaaagtgagctgcacagcaacagttgggttaaataatgtttcagccaaatgcttctttgatgtgttcgaacggacggacggcgaggtcaacggggagatctttggggggggggggg

SEQ ID NO: 28580 - DNA, 1606 bp, Heterodera glycines
  misc_feature (1581)..(1581): n is a, c, g, or t
tttaaatgattctttaatttcgtccaccagcaaaaaaacattggaattgcctaaattcgtaaaatcaaaaaaatgaaaacaaggagttttaatatgttattttatctggttgtcacaacgccagagcatcatcaagattgtgttgagctttataaaaagaaaataagcaaaattgaattcttagtcaatataaagtatttaaattatgaatttatacgaaatatattttgtgactaaaatcttttgtttattaaataaagaatatgaaaaatatagaaaaaataatcatttttcactttaaaataaaagaattgtgattgccctttgagcgcgcttcttttaccaaatgatcctctgagatttcaaaaaaaatgaaaaattatttattcatgatagcaatgaaaaaggcattaatgaattaaaattttgattagcgcaaataaatttttatcggagttcgatcctaagaaagcattgaaaaattcgacaaaaaacgattaaataaataagtattttaatgctttcgtaaaaaataaaataaaaaatacagtgaaattcataaaaaatatttattaaataaattcaatttaaatttattgattgtaggcatcatttttgaaatcagatttcatagcacgcggtaaagacagcagctctccgcatgaagttattattgcataaaaaataaaatttttgaagaaccaaggaagtaaaatatataaaaaaagccaaaatatattaaaatattttataaattaatcatgatatctttttttgagaaaaaattttaatcttcataaaaatttataaattcttatatctataaaaagattaaatatgcattacgcaatataaaaaacatgtccgaaaaactagtaaactttaaaaatgaattggtattagaagattatcgtgataaaatacaaaattatatattaaacttttttaaatatatttatttgaacatgttttaaatataagcaaaaaggggatctgaaaagtggaaaacagatttgattcatcgagaataaaaaaagtctgttattttgcaaaaagaaaagaaaagaaaaaaatacattaaatttcataaaaaacaaccaaagttttattaacttttttattgaacttcataataataaaaataaagcaaatcatgaaatgaacataatgttgatcttctcaaggttatttattagtcgttattcaatatttaagaaagtaatttaaaaagccgaccaataaattttcacaattatctgcaaataaaaataccattgtcatattaatttctgaatttcaaaatatatttttatagacatgacatatgacatgtaaaagaaaaataaataaatgaaaaattacaaaaaaaaaaataatttgtaaaaaaagataatttaaaactaatgcgttttttaaataagaattaaaaataagattaatttaggttttcttgagcagaaaaaagcaaaaaattaaatcttcaaaattaaatctcatacaaaggaaaaatgaggattataaattgtaaaaacaacatatcaattaaattaattaatatctgggtggagcctaaaaagatgnaacagcaataagtcttttaatttag

SEQ ID NO: 28581 - DNA, 833 bp, Heterodera glycines
cggtcatttcgtttcgaggcaaattcgcaacatatgaaccgccgctttactttctttaacgtccagctaacttcttccttacaatatcccgtcgataccctgccttaaaaattaatgaactcggcaaaatccaaaagatttcttaaagcccacgctgaaaaatattaaaaaaaaagaattcattcagtggttcgttattgctaattgaaaataatttcttatgaccataaggagaaaacaaaagggtgttcgagatttaattttgagctttaattatgggggtgccacaaaatgtcggcggtgccgcaaatgtcattttgacttagtgccgcaagtgtcgacaccgcaaatgtcgttctgactaggcgccgcaaatgtaacgccgcaaatgtcggccaatcattttgtgtcattagaaaatgcctatgccacacacctgtgtactcccaaattaccactaccattcatcaaaattatctatataaaatattaaagattgttcatttttatttcttgtgaacaatatttttcaaaatctgtctttttgaaataaacttttttttatctgctaaaatgtcattgaaaattgttatgattgctaaattttgacacatttacttttttagaatttttccatttcaaattgtacaaattgactcgaaaggaaaacattggtggaaagggccaataaatcaaaatcaaattccatcaaaaaagcataatcatgaaaaagagcaacaacaacaaaatcaaaaacaacattacatcggtagaagcttttagtttaattttttttttactatttatcaattattttttgctttttaaactga

SEQ ID NO: 28582 - DNA, 990 bp, Heterodera glycines
atgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccccataaacttttcataccccatttttcgcaccgtgaatgttatttttattgaattgtgaaccgttttgagtagattagactagacaaaattgaaaaattttgaaatcatgttttcccacttcccttctccccgggg

SEQ ID NO: 28583 - DNA, 1205 bp, Heterodera glycines
ctgtagtgtaaaatttcggccgtataaatattggttgaatttttctacgccgaaaattactgcacgtccctccttatcaatttgcgcatacttccgctcggatgagcttaacgttttttaagcataagcgatgactccaacttttccagtcttggcatccttatgaaataaaacttctccaattccataatccgacgcgtctgttgccaagaagtgaggcttttcagggtcgaaatgcacgaggatgtcgtttgaagccaacatttccttgatttctccgaaggctttttgttgctccttcccccagtgccatttcttttctgtccggcgaagttcattcaatgtttccgaaaccgtcgccaatgaagggatgaacttgccgtaatagccaaccatgccgagaaacgattgaagttctttcaaattttccggcgccggcattttttgaatcgcttccaccttctctggcgaagtccgaattccttgccggtcgataatgtgtcccaaataaacaatgctttcatgcatgaacgagcatttttccttttttactcgtagtcctgcctttttaagtctttggagaacggcatccaatctcttcaaatgttcagcatcgtttgcagcagtgacgacaatgtcgtccaaatacactgccactccgtcaattccacagagaatttcttccatcacctgctggaatatcgctggtgccgatgccaccccgtagggcatgcgtgaaaatcggtacagccctttatgggtgcagattgtgaggcattccttcgcctgatcgtccaacggaagctgtaaataggcctctttcaagtccaactttgagaatttgttgccattgttgagagcactgaacagttcttccggtcgagggagcgggtactgatggatgtccaggcacggattgactgtgaccttatagtcgcagcacaaacgaattttgttgccaggctttggcacaatgacaagcggagttgcccattcagatgtcgccacaggctcgaggactccttccttttcccattggtttataaccttctccacctcggaacgcaacgcgaatggcacgggacgaggcttgcatcttttcggctgtacatccgtttttattttaacgcgatgtgccttgtgcagcggccaagtccttcactaaagacttcggcgtaattttggagcacttcgtccaatttact

SEQ ID NO: 28584 - DNA, 705 bp, Heterodera glycines
agcgtttctcttcccctcccccgctcaacatttatgtcatccatcgattgacccccatcccacccccggggcatttctccgccttctcatcatccctccctccgtccgtccatcgtccgttttgcggatgaatgggacggggtggtggtggtggtgaggggggggggggggagcaaatgtgattcaatttgtggtgttggtggttgggtgatgatgaatcccagaatcccccacaaattatgcggaatgcctattcctccccctccccttcccccccccccccccgaggggtgagtaatcagcgccggcggcgcccctcgctcattacatatgcagtgaagtcgttgtgtgatcttggagccccaaaatttcgccaaaaatttaattggattagtcggcgcaaagttgcgctcgccgctttcgaataaatttggtgggagacaaatttggggggagggggcggaacggaacagagaatgaaccaacattaaggcattagtgaaactcacacaattagttgtgatcactttcattcattggtcacattatcttggttcttagttcagcgtccgcctgattctctttcatttgaaaagttttaaaatttttcgccgattttagaaaacccgaaaatttcaacagcagaaccctccctctttcactaatacccaaataaaatttttatataaagtactgtatttgtaa

SEQ ID NO: 28585 - DNA, 735 bp, Heterodera glycines
tgatgcgttcgaatccgatgactttacgaggcaattgcattttcggaattggcaatgcttttacatgataattggcaatttccatttcctttgtgccattctccccaattttgcttccaattcgaataattcctaatgcccatttgcgcgttttgaagtgttcatccacgtaaaagtcaaaacggtggctgatcagcgcaattccgaggccaagttgggaaggcgcaagcaaatcgaacaccgccagccaaccatcgccggagatgaaactgaaaaaaggaaaacaaaattgaaattggaaattaaaattgggttttaattttacattgcttttgccattttttcctctgcctcttttcggtcgtctgacattttgttgtgccaaattattaaggcaattttcggcacttttgaagttcagtgggccttttttgttcaaaaatatatatgaaaaaggaaaaaaaagagttaattaaaacaaaatcacaagaaaacaaattgaatatttttttatagttgaaaagaatgcattgtttttgttcgtttttcttttttgtatttgcgaacaaaagctgggactagggcttatatttacagttgctaaataggtcaaaatcagtattgaactaaataatttcaaaaatattttagatttaggtgctaaaataaaaaactagaaaatagttgctatgaactcgaaaactagcttaacaacaactgaaaaaacatgttttt

SEQ ID NO: 28586 - DNA, 844 bp, Heterodera glycines
aagacaaaaattcgatttttagggggtgtatttttctttttcagccgatttttaggggtgtatttttgcttttttgaaatcccgaattagggggtatattttgcaaaaattttcgccgttttcgccaaaaaattactattttttgccattttggactcaatttttcaaaaatatggtaaaatgggggtccggcggtgccgataggcgccgccgggaaaatttttgagtattttaatgcaattttgttaaaaagattgcttaaaatttcaaaaaatttaccgaaaattttacttttttgagtttcgggggggggggggctttagccacctcagccctctccctacctacgcccttgctttgaccctttcctcaccaatgccctcaattacattgacttcgtcaccgtcccatgcactaaccccgttatacaaaaggcgttaataaatatacattttggtgaaaaatgaatttttgttagagtacgggaccgggttagaaatgggtcaaaacagatgtcggattcgtgatcactgatcagttacccctgaaaacctattaggtaatttgattttttttaaagtaagaaaaaatatggagcctaaatggaaccagagccctttttgcgttatttatttctttggcaccccatgtacctatatgctacatgcatatctgaatattttttaggttaaatggctctaaggttaaatttgttttacgatattttgtgtcctcgttcttgggttttctaccaggtaaattaaatctttcaaaaatttccttttaaacattttctttagacactgcaaaagaaattgccttactggagaacttttcgcgaaat

SEQ ID NO: 28587 - DNA, 1039 bp, Heterodera glycines
ctgctagacgaaatatcagaaagaatgatttcgttttcttgtgttatgtgtggggtgactataaacaagcattcagtggacaaaatggcacgacgctgagggaaatggaagaagcggggggggggggggggaggcagccccggaggggcttgaactgactgatgaaagctttccgaggaaagccgagaacggacggagagtggggaagagaaaagaggggaagacgagaatgagaggagagagattggcccactcggagcacccgccccctccccccaaccattggccgatgtttggttcagtggcgatgaaatactcgcgaatggcacggcattgctaatgccaccaaattcattggaagatcggccaagggaatacttttgccatcaaagcaaaatgaatgaaacgaagtgatacataaaacaacacaaatttgttgcattctcagagatcacttttttcccattcgtctacccattcgtttgtatttattttgccaatttggcaatggcaaaagtgattttgccaggagatggctttgtgtgccgaggaaaagtgcctagggcaatccattggggcaacaacggacgacgaactggcacaaaattgctctcccgtccgtcctatcccccacatcgcccattcattcagcctaccgtcccccgccctctttcgtcagcgtttccgacggcagagacggctctcaacgtcggctctcggcctcccaattcccatcaacggcgacggcactgaactaaacattgccaacggcgcatagcctcggggaacaatccatccaaaaattcgatattccctttcccggtgcccattcttcctcctttccatccattcactcctttgctcccttccccgcctttattctcagcggctcaagcccggggaagcgaagaactgacggagagaggacggagggacggggggaggacggatagatggatgggaaggaagccgcagaagaactggcattgacactcatgaagcagccatgccatcccatcactcacccaccagccattca

SEQ ID NO: 28588 - DNA, 888 bp, Heterodera glycines
gggtccgaaggccccccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccaaaaagtttaggcttaactttttcagcgggtttaaaaaatctagaaaaattagtaagcatttgtagtgctccgatacgtatctctgcaaaatttggtgagccgctgatcaattacaaattatttatggacgatcaaattttttgaaatttttttaagtgcaaaagtggtgggtgtctgcaaaaaattttcaccgggtttaaaaaatctaggaaaataagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcatttgtagtgttccgatacgtatctctgcaaaatttagtcagcccctgatcaattacaaattatttatggacgatcaaattttttgaaatttttttaagtgcaaaagtggtgggtgtctgcaaaaaattttcaccgggtttaataaatctaggaaaattagtaagcatttgtagtgctccgatacgtatctctgcaaaatttggtgagccgctgatcaattacaaattatttatggacgatcaaattttt

SEQ ID NO: 28589 - DNA, 100 bp, Heterodera glycines
tgccttaaaaactaccgtatatactccagtactgtaatagtagaaatcattgtatacattcattgatgcaaccactgggccgtttgttttgatttcattt

SEQ ID NO: 28590 - DNA, 1616 bp, Heterodera glycines
  misc_feature (1028)..(1028): n is a, c, g, or t
  misc_feature (1079)..(1079): n is a, c, g, or t
  misc_feature (1603)..(1603): n is a, c, g, or t
aaaaaaaaaaaaaattttttttttttttttttttttttttttccccccccccccccccccttttcttttgttttttaaaaaaaaaaaaaaaaaaaaagcgggcgggggggggggggggggtttttcctctaaaaaaaaaaaaggtttggtccttctcacaagaaagaggaagggagggggggggccccccccccccccgcagaccataaaaacaaaacggtagtggtgaaaacaaaaaaaaaaaaaacaaaaacaccccacctccccccccccccccccctcttttttttggtgggggggggggggggggggggagagaaaaaaaaaaaaacaccccccctcctcttttttttttttttttttaaaaaataaaaaaaaaaaaaaaaaaattatatttttttttttttttttttttttttttttttttttttaaaaaaaaaaaaaaaaaaaaaaaaaaaaaaaaaaaaaaaaagaggggggggggcggcgggtggggtgtttttttttatttttatttttttttttttttttttttttttttttaaaaaaaaaaaaaaaaaattttttttttttttttttttttttaataaaaaaaaaaaaaaaaaaaattttttttttttttccaaaaaaaaaaaaaaaaaaagggccgctttttttttttttttttttttttagaagaggaaaacaccccaacaacccccccccccttgtttaacgccgggggggggggcccctatatattataaaaaaaaaaaaaaaaaaaaaatttttttttttttttttttttttaaaaaaaaaaaaaaaaacaaattttttttttttttttttttcccccccccctttttcccaaaaaaaaaaaaaaatttttatttttcccttttttttttttaaaaaaaaaaaaaattttttttttatttttttttttgggcccctttatttctttttttaaaaggaaaattttatttttttcccatttttttacacaaaattaatttgggttaattattttggtgcattaatgcctgatntgtgatagttttgtgggtatccattttagctaatattgattactaaaattnttataaaaacattaatttaattatcacctaatttgattttgtattagaaaagtttctataaaaaatatcaatttaatttagcgaccaatttaattttaaaaataaaataaaatttgtataaaaccccattaatttaattaaatgctattctggatccagtctctcataatcctgtaagccggtcaatccctatttttcaaattgccggatccggattggtaaaaatttcaatgttaatttaggggaaaaaccccgcaaaatgtcatcaactactatatatgagaaaattcggtgcaccagaaaatatcgccatagaaaagacaatgcgccgaaaaaataaaatttcaagaaaaaatttaaaaaaaaaaaatttatttcagttttttatttttgaaaacctatgtttaatgaaaaagagccagtttttaaagaaaaattgggatttttggagtccgacggtgccgataggcgccaccggaaaatttttttggattttttaatgaatttgttaagaaaatttccanaaatttgcgaccc

SEQ ID NO: 28591 - DNA, 1562 bp, Heterodera glycines
aaattcaaaacaaaaacgctttttaccccgttcctgcaaaatccgtacgggaaaaaaagacggaaacccggagttggattcccgtgtttatttcatatggtaatcctgttccagccgggcactaaaagcatgccctctgtttggttgaagtgcgaaatttgaaagtgcggaagtgcctatcgaaaaaaactgtcaaatatttgtgcgctgtttaaataaattggaagtttcggtctaaaggaacttggaaaaatgaccatgactatagtaatttaatgaataaattctatcacattttaattataacatttaacaaagtgcatttatttgttagcatttagctactaattctaattttcgtttctttcaagcggttaaatctattcacttccgccgttccctttgtggcactaattcccaataattttatcgcttaattatttatataaataaaaaatatttattttctttatttatattattatacacgacatcatttttattaattatttgtctgttttttgttgataaatcgtgtgactttgatagataatcaattattttttgagctgtcaccagcaatttttgctgacagcgcacaattccattctttgtcggtcggtcggtcgtatgttttccctatctttcgaatgatgtcattgcattttggagggccaataaaagcagttcccttctcctcctttcggccattgtatcacaaagcaaaatatatttccatctgtcattgcattataatatctcagtgaaatcgcccattttaagcttcattaaaaactaaatgctccttaattcgttagaaaagctcaattaagtgaaattattttaattttcattttattagcatttcatataaaattcatttgattttttaaacatttttaattcccatcgttccttaaaatggcctgtgaatgttgtgagttgaatgaatgtgttgttgcgtcgtaataaattgtaaattccttaagcctgctgcaaaaacaaccaatgttgtaccactaactgctgcggaggttctgctgacaaataaacaaatatttccatgccttttaatgcttttttcagattcttgttcatcatgccaatgccccaactgcgagtgccaaaagcaaaagggacagtgccaaccccaggggaagggatgctgtgcttagagaagcgaacggaaaggacggagagaggggagagggtgaagcaaagagagagagagggagagagagaaaaaagggaccacagtgatcggaatgaccaatttgtgtgccaatgataagagcaaatgacaaacataattactaattgtaagcaaaaagacttgtatttttaggggttcgcttccgtatttcctatggaagagtttcttgccgcattctcatttcttagtggcgccaataattgcccactttttcaacattcgatgaagtgtatttttctattaaattccttttttttggcaattttttgtgactcaaatcaaaatatttatggctgaaaaaataaaagaattttgtgagaaatgatcaatcattttcttggctttgggt

SEQ ID NO: 28592 - DNA, 1051 bp, Heterodera glycines
tgtaaaaaaactagtcagaaatagatctcatcaaaaagaaaggaattttagatatgtaaaaagaatcgatttctcatttttgataaaaaaatatgaaataaatttatttaattaattgttgattggttaaattttaagatggaattaattttggttttttgttttctaaaattaaagaaaaacgctttcattttactataattttttcacttggaaaaatgatttaattaaattttttgttttttttcgtttggaaaaaatctccgttttgtgccgggcccattttaaataaaaatttcggcctaaccctttttccttaaaaataacaatcaaatttttaattttttgtaaaaaaaaatctcgtctcgtctcgtgttctcgtgtttttaggggcgtctcctctcgtgtttcgtatatcgtattttatttttgtctcgtttttctcgtatctcgtattttatttttatttttgcaacatccctgctataaaaggatactcattccgctgggattcgaacgcacggcccttccaaaacagggtttggggtgtctatcttggcctttttatcactaaattaattcagaaaagaattcccaaagtcatttatcaaaaaaatagtgataatccaaatacaatgacatcatgaaagtttgtattgtaagaataaaaaacaatttaaaaataaatgaaagaaaatggaaaagaatagaaaaggccaaaaagaaagaaagatggaaaaaagcagggcagcagggcagcagacatttcaaccccaattcagcaagttcatcatcaaaagcccaataatgggggggggggggatttaaaaagccgacaaaattaagaagcgaaattaaagcacttttctagtttaggtggcccgatgttgctagttaaataaattccaaaaattttaatgcataagaatttggtatatgctcataatattttgaaatttgcagaaatacagtcaagaaggcagattttaaaacaaaattatctgtatgaaagtaatcctagtaccaaagtattttcctgtaaaaattaatt

SEQ ID NO: 28593 - DNA, 358 bp, Heterodera glycines
ccccccccccccccaaaaaaaaaaaaaaatttttttttttttttttttttttttttttttaaaaaaaaacccccccccccccccccccccccccccccccacaaaaaaaaaaaaaaaaaattttttttttttttttttttttttttttttttctctctcctccccgcccggggggggggggggggggcggggtgcggggcccccccccccccccccccccccccccccccccccccctcccccaaaaataaaaaaaaaaaaacgaaaagaggggcggggccgagggagtggggtttttttttttttttttttttttttttttttttttttttcttctccccccccccccccccccccc

SEQ ID NO: 28594 - DNA, 790 bp, Heterodera glycines
aataattacaaaaaagctattagtaacaattgtatgataatattctatatctattcaaaaatttaaactaatttcaacaaatttacataattttaaaaaatatataaatttttagcacatttaaaaataagtaaaagcctaacccataaacttttgaattttatttacctagttcggtcttccatttataaatttgatgccgactaatgctcaaatccttcgaaatttcccgttcaatttttgctctttcactcttttcacttttgttgccgtaaattttttccttttttatttgatcaaattttttgatcagttccaattttgttgactcatcttccattcttggtttccttatttgttgaaattttctctttattttaaaaatattgctccgatttgtgcccaattttttagcaatttcgcattcaaatttaatgtttgtcatttctttataaattccttctcttcgtaaggtatttttcatcaaattaaatttatttaatatttccaattcatcatcactttccccaatgctttttgcattctgtaaatttccaccattttaaattgatatggactatttctttaataataaatcaatttttaccgtatcatttgtttcggaactcgaataatttccctgtttaattgcttcattatttagttgtggtatcgttattttttgctcatttttttctacaaatgattctgatttgatttttggcaatatttcaggttttatgtcttctgttgcctgataattggcatattctgtcttaatgagtgcact

SEQ ID NO: 28595 - DNA, 719 bp, Heterodera glycines
  misc_feature (11)..(11): n is a, c, g, or t
aaatttcgacncaaaaaggggatacaaactgaattagtacccagctttgcttatatattgtagatacaaacgaacacatatttctttcacaatgtcccaccccctttggcggcgtgtctcgagaattggttacgtttccgttttggcgggtgccaccgccggtggtgcttatgtcggcacagtaatctttaaattatgtgttgcatggtttttcacaaattagttttgtttcacagcaatattaccgccacgggtctctgcccgagttgccccaatgggcgcaacaatttgccgatcggatgccacagaatggtaagaatcaaatgcaaatcattgcattttttgtgccaattcggtgcccgattcaactttttgtagccaattttgtgaggaatgtatgccatttttaagaccagcgaccataaaatctcaaaaaacgcaaaattttacgagttgcacaaattttgttggtaaaagggctgttgttatggaagacaaaaagctgtaaaaagaggggggagcaatggcattggcacagagcttggcaccttttgcaaattaatttttcgcccctatttagttgtttcacttcgtccgcaaaatgaaagtgtggccaaacaaagtgacactgagcggcaaaaggcggaggtaattaatgcaattagaatttgctgtaaaacaattaatttcacacttaatttaggctgtgaacgcccaaa

SEQ ID NO: 28596 - DNA, 1016 bp, Heterodera glycines
tggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtaatagattttgggcaaattattaaatttgctgcgtttggttggcaatggaaatgttttattggcatctctttttgggccatctcagggactcatccgttgcttttttgccattttgagcctatttcatcaaaattccaaaaaaaaaattcctcgcctcggctttttccaccgttttattgtcgtgtttttttcacagattgccggcgtcgactttgtgtacttcaaacagcgcaaccatctgaacatgcgccagcgcacactgctcatcgaagcgtcgaacatctccttttccagccgaattgtggtggtggaaaattgcaaatattacgtgagacaattttccaaaaaaaaaaaaggattttttttgtacactttttttagcaaatgttgataacccatctaaaaataccaaattttttcctaaaacatacttttctgaaaattggccgtttttgaaaattttttcacttttttttggtatttttttttgtttacaaagtcatgaaaccaagtacccgtgggttttagaggtcgctgatcatgaatatgacaattatttgggcctattaagaaatttggcgctagctataaagtgacagatttttaattttatcaaaaacaaaaggggggacccttttgttttgcaaaatttttttgagataaaaaatcgtgaatatactttttattcaccataattgtgatggtaaatacttaatatacatcattatgtgtaaataaacagcaacaaaaaaatttaccaaaaaaggtgaaaaaatttttcaaaa

SEQ ID NO: 28597 - DNA, 971 bp, Heterodera glycines
aaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcgggggggactgcccccgaaaacaaaaaaatacgattttttcaaggggctggtttgggggtactcaaacaatttatggggaggaaaaa

SEQ ID NO: 28598 - DNA, 1331 bp, Heterodera glycines
tttttctatgacctggggcaacgagtttaaggaccagggttaggtgaccaaggtaaactccaccatttcttactccgtcatcgctaaagtcctggtcactcattccacaatcggttgagtttgattctcagctgggattgattaaccacaaaatcgaacaaattaatgcgttaattttaatcggtaaaatgtaaaacctaaacaatcaaaaagcgcagtcaaaacactaataaatttatttggacataacacacaatttgacagtaccaaaacatttcgatttatattctgtcgactcggtggtctttcctacaaataacagtccgaatggccaattcgacattcattcttcgtcagtgaattctttgatccgtcccagacgacggtactctttcttggcccagtcggtgaccaaaaagtaagtgactacggggaagaagaacatccaccagtggggcaactgctctttgaccggctgaaaagcacaataaattttgtgggttatggcacatttttcttaccttaacaaacgcatcaaagaaaaagcccttccatactttctgttcaaccggagcaatgcgaacgtaataccaaccgtaagcctaaaacaatagaaaattgcatcccgtggattaatttttaatagtctaaatgacagtgaactttttggacttaatcaaaatgttgaatgcatttcgagtctacatgaaatgagcttgaattgctttgataatacagtcatggttatgacttataagaattctccatgcaaatagacatagaccaaataataaaacagaccttcgacaaattgccaaaatgtttctcgctggcacggagcaaggacaaacgcatttttggtggcttaggaaaaatattaaatttgtcaaattaaaacaaataatatccgatccgacaaagtcattccgttgattgagaaaaaaacgaatttttttatataggtttaatcccaaaaatcctaataagcaacagaaaatgaaataaatttatttataggaggatccttcttctgctgccccgtaacttaaaatcaatcattccattggatgaaacgctctatttcacaaatttgtcgtacttctcgagtctaaaaaatattaaaaatactttaatttattatttgctcggtgaaattgtatagagttttgcatgtacagttatttttgattttgaatttcgaaaatttgtttgaaaatcccttttaattgtaagtcaagtcaaaaagcaaagaattcgtaaaaacaaatgtattggttgttctattgctcttgcattacttggcaaaatccgcgtttctttgttgcgtgaac

SEQ ID NO: 28599 - DNA, 803 bp, Heterodera glycines
ccagggctaaaaaatccccggcgctccgcgaaaaaaaaaaaaaccgcggccgcgcaccgcgcatcgcgcattcaaattgccgcggccgcgaccgcgcctcggatcgcgcaaaaaaaaacgccgcgaatcgcggatcgcgcatcgcggatcgcggccgcgctccagccctgcagcccataaaaaaataatttttaaatcaatttataaacatttctagagggttttcggggtcgctgatcacgaatctgacatccatttcgaccaattttgaatcccggacccgaattcgaacaaaaagtcgaatcattttacggtgcgaaaataaaaaaagttcaacaaatggttatttgattcattataaaaatctatgaaaataagtcaaaaatcgaaatcgaaaaggaaatgtggagagagaagtgttttgggggggcggcggaaggtacgggtcgtcgcacggcgatgaagtgtgtagaagcgaaagatggcctagaaataggagggatgtgagaaggagataccgtttggtaccactaaccagtggtcggtcatcagaatttgattgctgacgaaacttcgagcggacccttcttcgaaatcccttgaaatctttctgaaatttacaaaactgagagccgagccgagaccggtgatgaacggcgcatgatcattgtcagaaacgtccaccaaaatgaagcgtggtgcagtcgatttgacaacgcaaagagacgggggaagaaattggagccgattgagcccgaccagcgatgaatgacacaacgagttgatgagacagagctggaaat

SEQ ID NO: 28600 - DNA, 1858 bp, Heterodera glycines
aaaaagtaagaaataatttttttaacccgtatagcccaaaaatgggaacaaaattcccaatggttccaattcaaccagataaaggcaaatcaatccagggcattgtaaaaagctatgtatgagttttaagggatttatggacatttgcattgacattcattccattttattttattttactttacatttcatattgttgtattttttgacattatttattttgatttttttttttttatgcgccacataagagcactaatgtgcctgtggtttgctcaataaatataaataatttttttatagtctcattattgttcttttaaaagatgcataatttcgcctcattcattaacacaattttgttttccgcatttctctctctcacacctcttctctctctctccctctctctctttctctcctcttaaactttctctctttcgctctctctcttctctttccttttatttttcttacatttttttctccttctctctctctcgttctcactctctccctctctctcttcttattctctcctcttatcctttctctctttcgctctctctcttctctcactctcttctcttttctctcatctcctctgtcttcgtttctccctcttttctctgtctctcctctctgtctctccttatctctctctcgtctttttctgtcttctctttctccctctctctctcccttcttttttctgctcttatcctttctctttcattttaccctttcttcctctctctctcttcgctctatttctatctctctctctccctctctctcgtttctccctctctcctttctctccctctccttatctctctcctattttctttctaacttctctctctccccttttctctctctcgcttcctttctctctctcacttattttctctctctctccccttttctctctccctctctctgttttcctctcctcttgtcttttttctctctcttctctttcatctgcaagatatttgtgaaaatttcatttcatcacatttctttttgtttccaattcaccttgctcacctctctctccctcacctcttctcctttctttgtttttctctttttacctattctctctcgctcaatcatccttgtttttctctctattctcattgcaaaataaaggtaaacaaaaaggaaatcgttttaataagtgagctattataaaaaaagggcggggcgtacgtatgtatacatccaccaaattactatagtggaccagcagcatttccatttggcccatcatcagcaattccatcggggaacagattaccggaattgatcgaattcaattgatcaagatcagtgagaaatgttggcgatatgcgacgacgcaaattgtccaaagcatcggtattgcaaaagaccaaatgacgaatgttggtcgcaaaaattggccaaatttcacggacaaaaacatcccaaattggctgatcatcctcagttttgtttggccatatagacaattccaaattggtgccacttctgtcccaaatttgcttgttggaacgaagaaatgtgagcacagaatggtcaatgtagctgaaaagggggaacaatgaagacgacgaccaaccatattaattggtttccgtataagtttaatttacccaatccgaaggttcttaaagcggattttgttgggcagcggacggtcggggaacggaaattgcacaggcttcgaatcggcatatattttcgcttttggtcctttgtccttccgaattatgacacttctccaaattgtcaattccgtcgtttttccatcaaaatgcgtgtcaaccaaaacatcgaaacgatcggaaagcaatgccattttgaggcc

SEQ ID NO: 28601 - DNA, 1072 bp, Heterodera glycines
  misc_feature (954)..(954): n is a, c, g, or t
  misc_feature (974)..(974): n is a, c, g, or t
  misc_feature (1018)..(1018): n is a, c, g, or t
  misc_feature (1051)..(1052): n is a, c, g, or t
aatttaaataattttcaaaaaccaaaatatctaggtaaaaatgaaaatatgcacaaaaaatgatttgactatttattctaaatgatcaaaatgacaacatttcctcccattagcatcatctgtctccctctcattaatgagtggcccttccatcgccctggcttctccttctccctaaccctgggcttcttcgccaatcatttggatggtttccaacgcggcggtcgcttccgattcggcctccgcccgcgtgccattgatcagtttcagcgtttccttcgccttatccatcatgttttgtgtgaaattcagttgtacaattgtctccaattcgttccgcacattttcaatgctttgcttctcgccaaatccgttaaatccgacttcaaaaaacgtttcgccaaacaatttgtccattaacaatggcacttccatcgtggccaaactccgcttcactgccctttcggcttgctccattttgcgtcggatgttggcaaatgcgtgcagtgcttggccatggctgaagcgatcatttccttccgaatttgccattttaaacagttgcgcggttggattgacgtacattttgtgataaatttgggacgagtcgaagaaaattggcgcaaaatcggccaccttttgtagggaaaagacacgagaagcattaatggcatggcaattaaatttcttattacaataattaattttgggtcggtcaaacacaaagggcaccgcagcatttgtttactttcgatcctaaaatattcaaataaattagttatcaaaaaaaacaatttttcaacaaaccatcgtgtgatgcaatcggcgtgatatttgtgctaaaaataataattaaatcaaaaattattaatttgtcaaaaaattgcaaaaaaattcgcctcataattcgtcctttttccatgcaatttgattatttgacgattctccaactgnagagaatctaaagcaattgngcacgtttcttcctcattttggtcatttttctgtgcgtttcggntttgggctgcgcttggcagctgaattaatcttnntttaatgaaatattttgcta

SEQ ID NO: 28602 - DNA, 1507 bp, Heterodera glycines
tagggttcggaccccgtgggcgggggtggcttttcacgggggcgggggatggcgggggtcagagtcgcgggggcggggacgggggcacgataattccgcccccgcgggggcgggggcgggggtttgatttgaattaactccaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggtttttggggggcccgcggtgccgataggccgccaggcagattttgaaatttaagctcgatttctaacagatgtttacaaaaaaaaataagatttttacgataaatttttgttttttaatatattaaattatcatgatttactcaagcaaaattggaactcagatttgtaacatattttcttgaggcacatttttccaaaaaaaaaaaacttggtgaatgtgcgagcgtagaggtccggcggtgccgataggcgccgccgggaaaattttttgaaaactgatggatctgttaatagattttgtccaaaaaatgataggtttttgcaatttttagagaatttttttaataagatttacgaatttttgggccctgcgatgccgataggcagcgccaggcgaattttaaaattaaaaaaataaattaaaaaagaaaccgtcaacctaaatcgaactcacgacagaaagtaatgtcaaggttgattcactaaccactacaccacactacacatcaatgaccaataataaaattaactttaattatcgcattaaaaattataaaatttttcacggcggcacctatcggcactgccgggctcccccccccccatttgctgcccaaaatttttttgaaaaaagcgcgccccaaaaaagtgctttgaaaacaaacaaaaaggtcgttgggcaatggtggttttgcggtttctgcgtaaaataaatttaaaaatttaagaagcattttttctaggatagaaaaatgcgctgattaagaatctgagctcggattttgcaaaatcattgatttttgtctatgatttctcaatgtggataaaggactttttgagtaataggactttttgtgttaaaattggggatgatttatcctccagtaaaaaagttacctctggagtcccccagggatctgtccttggacctttattatttttgatttatattaacgatcttcctgatgctttgccatcaggagtgaaaataaaattatatcctgatgatgttaaattatatatttgttataaagcgagagttgacacagaaattatgcataaagcattgcataattaaattgcaattttccaatcatgtcgcacaaataataaagaatgcatatttacgtatgcgttctttatttcgggttattaaatcaaaatcttctaggatttggattattttgtacaaaactta

SEQ ID NO: 28603 - DNA, 1557 bp, Heterodera glycines
cttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaacttagcagggatactgaaaggaagagaaataacctattttaaatattatctagtcagttcatttaaataatttttatccaaaaaaaatttttttttggatttcggggcagtaccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttcgatatacctctactttatttttaccttggatttttgctccccataattgtttgagtaccccaacggacacttgaaaaatcgatttttt

SEQ ID NO: 28604 - DNA, 1482 bp, Heterodera glycines
  misc_feature (274)..(274): n is a, c, g, or t
ataaataaaaacgaaagactcagattttcgaaaattttcttttgccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtgngtgggccttcgccccccccccctcccacgcccttccgagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattctgtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccct

SEQ ID NO: 28605 - DNA, 2092 bp, Heterodera glycines
tttttcaaaaattctacccaaagaatcgacctgaaaattttcataaatgcacccctaagaaatgataaatttttcaaaaatcatcactaaaattaatttaattattttattgacgataattttttgattgtaaaaattatgtatctcattaatggtttggcataatatttttgctttttgaagaaaattttcgattttacaccccctaaaattcggaactttttagcaactatttaccaatttttagcaactattttgggtttttttagaaacaaaactaattattttggtagtttttagcaactataaatattagccctataaatcaggtttatttacgaatttaactttaaaaaaaaattcttaaacttcaaatgtttatctacaaaaatttatggaaaacaattattctaatccgtgtataatcaattatttgcaccttagacaattaattatgcccttcaagcaccttgctttaattttcctaatttgcttgtgctatattcattttgtggtcaactttttctatgattaattttgttttaattattttaaatagcaaataacaattaattaattttttccatctaccttaatgaccagttcgaacttgagctgatccacttcgtcagcgagcagtgccatctcattgtcgcgcttgcgcttccgttcaaaacgtgcactgacgagcttttggcgtttcaattcggcacattctctttgtaatcgttgacgtcccgttgccaaaaacttttcaaactgatcagtcgcaccaaattggcggttgtccatgatcaaaagacaatcgatcagataaattggtgaaaattgagtcacaggcgacaattaacctaaattgaatgttaataagttcaaatcaatctttttttatagggctaggaaaagcagacacttttttgtaccaaaacaatacctctcatataaatctaaaaaagtttacaaaaaaaaaaaaaaaatggccatttcagtgccgggtttttacaaaaccatgcttgtttttttagcttattcgatagaaaatttgtgatacttgctaaagttatgcgggaattccgaattatgatttttgggagaaattttcaaattttcatttattcttttcaaattatttaaaataaatatgttttttggtataatttttggcgctgaatatgacaaattgtttaccaatgtcatacatagcgacgtttttatattaaattgaacagttcatacaccattcattgccgatcaaattcagtcacagataattattttatttatttatttttgcattttatattaatctttttgaatttattctttgctcattagtcttagatgttcagcgcctcaaattaatcaagtaaaaattaaaagaaaaattcagaggacatgatctaacgagccttgtatacacccaggtgggaaataaattttatataattaaaaaatcttctataaaattttcaagtatttttaaattagaaataaaattttaaaaataatttgtatgagtcatctcttctgtgagtggtaatgggaaagaccaaccgaagaccaaataaatagagtgagtgagataaaaccaatagataaatatgtaaatagagagagagtgtaatggaagaggaagagaaggaaggcttggcatctttttggtttggcttccaatctgtgccccgccgttttgtccccaaatgccaataatagattgaattgttttttaaaaaattgtcgtagatatttataaacttattaaagaactattgtggatttcttatgttcttctacatcagggctctcattcgtccttgaatggcaaggacgtccttgaaattgggcctttccgcttgaaaatttaaaagtatccttgaattcaagaagttcttgaaaatgagcatttggaaaagttttaaaaaaattcaaagaaatttgagaaatttttgtaattttaacaatattttgattaaattatggcattatgtcaataaaaatgtgtaatttttttttcatggttgagaaattttttaattatatggcataaagtcactatttttcttaaagaaatagcccaaaaatcgcaaatttt

SEQ ID NO: 28606 - DNA, 966 bp, Heterodera glycines
gcagaatgccatccaattggcctggctcccgccccatcccgaaacttctccggtggtcgcttatcgtctccgttacggccccgccgcaggcacttaccggccgcaggaagtgattctgcagggcgacgaactcagctgtgccgactacgagtcgcgcattttgactggcgaacacttgtgcacttcggccacgggtctgaagccggccacgatgtaccgcttcgcggtgcaggcgcagtcttcgtctggcaattggggcccgttcacctcggacagtttcggcaccactgaacccgaactgaaggcggtggaggggggacagttgcgactgatcggcgcagggcacgactttttgcgagtgcggtggacggcaccgccggtgattgttgcgcacatcgaacaatacgaggtggacaaggcggaggacgagattcgcaactgtacctatttgtttaaagttgcacatccaaccgaccgaacgacttgtccaagcgccacaacggcacgaagtgccggacagtcagacggacttccaattcaaagggttggtgccggtgacagtgtacaacgtaacggtacaaggactggcacagcaggggaagagcctgtggaggattagcgacaacttcgccaccactgacatatccgtgagaaaggggaggggtaagggacagtaatgccattcccgaataaacgaacattcccgagagttgggaccaaatgcaaaccgagttgaaaatggcatttgaatttgcttccccttaggagccgtccctcgcctggctgtcttcgtggtgttctccgcttaccctggtggaaaagtcggactccatgctgcacgtgacttggactccacctgacgtgtacgagccggagtaccgcgaccttgctgacgcattaccgcgttaccattgcaccgctcctagaagagacgatgaaggcgggcgggcgcaaaaattacacagt

SEQ ID NO: 28607 - DNA, 1375 bp, Heterodera glycines
gctaaaagagaagctcgtaacggagttcactcacttgcgcaacaattctctggagcctcttgcgacttttcttgattatataacgtacgcgaaccgacggaaatatttattagaagcgtgatttttaagttattcatacatgatcgacaacatcattctgctgatcactggcactctccatcaacggccaatcaacgagctgatctccaagtgccatcccctcggctcatttgagcaaatggaggccattcacattgcatcaaacccggctgaactgtacaacgctgtgctcgtcgacactcccctcggttggtcgttggagaagggctttgattcgttggcctcgaaatcttcttgcttttatttacttagcattttctttagccccatatttcgtggattgcataagtgagcaagaccttgacgaactcaatgtggagattatccggaacacactgtacaaggcgtacattgaggacttttataatttatgcaaaaagatgggcgggaaaactgctgaggtgatgtgcgaaattttagctgtgagtttcctttttctctatttcatcttttttatcggtgtattaagttcgaggctgatcgacgagcaattatcatcacaatcaacagttttgacacggagttaaataaagaggaccgcgctaatttgtaccctcggtgtggaaaactgttcccagagggattggctgggctagccaaggccgatgattatgagcaagtgaagcaagtttgcgagtactactccgactataagcaactcttcgagaacagtggcctcaatccaggcgaaaaaacgcttgaagacaagtttttcgaacatgaggtgatccattccagcgggattgagttcttaggcgactccaaaatcatttatttaaaatgggtcaaatcagtgttctgtcgtttccaggtaaagctgaacgtccaggcctacctccaccaatttcattttggcgttttctacgcgttcataaaactgaaagaacaggaaatgagaaacattatttggatcgcagaatgcatagcacagcgtcaccggaccaaaattgacaattacatacccatcctgtaaatcttataattccacaattgtctaacgtaagtaattccacacgcttccttttagtttctgataatgtctgatgattcatcgtttaaaatgctattttgtgataaagaatgtttacagtcatttaataaggtctagtgcagaattcgcgtcccatggagttacgatatcccttggcttttatgcaaccgttaggatttttatgttgacggttttacgtgtcctaattaattcgaaatttattcgactttctgtggaatttcgtgtcggaattgatgtcatatg

SEQ ID NO: 28608 - DNA, 1644 bp, Heterodera glycines
tttaaaagtaatacataaatacttttattaatttaatactaataataattttagttaatttagaaaaataatgttcgaagaaaatattatataagaaataaaggattctattaacaaatctcactcaaattctcggtctcgagtctcggtgtctttccaggtctcggttctcgaaaaatttcgactctcaagcagccctagattcgggttttcccttcccttcccactctctctcctctctctctcttcccgctttctctctctatccatctctccttcctctctctccatgtcgctctcttttctctctctttccttttttacccactctatctctttcttttccctctctctcttaaactgaccatgctctgtacattgccgtggccaacatttcgctggtcagattttccggcatcaccgatattgaattgtcaatgccgacattggaaagcattcggcgatgaagtgcggtaaggggctgaggagtgccgtagccgccaattgagccgccattcaattcaatcttaaacagagaacaagttcgttttcaaatttttactggcggcacttcgaaatagccgaaaattttaaaaattgaccgaacattggcaatttttggtgaaaatttattaacaaattataacttttttccggcaaaaaaaattaaaaatagaatttcgattccacattcttgttgatagtgttgatattaattaaataaatatcaaaataagagttgattcttaggaaaacaaataaaagagtgttcatttgctaattattatttacctgttttagcgcatattttttctcattgcttttttcatcaatttcttcgctggccatataatcctaaaaaataaaataaatatacaaaatttgaaaaaatgaaatcaattattatcatatccttatatcataagaattaattatcccaccatttaagaaaacaacaaaattagttaattattaattatcccaccgctcttatgcaaatcaacatcaatggctgtcgaatgccctccttatgctttctttcgattagatcagcagtatatcggagtgatggactcacagccagaacacttttatgcaattctttcaaaaattcaaaattggacggtaacgacgcacggaaatacatcaaaagaagggtctaaaaattaattagagaaattaaaacatttttaaaattaaaaattgttaattaaatttataaaattgtccgtatattatagtcactttgttgacatccatcgcctggtcgaacaattcgcgtgggaatggcgaagggtaaagtgtaaagggcacaaactgtgccatgtcgtccaaaacaacattctaagcaaaggaattgaccacttttggcatttaaatcaaaaaattgaatttaatataactcgagcccatggtaacaattaccctaattaatggcctatggcatttgccaagttttaagggatttgtgccgtatttatatatatccacctcattgattttgtcacatgcgtcacatttcagtttccttcttggcatcggaaaagtcagcccattagtcagtgcccaatctttcgcgtcgcgaattcgttccattaaaactttttcgtccctttcaatgttttccacacaatatttctcttc

SEQ ID NO: 28609 - DNA, 1344 bp, Heterodera glycines
  misc_feature (153)..(153): n is a, c, g, or t
aagatgtgattaagatgacgaaattgggggggggggagtggacaattgagcgtattcatttgagtccaaccatcgcgggggtggccaactgagcaccatacaaaaaagaatatttttgtggacaaaagcattttattgctgggccaaaagcanacaaatgatagtgcagtgggtattattggtgcgcaaaatttcctgtttaacctttcggcgtttccaactaaacacaatacggaaatttagaaattaaagaaaaaataaataaataaaaaagcatatggccgatattcagaatattttatttaaattgctttacaaacataaataagacattttttatgaattacggaacatttaaaagtctcttcattcattggttatttcttcacaacttaggcgatgccacaacgttgttctgttcggcatttgtttcggttttgttcggtgccacgatgttgttctgttcggcatttgtttcggttttgttgggtgccacgatgttgttctgttcggcatttgttgcggttttgttcggtgccacgatgttgctctgttcggcatttgttgcggttttgttcggtgccacgatgttgctctgttcaacatttgttgcggttttgttaggtgccacaatgttgctctgttcggcatttgttgcggtttttttcggtgccacaatgttgctctgttcgacatttgttgcggtttttttcggtgccacaatgttgctctgttcggcatttgttgcggttttgttgggtgccacgatgttgttctgttcggcatttgttgcggttttgttgggtgccacgatgttgttctgttcggcatttgtttgagttttgttcggtgccacgatgttgttctgttcgacatttgttgcggttttgttgggtgccacgatgttgttctgttcggcatttgtttgagttttgttcggtgccacgatgttgttctgttcgacatttgttgcggttttgttgggtgccacgatgttgttctgttcggcatttgtttgagttttgttcggtgccacgatgttgttctgttcgacatttgttgcggttttgttgggtgccacgatgttgctctgttcgacatttgttgcggttttgttgggtgtcacgatgttgctctgttcggcatttgtcacggttttgttcggtgccacgatcttgttctgttcggcatttgttgcggttttgttggcattttctaatgccaaaatgttgctctgttcggcattttccccagtggcattgggtggagccgtaatgttactctgcttggcatgtttggcttagaggtcgtgccattggttttggatgaaccccgcatgctttt

SEQ ID NO: 28610 - DNA, 1679 bp, Heterodera glycines
ttatcctagtcaaataattttttgttttttttaatgatatgtgacgatgcagcagttacggtataacactttatattcaaagtattttgcttaaatttttatatttttttatgtttgtaaaataatttacattcaaatatgaaatgcccattcgacctaggaggtacgacgaagctggcctttatgtaagtattttgatatcgctaatattgcttgcttttatatattaataatagaaaataaattttattcgtctttttttgaatattatttttttcataattcctttttcatctgtctttcctagttttagataataaattatatgtttgcataactattattaatgcctttgtaataatgatttttagcttacttgttgacatttaataattctgtcctttttgtgtttataccggaggaatttttaaaaaattatttaattttttcactaatgatataatttttttaattttaataataaaataatgattaaattaaatttacttttagtttaaagaattggtggctggacgtttcgccaatgaccgtttcgccaatgaccgtttcgacaataccttttcgacaatgccgtttcgacaatgaccatttacgactatatcatatcgccaaaatttaaaatatcaaattaaatataataaaatgaatataaaaaataataaattaatttaaaaaaatattgatgaaatttaaagagaaaaatttaattaggtagttatattttttaaatttaatgaatgcattatctatcgcctattgtgtatgattattaatagttaggagtcggatttttaggtttttacctatttctagattttttcaatttttaacacctattttcgcacctattttggccttttttggggtttttagcacctattttgcacttttttagcacctattttagtacctatttagggatttttagcacctaaaaatccgagccctattaatagtgaagaaagaagacaaaatgagacggacctataatataaatccgaaatgaaaccatttatttaacttaatgtagtgtcctctttttacccaggcggcaatcctgaagaatggttgtccctaattttcatttttttttaattttgtgctcaaaaccagtttttaggcgtttttgagggtgctgataacggatcttaactcgggtttgcccaattccgaactccagacccgaattcgaacaaaaaaaaattgtttttttaatcaagaatagttttttcagggtaaaagcttctaattcattatcaactatttaggtgtaaaacaatgtttcaatttttaattaaaaaaaataagcaatttgcgccgaaaattgaaaaactaaagccattctcataatgctattttgaaaaaaacgaaaaaaaacttttttatattgatcccaaatccgcaccgtccatataattttgcagaaatttgaattttattttaaaaaatatatttaattttattgtcgaaacggcattgtcgaaaaggtattgtcgaaacggtcattggcgaaacggtcattgtcgaaatgtccgggagcccattaagctagctatttttgcccacccttagcgatttttgcccaaccgatttcgaaacggcttagtgggcttgggcactattgagtagtaggcttaaacttttgaatatagctctgc

SEQ ID NO: 28611 - DNA, 1745 bp, Heterodera glycines
  misc_feature (1651)..(1651): n is a, c, g, or t
  misc_feature (1737)..(1737): n is a, c, g, or t
actgtccccccgaacgtgcgacacttttgacgatgcctacggcggtggctcatcatcaattgacggacattcggtgggagggaaggggaaaatattgccgtaatggcacagggggacagagcggtggtccactattaaaaacggaaacgcacacaaatttggctttatcttgttgactcggttagagacaatgtgaaaaaacgcaaaaaattggccattatacaaataacgaacgaccaaaacggcacagatgaccacaatgcattcttcgtcaaattggcactttgtcaccctttctcatacagatcagggatggcattccgaggccccaattaacaaaatttgtaaaaaattgttaattttttgaaaaaaaaatcaaaaaaatttccgaaaatttccgactttttatcaaaaatttcgaaaatcggaagtcggatggccgacgtccaaaattttttcggaaatcggaattccgaccccaaaaatgtcggaattcggtgccatccctgatacagacccgtaaccgaatggcgaggggggcgggggaggaatccctctccaaagcaaatttttctaaattcttcaatttactaaaacacttcagccgctttgatttttttgaaaataaatttaaaaaaaaataagaaatgttttcgaattaccccatttcttttttgttacgggcctgattactttcgacattttttcactggaatttgcattactcaattcttaccatgttccgatgtcaaataattgtcctttcttttgttttttccaaattttagtgatttttatgcataagtcttctttctcttcgtttcatttcattttaaaatttctttggcgaataattttttttccctcttatgcaatttccagaggctgtcctccctaaagacaaacaccataaattgtttttatggtataaattagtgctttcaggcttaattgggtgcttatagggactgtctctctcattggataattttcttttgtctgttttccatttcctgtttatgtgctttttgcgtatttttatttctattcatcagctttttgctttttctcgctgcttggtatattcgtcttatgaataaaaatgtgttttaaatatttattacactgtagttgggacttggatggtcggaattttctaaatgacactctttggagttagattttagaagaaaaaaaaattgttgaacaggctttgccaaaaagcaccaattccgaagatgacttggacaaatttttatttatttttgtctatctcttaaccaaaaaaaacttagtcagctacatattgtcagaatgagccatgggataaacaataatgtttgcttgtcctggatttttgtccagaaaatacaggttaaaatcccacattctttggttctgagacttgcctttaagtgactaaaaaatattttttcgatctaaatttgttttagtctagcaaattaattacggaaatgcggtaattgggtaaaaaatattgccgccctttgtgactgaaagcaggcggatgaaaaattggcaccaaaaagaattaagtttatccataagacacaaagcaaaacgtaagcgaacaagcaaaaaatgagaataaagaataaaaacgaaaataaaacaggcagattaagtttanaatttaaagcgaaaattcatgccaatgactcatcacgtggcgaaaacgatggaattcagaaaggctgtggtgacttcactgcccgncccatgct

SEQ ID NO: 28612 - DNA, 2195 bp, Heterodera glycines
aaggcaaagtgtcgcggcgatcgcttattctccacaagttctttagggatcagatccaaaaggactgcgcgaggctgctgaaataagggggaacagtgatcaggacgaaacaaagcaaaaaaaaaaaacaatacaaaagggaaaagaagagagtgaaagtgatcagaagagagaaaagcaatgacagagataaagggaaaagaagagagaaagcaatgacagagataaagggaaaagaagagagtgaaagtgatcagaagagagaaaagcaatgacagagataaagggaaaagaagagagaaagcaatgacagagataaagggaaaagaagagagaaagcaatgacagagataaagggaaaagaagagagtgaaagtgatcagaagagagaaaagcaatgacagagataaagggaaaagaagagagaaaagcaatgacagagataaagggaaaagaagagagtgaaagtgatcagaagagagaaaagcaatgacagagataaagggaaaagaagagagtgaaagtgatcagaagagagaaaagcaatgacagagataaagggaaaagaagagagaaaagcaatgacagagataaagggaaaagaagagagtgaaagtgatcagaagagagaaaagcaatgacagagataaaagggaaaagaagagagtcagagataagggaaaagaagagggaaaagaagagaatgaaagtgatcagaagagagaaaagcaatgaaagagataaaagggaaaagaagagagtcagagataagggaaacaaagagtcagagataagggaaaagaagagagtgaaagtgatcagaagggagggagagaaaacgaataagagactagcaaaggaaggaaagaaaaatgttccaaaaatcatgatcataaataaattctgctaaattgtgatggcttacctcggcggatggctgctgcccctccacagaaacacaaagtgcgacgaggacagcaaagagcgtcagaaacaacggcagaagacggacccctttggacaaggcggaaccaaaaaaggaatgggagggaaactgaaaggggatgaaaaaaggaaaaaagggaaaaaatggtcaaaatggggaaagggaaaaattgccaaaaagggaaaacaaaaaaaaagggcccaaaaaaaaagggggggggaaaaaatttgtgaagaaaaaaaaaaaaaaaaaaaaaaaaaaaaaaaaaaggggggggggggggaaaaaaaaaaaaggtcctttactagtgtcattgtcatgtgtagtagagtgtgccaggggggtggggatttaaagtgccattagtttcttattttttttgtctcttgcgtgtcgggttctctttacggggggcgtcgcagtaatgatgttgatttttattttttatcgcatttctgttcttcttttgtgtttctgagtttgtagtgcttgttcgattagggtcattttactaagtcgtcacaaattgatttctaaatttcagtttccatacgtgatacctgcctgattggggcactgattattggatttgggtttccgtattattagaatctgttctgatttgagattttattttgtactcgcggtttcagtactagtttggggaacggacgatttagtcggattaccagttcgatttgtggctatctgctctgtgttatttagttgcgatcgggatacacattatgagtgggggcagttctaagttgggataaattactacgactcggcgtaccagtgcaatttgagaaaaaaagtcttattcggggtaccagcaccattcggtgtatcagtacgagacggaaaacttagtgatgattcggggtgtcgcttcgatttggggtacctactaagtttcggtgtaccacaacgagtagcggtatacaatacgaatagagaacgtagtatcattgcagggcccactatgatatctgtctgtacgatattggaaaacagtcgaacgagtagtggtaccagtatgagttcggtaccttagtaccatacgtgcttccagttcgagcggtgagatttaggaagcgtaggtgtaccagtgcatattggggctgtccgcaaagggtacagcagttgatgtccgcgtatccatggtaaggggggtcccttaaggcctcccctcccctcccctccctaacgcgattcggctttttcttccctcttctcatgcatcctt

SEQ ID NO: 28613 - DNA, 1305 bp, Heterodera glycines
caacagcatcacatcttcctgatcacttaggttgttttcgcttgttgtactgctccatcttctcgccctgtccgatcaccgctgccgctttctctcgtcgctccgtcgccattgagcacagcgacctgatcaacccaccggtgccggtctccggatatccgcaacgtggggcatttgcttttactcacggccaattctcggcactcaatttcgatcaattctcgagaattaagccatgaccatcccgattgtatatggcaaaaccctgatcacaagattagaatcgattctgtcattcttcaagctcctccttagcctcgaaagtttctcagtgatcaaatccttgtcaaatttcggcatttatttctcgacatggtgatcggtgctgatcacaaaaacgaattatgggggcctgatcaaatccttttatacttaattgatcaaatttgatcagataagtttatcaggatttgatcaggccccaataaacccgggttccaaccgtctaaatacaatcccgacaccaattcccgagttgtatctttcccattcagtggtccctttcttcggttcgcctccgtccgtcgcttcgtccgcctcctcttccgcgtcatcgtcgacgacggatccgcaccagcagcagcagcactcgcccattttccactcgcaccagcgccatttgaccccactgggaagcagcagcagcaacaagcagcaacaacagcagcaccaaagtgtgatttgattgggagagtgatccgatccgtgatcgttttttaggcagggaaatccatcggataataaaaaggggcgagggataaatcatgagaaatcattgtcagtaggactgaccaccccgccgatcacaacaaaaaactgatcaggttgaaaagatgaacggaggaactcagcgatctttcagtcataaaaaagtgatttttgatcagaggggcaatatttcttgacttgagttctcgaaactgatcagcagcattcaaaaactgataaatgtttaatgaaaaaagtgatcgggagatatatttcgtttgatcaatttgtgaaattggatcgaggacttccctgatcagtttcagaaagtcaaaaatagtggcgacttacaaattatagcttcttcaccctactgatctcgatcccgcattgagggcaattgatcactcactgtcactgagatccataattaattcccttttttctcagccgcccatccgcaacagcgtcgcccgtacgcgtccccttccggcgcagggagcgcaggaggaggagtcgccttcttcgaccagttca

SEQ ID NO: 28614 - DNA, 799 bp, Heterodera glycines
ctaatgcaattaaattatgcaattgcttttttgagtaattattctttacacaatgtaaacgtttgagtaaaattaaaatttcataaattttatttcttttttctattaatttgattaatttttgaattgtgcacaattcgcttttagtaataaaaattttgaattactatagtaaaaatagctaaaacgaaaatcggtttttttaaagaactttggctttaaaatgcaaaaattatctgcctatttcgtacatttcaaattattcaaaatgacgaaaatgcctaccattttgctgctgtgctcaattttaatcatttatcctctgccatctttcactccttttcttctccctctcgctcttccccttcctctttccgcttctcttcgttttcttcccccttcttcccttctttgtcttatacacttttctgtctcttccgcttttcttccctctttgtcttccctcctctttcgctatttcttcctcttttcatctcttcttcctctttccctttctctttatcttcttccatcttctctctaccattctctcgccttccctctaccccctttctcctcttctcttagttctactcttaggaaatttgtatgtcataacgatttgccgtataccgtatatactctaattatcccactgtctccattacataaaatcactttcttcaccgggatccgaacctgacccacctccccctcagaatgatgcctcagaatccccatatatgcagggattcggaggccttaacgaagtcctaaccaatatctaattccaaattct

SEQ ID NO: 28615 - DNA, 1179 bp, Heterodera glycines
  misc_feature (62)..(62): n is a, c, g, or t
tgtttcttatcctatcactttccctttttccttccgtccctctacgtctcatatttttcagntcccctttttcccacctccccccccccccatttacaccaactgctggcggaatcacaataatatataaagggcattaactggcaaattcggccaattctttcacgggcgtactttgagtttgcttcttttcttaaattgctaatcaattcatcagctgccaattgcatcattctcatcgttgaagctgtcgtgggcagaaggggggggggggaaatggtaatcggtagaaaaatgcgcagaaacggaaaaagagacagaccaaatgtgcaaaggcccaccctttgaaaaaataaattttattttgttaaagaatttgccgtgtaaaatacggtattacttatctttgtcttttttttcgaaaaataattaataaaaaagtttatttaaaaaaagtaaagtcagctaaatttattcaattacgatttttcctgctcaatgtcagaattaccccccccccctaacatttattggatgatgtaaaaataacacataataatattggcatcgtttagaaggctttcccccatggtaaaacatgggatgagaattgattgaggttggaagtgtaaagttgtggaaaaaattcgcccttttttgctgttattcttctcactcgacggaaatcacatacaatgccatttttaatctgaaaaagtaacgaatttttgttgccttggagcggtggggcgatggcctcccccccccccccccccggaagcgcccctcagtctccgcccctttccacttccaattttcccgtgacccatcacgggaccgaccatttccattgggaataatgggcattggagcagcattcgtaaacactaaacagcctttcccctccctttcccccccccccgctcatttactgtgataatggcaatggatgtgcaagcactacaccaagcagaagagaaaagaggaggaggagtagtatcattcattcactttctgattcacattggcctcgccattccccaccctttttctgccatttttcctttcctcgacattttcccctcccattgcccccctcgccttttccggtttcataccctcaagggatgtgtgtgatcgccaaatcaaacgtaataagggacatgactcatgaatcat

SEQ ID NO: 28616 - DNA, 245 bp, Heterodera glycines
ttcattttctatggcatttctttccgcagttttatactgctgccttttatttcattttgattattgttagctcgtcactgttgccattacaaccgacgcgatgagatgagtgagtgcgtttatttttcgggccaattattaaataccatccctcccctccttttctcccctccccctgagtttggtctcccccgcgctccctttgtcgtgtccgccgtccgccaccccattccgcttcatccctc

SEQ ID NO: 28617 - DNA, 729 bp, Heterodera glycines
gggcgtcaacgattgggggcggaagcgcggaagtgccggagcaggacgcctgcggcatcagtgtgccgtacggcgtcgacgcgggtcgctggtggagcaggtggtgggaggcgtgcgggtggccaccgctcaaaccgccgccgccaccggtcatcgggcttgacctacggcacacaaatggtggaaaaattaaccgacaaaaaccaaacaaatgccttttaagcctaattaggacacggaaatggcacccaccctgattagtcggctaattgctattttcggcccacctttgatgctccaatccgccggtgccggcagtgatcgatgcgacaccgccgccgccagcggttgtggtggtgaccattgaggcggaggcgcccgagttgggcgagtaggcgccagtgttggccaacacggaactgttgaacacggacggaacgccgcttgggcccacgggcgaagacgaagcgaattcctggggaaaggtggcacaaatttatggaaatgtggacacattccaattcaatcccacaaaatgtttcgttaattattctaacattgtaaaaaagctcgtcgactgtttgtttcattttgtggcataattcccgcctcttagcaaactatttcccatttctctaatgccttatttgttagggatttaatgccgtttttttcttggcctttttaccaaaaaaaatttttgggctaagggtttggttgggtttggga

SEQ ID NO: 28618 - DNA, 1241 bp, Heterodera glycines
  misc_feature (1213)..(1213): n is a, c, g, or t
gatccgtttcaaaaaattaaaacgaaggggagcctttaggtggtggtgttttttggcacatacaatgttttttaggacataaaacctgctgttgatcaataggaaaaacacccctaaaattggaaaattttctcaaaaattcatccctcaaattttttttcttgcaaaattttggattaaaaaatgtcgatattttctaagaaatattagaaggaagtgtaacctaatttgcaacagcaaccagtgaattaaaaaaaattttttgctcaatttttggctgaaaattatgccaccactattcgtcactatttcaaacttatcgccactattttggcatttttttttgtcactatttagttaattattttgggtttttgaccactaaaaatccgggccctaatgatcaatgatctcaccaataaatctttttcaaaagaaaagtcttttgccaactttggatccgcatcaaatcgttcgtcccaaaggaattttgcccgtgccgtttttcccgttttttccacctttcccatgacccctcccccttaatctccgccttcgcccttttatcccataaaaaagtattctccgatctcccgcccctcgcctgaatttctgaaaaaattactctttttgttaagaaatttcattaaaatctctagtttgcccctggcggtgcctaccggcccggccccaaaattcaccaaaaatcgcaaatttatggtcaaaatttgttaacaagttcggcccaaaattccctaaaatttcctgcgttgcatacctacatcgcctctttacccgtgtactgctttggctaaaaatttaaccataatcttaaagagatgggcgtgggatttgcccagcagtccgctttaagtttttgagcaatttcacatattcatttttatgttttgctaagcaaattttaaatccgtcgagaattgtcttaataattttcactcaacaaaatgtcagacaatggaaaagaagcggatgaagagatggcaaaagcaatgtaaaaattaaaattaaaatgcccattttcaatttcaattttaatttttttcctttttcttcagttttatctccgccgattgttggctcaaagtgtttgaattgctcccgccttctcaacttggccttggaattgcactgatcagccaccgatttgacgtttacgtggacgaacacttcaaaacgcgcaaaaggacattgngaaatattcgaattcaacgcaaaattgg

SEQ ID NO: 28619 - DNA, 558 bp, Heterodera glycines
aaaaattggtgttttggaatttgttgcggacaggcggcaagaaacactgtttccactgctccaaaaatgtgtcaggggtggctcaattatccattccgattccgcctcaatgtgtgtcaatctgcgcgcaaacccgccatgcagccaaatagtcaatatctcaaccgtgccaataccgacttatcagcatatatgggttaaccatacggaaaactatcgaccccgcgacgggtgcttgcacaaatatgtgcacataattaatgggccaacaaatttaattcatctcgcaacagcatcagtaatattcccattctgttttggtcattccattcattttcaacattcgcgggtcgttcattgcctttccgcgggttggggtcagttccatactgccgtttccatgccgccgtttccataccaaggtatttaggccatttccataccaaaagtttaaaagacattgaaattaaaaatccaagaaaaaataacattttatctgtttcaaatcacggtctcatttcataatttcgagaaattccgatcaaaaaagcaataata

SEQ ID NO: 28620 - DNA, 841 bp, Heterodera glycines
cataatagcaaattaatcttccgcttcggccttttccttcgcctccaattgcttcaaatcctccttgttcttcgtgactatttcattggctaattctgcgaagcatttcttctggtcctgaattaaacaattaataatttgtgaagactaaagcaaaaaaaaatctctcattcaatgagaaaccgaacaataccaactgttttctgctctttttttacctcgatctgctgaaagtggtcgcagagtttcgtgactttctccagcaccgccgacaacaattcgttgtattgtgtgtccaaacgatttttgtagtccaaatactgttattaaaattcgaaacatttaatagtctatcactgcgaatgcattttacatttttgtgcttctcggccaattcgtcatggagtttgcccaatctcaggtcaattttgcccagttcgtcgacggtggcctggtgtttctgtctgatcacgtccaaactgtgcttcgcgtcgaccaatgaacgctgattgtccccaaacttgcgcttggccctctccagttcaagtttgtgctttgacagaagctaaaccaaaagtcaaatattaagggatttcgtcgcccgaaatttgcggactccaaatcgaattaaaaactaagtttttttcaatccccgatcgcctaaacagcattatatatgtgaagaaagtgattgtgtctaataatttgatagtcagtaaatttttgaaaaaatcatcaattattcaaacaataaatagaattaatgatcctaataaactagaagattgtgttttcttaattttaataccgcttaggccatacatgcaaaaaaaaggggggg

SEQ ID NO: 28621 - DNA, 1323 bp, Heterodera glycines
aaaatttggggcgattgaaatgagaatagaaagagccaggttcgatgaagttttgtaaaccaaaaaaaaatccaaacatttttataaaaaattaaaaatgagaattcatgcgagattttctggaaataagcttaatagggcctagttaagctgtaaaaaaaatttggagcgatttgaatgagaatataaagagccaggttcgatgaagttttgtaagtcccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaatatccaaacatttaaaaatctataaaaaatttaaaaatgaagaattcatgcgagatttttctggaaataagcttaatatggcctaattaagctgaaaaaaaaatttggggcgatttgaatgaaaataaaaaaagccaggttcaatgagtttttggtaacccaaaaaaaacccaaccttttaaaatctataaaaatttaaaaaggaaaattcctggcagatttttctggaaataaatttaaaaagggcccaagttaaattggaaaaaaaatttgggg

SEQ ID NO: 28622 - DNA, 1441 bp, Heterodera glycines
tgcctgatgaattattgctcgtccatcgttcaccgtcccctgccgattcctatcatagccaatctcttaaaaatacatccacttcttctcattgcacttctgctgcgccttcaaattcttcacccataggtacagtaacatttcgtacgaatttgaattaatccaatgagaatgataccgtcactttccagatgctttttgaatgtgattatgatttctccatttaaatttcacacttatttcaaattaatttgtagtcactcgtcaaaagtttgacctgccttcgttgtccgttgaccagttggtctctgagcagaaccagcaaatcattgggcccgactttgaacttcatcagaatgtcagtgtcactgtcagaggagggaaaagcaacaatggagaccaatatttgatcaggtgaaagcagcatttagatgaagttaacttcattttagctcattccaagaggcaaatttgtcccaacaaattctccaaaatttggcccaaattcgtttcatccgtcccacagttgtgcaaagtcgcatcattccacttattatgcggacaaatggttggccaatttgaagcaaaagttgaagcaaattctgtccatttttagaggatttgctgtgtttggcgtccaccggcacgggaaagaccggcgcctttctcattccgttgctaaacattttgcacatgttttgctccatcaaagagcttgggaatcttctctttccagtcaatcggcactttccgaaggcgattatcgttgcgcacacaaaggaattggtgctccaaatcgacaaaatggcgcgaatcctcgcagacggtgaattttgaaccattcattccaaatcaaattgcgtcgtctttgtttatccttttccgtcgatttgcagggactggcgttggcattgttctaatgatgggcgagctgagctacgcttcgatcaacagccgaatcaaccgggacggatgcgatgttttggtcgccacccccggccgactaaaggaatttctcctgaagaatcggatcgaattggattgtctgcagtttttggtgatcgacgagatggacaaattcttttcggtgtttttgcctttgtttttgatccgattaattgcttcttcatttttaggactttgaatttctgcaattgtttcacgaattgaacgaaaaaaagagacaatgcaaagtgacaaatgttttgtccgcttttatttttccactttttcagagcaccgtttggccctttcgtacttttttgttcagtgccacttccgattccctcgacggcgtcgttccgttccttcgccccgatttcttccatgtcatcgctgggccggtcaaccaaagtgttgcgcacgtgcgacaacgcatcatttcgacaaacattttcatgcgaatccatcaacttgagcttatcttgcaaagagaaggtaa

SEQ ID NO: 28623 - DNA, 1543 bp, Heterodera glycines
gtccattttcctaaatgtgctcttgctgtgacagaaaaaaagtaacatttggaaatggtaagcccatcaacagtccaagcatggcataatggtcaatggatgttcaattttgaaacaaaaaaagacaacaacgggatactgtataagaatattaacacaagacgattggacgggattggatgataatgcttcaatcgatttcgtagataaaaatggaacggtaagcatttaaataactataaatacccaaaggccctgaaatagaatttttttttttatgtttaaatgtagaaaaaaaaagattcaatataattgaaaatttttcgaaaaatgcaaaatttattattcaaaaaccccaaaaaaataagtgggtgaattttgagataatatttagaggtggaggtgtattttttttttgttaattaggaatatgcgttgtatctttttgcatatttttctgcacatatgttatgaaaaaacggctcaatattagcatttctgcgtgaaaatttttttgatgctttggtttaacttttttattacatatgtataaatgtgcatatttttacattatttggttttaaagtatgtatgttttttcttagttctaaaaatattgttattttacagattaaaactatagaagtaagacagctgcgcgtaaaaaaagaaagtatattttacaccaaaccctaaaactcatatggaatttctgtctatttcaatgaacaattcattgttcgactactaataaattatgatgactcggtggataagaattatttggagatattgatccaaagcaatggctacaacgaaatcccaatgatatgattacattcaaacgcaatggaccttatggaatacagacagacaggtaggtagtaaatgaaaattataaaagtttttaaaaataaaattgaattgtgaaaaaaatgaggcaaattttctgttcatattttcgatgaaccctcttaaaacgtaatcaatgttgctaaaaataatgctgatttttcgtgctacttacctgggcaaatttctgttccatattacagacccacctcaaatttccaccaatgctagaaaataagagttttttggttgttgttgttgttgttgttgctgttgttgtttttttttttggcttaacacatttaatttgaaaattttgaactaaactaagcttaagatgtagcttattgaccaaaataaatgaaaaaaagccccgttttggcgctatgcgtcattttatcaaaccgaataatgaccagggatggtttaaaattccggtatggaattttttggttgaaaattttggaaaactggaatttttaatattaaattaaaagcaataactttggatgtgttaatttgacacacttaatgcaaattgtttcttaaatatagtaagaaaaccagagcttctttcccccagaattatgaattattcctgaatttttcattaagcctcaggaaccattgaccaattttgtataattgtcatttattaatttttttatgtgctgggcacagctaccgtagc

SEQ ID NO: 28624 - DNA, 1246 bp, Heterodera glycines
aaaatttttaaattaagaaaggaaaagggttattaaatattttttttaaggcaggatcaaaaaatgggtttatccaaaaaggaatagagagggttaaagcagctaattccaatatttttataaaaacaagatttatttattttttggtaataaaccaagtaattatcgatcccacatcaacaagtttattatacaaggctgttgagctcttatgttaactgcaaagataagaaattcaataaataaatattaaaaacagtaaaaatttgaataaagataataaaataagaattatcatttagaacttattaagcatctgttgagaagaatcgctgcaataaacaaaagaattgagtgtctaaaggtaaccaaagcaataaattattaaacaataaacctaaaaaataattattaaattttatggtcgattcagttcattaattaatatggccacttatgcattttaaaagtgaaacttaaatattatacaatgataaattatcagcctttaattattggtaaaatttaatatttcaataattaaattttgaattttttaaaatcaaattatgagtggtttttgtgattataaaattatttcaaagaataaaaagaaggttaattttaattggtttgacgatggctgagttgaacacggtctgtgaattggaatggcgaattttcgatttttctcaaatggttgaaggccgagtgcgccacccgaaaagttacgcgtggaaaattttggccatggcggtaaattaaatttaaaaaattcaaaaaaccactgcaattctaaagaagttttgtcggaagatgacacggtcggttggctggacacatcagttgtatttggcagtgacaatttggcgtcaattttaacacaaattcaaaatggcaaaattggcccagttcaactgcttagcagtgagtgtgaaaatggacaaatttttaattgttttattttttgaaaaatcgttgttaaccttaagatacttggcacggcaaaaacattgcgacacatccgagtacttattttaataaaataatttgaattaaaacgcataacaaatcacaattttgcccagggatgtacgattatttgccaatggtcgccaattttgggcccacaaaacaaacaaatgatttgtcagggaaagacccgccacaattcgagtccaactttgtcatccttcataaaacggaaaatacgcggcaactgatgaaatggttggtatttattctc

SEQ ID NO: 28625 - DNA, 938 bp, Heterodera glycines
  misc_feature (12)..(12): n is a, c, g, or t
  misc_feature (97)..(97): n is a, c, g, or t
aattatatatanctgacaagttttcgtcattgtcatgcacatataaattaaaaagattaacaatgttcatttcttcgtttattatattcatttcttntaaaatcaattaataaaatagtaattgccaatactattatcatttaaaaatattcgaattttttcactattcttctacatatatatatattaaacagaattaatttataattaaaatctttaatggacttatgcaaaaaattgatagaagaaatttatatttaattttgattatgttctaaaccttctgggtattatttttataatttgaaataaagttctcgaccatcttcgatttaattattactagaaaaattttaatgttgttattgcataaatttttattattataaaaatgaattaaatttatatatttttataaaaatgtaatgtcgtttaaataaaaacttttgaatttatataaatttatttctgccttttcttaaagaaatgtttctagataaaaactataaatttatttttttaaattaattaatttattctcgaacatttttattttgaatttcaaagagaatcaagagatttagaatacatagctgctatgttcgacgaattaaaactgatttaaaaatacaaaagcataatagtttttaaaatataaaatcaattaaaattactttatacgactttaaacatctaccaattataactagtgatacgatttaggtgctaaaaactgccaaaattggtaggtttttggttctaaaaaacccccaaataggtgctaaaaatgggaaaataggtgccaaaaagttagaaaagttgaaaagtaagacctctagcaaaggaaaactttcgtaagaaaagcttgatgtagtagaaatattatttttaattgaattagtattttttgaagaaattgctttgaggtctggtacaat

SEQ ID NO: 28626 - DNA, 1021 bp, Heterodera glycines
cctctgctcgtcgatccttcgcttcgcgtccatttgtcttggccattatctcagcgctccatcgccaataaaattgctgctttaagtgccatcggaagaaaaggaatttgcatcttttctcttcccctcctgatgtccctccggccctcttctgctcttcatttcctacaattggatgactgcgtctcttccgcccgttttcccttctctcctgctgatcatgtcgaacattaggcttcacttcaaccaaacccctattataccccacccaattagggaaatgaattctattttgttaattatttccctatcaatcgttttagcccatttgaaatccaaatttgcttctgatcaccagccaatcacccgccattcttcgaaaaaacaaaaaaccgcgcacgcccattcaggtttaggcgtaaacccccaatttcctgccaatcctcacatgcaaacccaaagtcatttttccagttccccaacttcgcactgtcccctgaccacgcactgttccctgcccaccaatcaaacaagcttcgaaaagccccgtcgactgccctccccaaagtgccattcaggaattgtcttctgcccaaaggtcagagaaacataacaatgtttggcgaattttggtacaactaattttctgcctcagttaaactcacatcagcaggttttgcaccccatctcatttatgtctgtttgatcactatcacttgatcttccaatggtttctatcgtacattttcggcctcacaaatttgttcctcgttttctatcatacaatttttccatcgcaaattcattcatcgttctcctcgtttattttcgtacatttcagcaacactattagtacatttttggcatcataaattcgttttgcgttcgtttcgcatattttcagcaaaaaactaattcgttcctatttttcgtatcaattcaaaaacaatttgttattttctttctccacatttttgtactaattcaaatcaattcgccaattcgcactacattttcggac

SEQ ID NO: 28627 - DNA, 958 bp, Heterodera glycines
  misc_feature (850)..(850): n is a, c, g, or t
aaatcagcagagaaagaaaagaaaaaaatttggccatctttccctcttaaggcataaaagcacaaatgacaagcaataattgtaaaagcccaaattgattaataaaaacattttcccaccaatttgccgctttttcgcccgccaatcgagtgcagttcagccgcgtctgttgccccgcgccgatcccaataacctgaacatgaaactggtcaactgctaattcaatgataaaagcattttcgggcattttcactaatggcactttgccaatgccattcttttcgcgccctttcaaattgcttttgtttgactgatcattgacctgtcctcggtgcgcaaagcacaccgcgttgctttgtgcgtattttaccgcaacacaggcgacctgaaaaagcgtagaaaaatttttgacggttattggcattttgattcactttccctaaaaattcaccagcaaatcgtccaccgtcgaagcagtgatttcgtcgccgtctccgaccgcaacatcggcgaatgattctgcggagagaggcgccgcgttgcgcttttgcttcagcttcagaccaaaaactgtgcgaacttcgtcctctgccggcaaatatttggggtcaatctgaggagggggcggggagagaaacatatcgccaaagggcgccaatttaaaaaaaagaacggacggaggaaaattggcaagagaatgaatgaatgcacgcacaccttcagcaccacgtagttgccgttcttcttcttggccaacatggacagcgccgcatcgtcaaagtctggcgcaatgactccgtcgctgacttcgcggttgataatgcgcgcggtcagctcatcacagcgttgngacagagcgatgaaatcgctgaaggtggacatccgatcggcgcctgggggaaaacgcgcaaaaataataaacggaagaaaacggcacaatcaaaaacaaacaacaaaa

SEQ ID NO: 28628 - DNA, 186 bp, Heterodera glycines
tgccggccgcgccgccccagaagaagtcgcccgtgctgccgggaatcaacgtggcggcttgcgagatcgtggtcgcgaaccccagtccgaatccgacgccgtcatacgcggcctcgctaaacatcgaaggtgacgacaggctggacatgtcgcgcccgcccggcaggtggttggcggtcatcagcg

SEQ ID NO: 28629 - DNA, 196 bp, Heterodera glycines
aaggaggtaatatggttatatagagaataaggggataaagaaggaaagaagatgtgagtaaaaggttaggaaaaggggaggaaatgtaaaaaggaagtgttgatggggttttttgataggttgtgttttgatgatgagaataagaaaaattgatgattaagtaagaggtggagaaatgtgataggagtataaagat

SEQ ID NO: 28630 - DNA, 952 bp, Heterodera glycines
ttaaaaaattgaaatttcaacaaaaatggcaataatttggggggggggggaattcctccctcccgaaaagtttaggctagtttttgaaaaatttaagaaattttcttctcaaattgcttaaattttccaaaaaaaaaattttttccctgcggccttaacagcattgcaggacctccattttacaaaatttttagcaaatttaattgcaattttggcattaattctcgagaaatatgtaactgtaggtagagatttttccctgaacatgttttttcaatacaaaatatcttagaaaaactgaaaatttttttgagtttgagaattttcagtaaatttactattggaaattttttttttattaaataataaattcgaaaaaatttttaattattttagaaaaagaaataggcgttatttttccgctaccaaacaaattatttgtgaattaaaaaatttttcatataattatttattactctttgataaattttcttttaaaaaataatgaataaaattaattttttttattaaaaaattcgtaattagctgtaaatgcttttgttcatttattaaaccaaaccatcaacagtttttctcctcatttttacaaattacacattaatccaattaattgttgttctccattaattccgcgacatacattatcccgtccaatactttacgaattacacaaaaaacttccaattttcccccgattaatttgttttgccaattaattagagtaattagtaactattttgtcgccaaatgttcgttccaaaaattggttttaaatgattccgacagctttcatttccccgttctcattttttgcttttcaaatttatttttatagacattatttaacatcatcattttaagaaccgagtgctgatttgtgagcacatcagctgtttatggccacttttcatctcgcattttttctgcatca

SEQ ID NO: 28631 - DNA, 862 bp, Heterodera glycines
tagactttacaagttgagcagccatagaatgaattgatgatcattggtcaccggccagtgataaaaaatttttaaattagtttaaaaaaaacagttaactttttatttataaaagctcaaagaaattttctaagcttcagagattttttgaaaatttttgtagaaaattcagtggtaatagtgttctttgtccccaccccatccaccgtttttggtaataccggagaatctgtactcgatataagaaagctatttctgaaatattcagtatccccataaatctgggcgtatcgattcggggggactgccccgaaaacaaaaataaatcgattttttcaagtgtccgtttggggtactcaaacaaatatggggagcaacaatccatcgcataattaaagtacaggctatagggaatctattccggaatgattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatatgggagcatcgattcagggggactgcccctaaaacccaaaaaaaaattttttgtataaaaattatttaaatgaactgactatataatatttaaaataggttatttctcttcctttcagtatccctgcaaagctaggcgcgcttctgatcagattctgaaaaaaaagttaagactaaactttatgtcctgtttacaatggaattaaaaatttttaaaaattttattcatctttcgaggggactgccccgaa

SEQ ID NO: 28632 - DNA, 1391 bp, Heterodera glycines
cgtttttgggtttttcatctggttacgcggcttttttttggaaagaatttctccagcaattaggacgatcttaattcttcgccttaatcagctattacgaacaattaagtgggacacgagcgaagtccgttctttctatatctttttccgggttataatttattaattcagttccctccgtccgaccttctcgacgagattaaacaacgctcggattttctcgccaactcgccaaaaatactcgcaaaacaacgagccgaatacatttccctttcccggcctgctgaccttcgcgtcgtgcttaacagactcttgcgcactttcaatatccgtcagattttgagttttaaaattttaagtgggcctttgattgaaatcgttttctaaattacacaatttatttactttactataatcattcactttaaaataaaaattatagcggaggaatatgtcaaattatgcttcgaactgagcaattgtgcggcacaaagtttgggcgccgattggctaaaatcgtcggataagcaattcctgcgtctgttggccagtctctccagtggtcgtcttcgcattttgttggataaacctgaggaggtctctttttatactacgattctttaattgtcgacgtttaatttctcagattgacatggctcagctcatcgcctgtcttcagctccaggaatatttttgcggctgtgttgaggatgaacagatttggatgagcgacgatgagcaagtttttctgtcatttatgaagcgagttgataaaactgtcgaaagtagtcccccacctttcttcgtaaaaaaacaacatataaaacagaaaaattcagttttcaataaaatttcacatttatgctgcaaagcaattcaatgattattggcactaacaaaattgagaaatatgcaaccgaaaggggtgggggctacaccataggcactgttaccgaacataggtgaacaaggggtgcaccagggcgaggccgattggcgcagggtgtgtgtgccaggaccaatttttcgtacgaaggcccccaattttctccagcggcgacctttttttttttgctattcaaaccaccttttttgcggcgcgctttttccaagaaacttttggggaagggggtggcccccttacaacgaacgagggggggggggggggagtgtgccaggcctcttacgacgaggggttgtgtgccggcacaccccttgttcacctatgttaccgaaagttcaattaattcttatggttattctttttcagtgccactttcgtttccaaatgctgtcaagaagcagcagcctttgtctgttcttacacagccgcttgtgcccatcaattgtccgacatcacttcgcaaatggatcttttctttgtcctttat

SEQ ID NO: 28633 - DNA, 1330 bp, Heterodera glycines
aaattaaataaacaattcgaaatagggtttgggaatttgacctcaaacatacgggaataagataaagcttcagaatcaaagccctgaaagtggttactgaaacaaaagcgccggtttttctaaaagtcaaaaagcccgagatttttactagccgagactctcgagcacgaaggtcttataataaagtctttcatttttattttcaattttcctttttgttctctaggtttagtatgactataataaattcaaaagtcattaaattaatacaaatgccacttttttcgtggagtggcttctggcattctttgatgaaaccattaatacggcacagacgcgtgaatgttcatattggggttgtcatcctcttccctaagcatatgataaagtgcatttattgttatattccaaacaaaaatttaaaaaaaaaaatttcggcggcgaaattaagtcccggcaaaatttttggatgcaccagagtggacataggaaaaacaaaattctttagaatttcaaaaaaaaattttaacaggcagcgccgaacccccaaattccctagatattactagatcgaaacataaaaattgtggtttttgtcttgaaaacggcttaaaatttttgtctttattcaatgtaattttgactaattttctactgtaaaaacgacaagcttcactataaattggtttttaaattcgattacccattttatccaaaatgtttataatttttttttaatttttcggggggaaccgtaatgcaccccaaaatatttgctaaaaataaacaaaaatgttttttaatttaaaaaatatgataatttatttaaaaaaatgttttgttaaaattaagaatttctcttttactttattttcatgatctcatcaaaaaaaaatttgaaacttttttcttcaacaaacttttttaaatttttttgttttaagacatttttctttacaaatttttatggaataagcaaaaacatatgccaaaactaccaaatcgaaaattttagcggtgaaaataaaggttatctgcaaaaaaatatactaaaaaataacaataaccccccccccccccacattgtcagatgactacgacgagttggactttagcgtgttctctctgctatttgatataattgtatgcgcctaaaattttataaaaaattcatatgcatttcccacttctctccgctatcctccccctcatgtatttcctgaaaaatccttccgtattgtcaacttaattaataacaaatcttaaaaataacgacaaatgcacaacccatgggattatttatcattagggtatggaatatatattacat

SEQ ID NO: 28634 - DNA, 982 bp, Heterodera glycines
ccttaaaagatttcaactttaaaagtttcaaaaaatattcggcaattgtttggaaattaccaaaaaatttggtaatgcacaataaattttgaagaaattgatagaaaaatactttttttttaaaaaaaaattttcgacggggggagtttcccgaaacaggaaaatgaaagattccagccaatattgttcgagtttttttttgccgtgttctttagtgtttttcccccatggggaaggcgtatgttccccgagtgcgttgtgcaccctccttttcaattaatttggatcagattttcaccaaaaaaggccgattttgggattttgagccaattgactacgaccatttttgacaaaaattttttggttttaaaatttataatttttaagaaaaaaaaaatggattttaagggtccggcggcagtgtctgtaggcaccgtcgtggaaatttttttttgttattttaaataatttgcgctaaggaaatttgttcaaattttgaaattatgtttagcctatgtcggtatgacatgagtaagagaattgagcattcaaaaatttagccattttacttttaaaatttcatttttttgggggggggggggaggaggaggtgaaattcgctgccctttcccccagtgattattggtgtgttctgtgtccacaaagtgccaacctccaaaaagtcgggatggctttgcgcgagcagccgattttgcctgccccgcaacttgtccgccttgctcaggggccttggttctgaaaacaatattaatgtagaaccatgggtacttatatggttcgtacgccacaaattttaaattttttttaatcatcttagattgcttagagtcatttatatggttttcagggtcgctgaacacgattataacatatatttagaccaatttcgaaccccggaaacggattcgacctaaagtcgaaatcccccaagaagtcgaaaattcaaactttttcaacaata

SEQ ID NO: 28635 - DNA, 953 bp, Heterodera glycines
  misc_feature (910)..(910): n is a, c, g, or t
  misc_feature (933)..(933): n is a, c, g, or t
atttttttcatttcaattgggacaacaaaaaaaacttattttcattttaaatgtctgataagaatcacttaatattagcccttttaattcatatttcagttgatatgaatatttcattgtgtattcttcagaatcagcaatcggtttgagcattctttcttcgtcatattttaccaattttaataattctaagtttttttcaattaattattaaaattaaattaattgctttttaaataaattctagtttgaattgttttgtttttttgttttctaattttgattcagcctcctttttagatgaagttccttctacaattactttatgtaataaaaataattacattttatgactgttgagccggttaattgctcaaacaataatttagaaaagtcgaacaccaaataaatttattaacacaaaaatggaaaataaataaaacaatatttgtcggaggaatggagcagaactgggaacatagaaggaaggaaaacacaatgaatgatggactaagggaagggaatgcaataaaggggaacaatcaataattggggtcaaagatccaaagagagggaattacaaatatttgaataatttgcctctctaacaatgacgaattaagaaaaatcttttattatcattttaattttaaattaaatgtgaaaaaacgttttttctattttttcattctattcttgtaatatttcttcaatttattccggtcccgtacgggtcaaattatctaagcccggtcccggttcttttcaaaattccgggctctattaggtatttcaaagggattgatattgaatttttgtatatatttataaatagaattttatcttgatttttctttttgtggcagtggaattgaataatggacgtaattgattctatttccatgacttncactatctttttcattataattntatatggcatttactgatgg

SEQ ID NO: 28636 - DNA, 1177 bp, Heterodera glycines
  misc_feature (1051)..(1051): n is a, c, g, or t
aataattttgaaatttgatgcaattaaagaaaagttgaaggaaaaaataaaatacaaaaagaaagattatgacaaaattgaaagaaaaattgcaaaattattaggagcaaatctgcaattaatacaaaaatggaaaaatgaattaaatttaaataaaaacaaaattaaaaaacaattatatgatgagaaaaagagtgaattcattgaacgatttgatgaatttaaaagtttatatgcccatggcaaacagaaagaatttgcgaaggaattgggcatttctgaagtgacattttggaaatggaaaaaacaaatgctgccaaatgatcataaaagtaagggtttttctttttaaacatataataattttctattcagaagagaacaaattaagaaagttgaagcaatattacgaaattaaagaatcaaatccgaaaatgagcgacgaaataattgccaaaaaattgggaattggaagtgcaactctgaaaaaatggaaaaaggaatttgtttaaaaactgatcttttgttcttggaaaaaaatgttcgaaattttgtcatttggagaaaatctatataaaaattattctttgtttcgaaaacattttgcacttttcgtataaataaagaatgttgcataaagacgtgtcttctgttgtttagggatgtgcgagaaatgatttatttgatgagtttcgcccggttatgatctgtgccgtggacctctccatcattctgtagagaaaaactaaaaaatatacttaggaaaaaatcttattcgaacaaaaattgttgtgttttttgcagttttttttttaaacttttgcaccgcgtttttggttttggatgtaaactgaaactttaatttcactgcaaattttcttctttcattttataaggattatacctatttgcacacatcaacaaatgaaaacaagaaacaaataatatatatttaatgtttgagatgaaatttcttacattttacgaccgatatttctcaattattattatttttataatttagagaaattagaaaattggtttgccttanaatcgggttatctttataaaaaaacaagatatttttgtttttctttttgacaaaaaattgaaatatataaaaatggatacgacaaaatcaaaccaaattttgatggaatatttggccggggatggg

SEQ ID NO: 28637 - DNA, 1257 bp, Heterodera glycines
  misc_feature (8)..(9): n is a, c, g, or t
  misc_feature (61)..(61): n is a, c, g, or t
  misc_feature (94)..(94): n is a, c, g, or t
gctccctnntatgaacatcccttgccatcgacccacttgcccgcgccgccctccattcttnggggtttaatcgattcaaatttttgactcttcncctcccattttttgacgcatggaaatacggaaaataataacgaaaaaaaagattcatataattttcctttaattttatttgaacctatttttttcctatcgtactctattttttatttaatttcacaaattttaaacgttgcttaggatagggctttctctttcaaataaattattattgtttttgttggctatttcctcccgcctccgcgctgctgcgcaatgattgcgcaaagagattaatgatgaacgaatcattagtataacgtactcaaatttaaataccacatacagatccaattttttgtttaatttccaccgtataattcgtcaatccccttttccctccaccatataatcgattcgtcattaaccagcccccactccctcccgcccagcaggtctcgcctcggcgaaaaaatgcatacattgattactaacaaaattaaactacctaaattgtttaccataatgaaaggtcaccatttctggtaggtttttcggtcaaatagttgttattttttcgattgagcataaaatggatgtaattttatgcaagttacctgaaagtccttcatagaaatggatgaaaaatatccaaaggctgtgataataaaacaggaaagaaaatatttgaaagctgtgaaaaagaggcgaaaatatatctcgaggtaatgaaaaaatgagaatttgtgtaatgctcaaaaggcatgatagtaacaggaattatgggtgaaaatggatgaaaaaatgtgaaatctgtatcattgtataatgagataattaacgatattatgtttaccaattgtgataataaggtaatgaaattaagtgaaaatgctgtcaaaacaggtgaaaaagtcaacatgtcaatgtgaaaaaacataagaactcaaaaaaactcaaagcaggtgaaaaaagggcagaacaggtgaaaaatattgtcatagcaggtgaaaaaaaagggcagaacatgtgaaaaaatgtcatagcaagtgaaaaaagggcagaacagttgaaaaatattgtcatagcaggtgaaaaaagggcagaacaggtgaaaaatattgtcatagcaggtgaaaaaaagggcagaacaggtgaaaaatattgtcatagccggtgaaaaagggcagaacaggtgaaaaataatatgcaacatgt

SEQ ID NO: 28638 - DNA, 1372 bp, Heterodera glycines
cacagaacagtgcggccgggggagccaactttttggtctttttgggtcacgcttttgatcgactttttggcagccttcggtttttggtcgtccgccgattggcgttccgcccaattgttcttcggccctctcccaaatggcttcttccggtgcttctcctctgtcctactccaaccctgacgagtcgctaactccgtcctccaccaatgcgtccacaccaacggccacaaatggggcgacaacaattgtagggggacaaccgcacaacggcacaagcagcaacatgggcaatggaacagcaatgcttcaggggaatttcgaagtaattggcagtgccggcggaattgcgcactttgcgagcagtgccggcggagagtcgaactgctcgagcagttcaagttcagtggttgtgcacaagggaaagaaaagcaaaaaggacaagtcggtgagaaaagggagggaagggatccatgggaaaggcattccccggggacaaaatcgaaatgcaatcagtgagtgatttggcaggcacagcgagtgcggacagtgcttaaccagaatcagctgaggatactgaagcagacataccaagggaaccaaaggccggacacgaacaccaaagagcagttggtggagatgaccggactaaacgcgcgagtgatccgcgtttggtttcagaacaaacgctgcaaggacaaaaagtgagtaggcgaaaagtgccgagaatttccatggcattggcacttttaaaccgttgggccaacaaatgctgttaatgaaattctattccaagggttttcagaaggcaaattgaacagcgcgagaagcagcaaagtcaggaaaaggttggtgaaagtgtctccccccccccccaattgaggcggcggtcggtcggctcatttttctctcgcgcccgacgattgttttgttttcttttcctttgtttttgactgtccgccgccccgtgccaattccatcgcatttcattcattcatctcctctcaattctctcattcattctctcatcccattcattttcattggttcggttcactgattccttcggccattggtgaatttctgcgataatttgattattaatggacggcggtggaagcccaatttctcccactcttccgcctttaccctttcatcggcgccaccaattaggcgccatttgcgccgcccaaaaattatgtccgaattggaggagggggggggggggtgagaggaggtgtaatgggagcggagaggaaggaaatgggaacaagaatacatccaggatgaggagaagaaggaggaggaggaaaaaatgagttggtaagagggagaggagaagaaatgcaggggatggatgtaagtgaaagaggag

SEQ ID NO: 28639 - DNA, 2192 bp, Heterodera glycines
  misc_feature (666)..(666): n is a, c, g, or t
  misc_feature (693)..(693): n is a, c, g, or t
  misc_feature (716)..(716): n is a, c, g, or t
  misc_feature (727)..(727): n is a, c, g, or t
aattctgaaatagttaaacggaaacggttttaaataccaacgtaaattctgaaaatagtcggtataaaaatattaacaaaattctggaagcaattaacgaaaaccgttttaaaattttaacgaaatttttggaaatagtaaaatgaaacggtttgaaatattaaaaaaattctggaatagttaaacggaaacggtattaaaatatttacgaaaattctgaaaattgttaaatgaaaacggtttaaaatattaacgaaaattctggaacagttaaatgtaacgttttaaaacattaacaaaattctggaaacagttagaaacgtttttaacgaaaattctggaaattgttaaatgaaaacggtttaaaatattaacaaaattcttaaatagttaaaaggaaacggtttaaaactttaaatattaacaaacttctggagcaattaaacgaaaaccgttttaaattttaacgaaatttctggaaatagtaaattggaacggtttgaaatattaacaaagttctggaatagttaaggtattaaaatatacgaaaattctggaaatagttaaatggaaacggtttaaaacttcaacgaaaattctggaaatagttatcagaacataggtcccaaaaaagcagtttgccacaaattttattttttcttgtanaatggtgacattaatctataaaatttncaaattatgagtatttttatganatcagaaacanatttggtcactattttattgattcatattattctgacattaatcctataattatatttatccattcaatttttacagtaaattattattcttgtatcaatgaggtatttcatcaattgctctccttcaccgaatttttgcaattcgttaatcctaaatttgcgaatagttttagcataaatatgaaaaaatcttaaaaaatcatattgtataatatgaagtaaacgaattaaaagaaatcttcaaaaaattttaaaaaaattaacatttttattattttctattaacaagtaaatttaaatttcttttctatgaaatacaaacaatcaaagtatttaaattttaaatatttatgaatattttcataccaaaaaattaatatcatcaatttaaatgcaatattttacccataagctctataattcaaaaagtagtcatggagcaacaaacgggatgagacgatcgaaaatctgcacggaataaagcgcgcgaccgcaataggcaccacacgatagcaaaacgacagagttgaatatataaataaatgaaatttttaacgattaaaaattcattatcaggaaaatgagtgtgaaacttacaactttaaattaaattaatcctatttttgatataaattatgatacaaaaagaatttttgttacaccgacacggtctcaaataaaacaattttgttttatttttcgaattaaaaatttcaaaacgttatcgtaataaaaaaatatttaaagttaaaccacattggtactattgaatataagaattgttgtttagtctttaaaaacttcaaagatactttaaaatttattatgcaataaagaaagaaaagataatttatatgtattttttatgcgttacatcaaattaaataaaaattactttgatgaaaataaagataatctaatatcttcacttatttagatgcattaatattcatgatgtttaatactgcgagattatataaaatagaataaaatcactaactaataattttatcctaaactcaaaatttattttaaattaattttccaaattttctaataaaaagcatctttttcttatattaaaaaatgtagcataaatatcatttatcgcgttaatgatattaccgtttcttactgctgaagaaatttataagtcagttaaaagatacaaacattttttcctaaaaataatgaaatatttatttaaacaaaaatgcgatagacaatcattaactatataaattaggctagaagacgaatgattgtagaaaatgaagttattattcattattaatcgatataaaaatattttttaaaataactaataatttatcaaaagcttcaaatttaattttaaactatagtttttaacgcttacagctcagaacgaacagctcaataaaaatagatataaacgctttaaaggtaaattatttatagaaaatatcggttaatgttttctta

SEQ ID NO: 28640 - DNA, 1301 bp, Heterodera glycines
ctgtgcatgagtgcgggaagtgggagggaattgttcattgtcagtctcagttggtggtgaagaaatggaaaaatgaatgggggggggggggggaaagaaaagcacggggggaatgattcatcttcaacactttcccacaccattcactcatccagcacccacaacaaacgtgaataatatgcgggaggagatgaatggcgatgataggagagggtaaaatgtacgaatgaacaaggaatttgtggtctgatggggtacaggttggacatgtgcaaattagggaagggggaaaggaggagtccttaaggaaaatgccaaaaaaagaagccaaaaatggcattctctccccccccccttgctcggccaattttacgtagtacgagcggaaggtgatcatttggtcggacaattggataagtggactgttcatggtcaaaagtgcaacatatgtccatgggcatggacaaaggcgaagcgactcaatgaccgaccaactcattaatataattgcagaaaaaaattctattgagcacctgaacaataccaattggtggacagcagcaggacaacacattgttcaatgtgtgtgaattggaatggaataatggagaatcggcaattggttgttgggtgggtaaatgaataaatgaatgaatgaaaagaatggggaatatgtaatgattgatgacgacgatgcactcactgaactgagagggaaatggacgagaaaaaagttaacaaacatttaatgaaaatgatttaactgtggttcgcaaaagatatccagaaatagagagtgatttccttcagctaactgcatacgacagagaagctgattccaaatgttattgttgtacagtagccgtcaatattctgactattctagctctccgtagcaaatgtcacaataatttgttgcatattgcctattgacattgcatgatcgcaatggcaataagtgatgtgttattgccttgccctcttgcagataattgacatatatgcagcagcgttccgcttgattggcgggttcgtgcactcaatacaacttggagcgaatatcccactttcatatgacacatctccagtctgagttatgagtaatgcttctctcaatccaataggcagaaaggcttacaggtgtgcggtaaacagcgggatgaaaacaggagagcgcgagagggaagttacagagagaagcacactggtgatggatatagtcatatgagatatagacgcatatgagaggagcgtggatttttgagagagtcatcagagggagagagcgaaaggaaaaacga

SEQ ID NO: 28641 - DNA, 992 bp, Heterodera glycines
tattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttttgggcagtcccccccaaccgatgcgcccagatttatgggggggaccgaatccttcccggaatagtttccctatagcctgtacttttattctgcggtggattttttgctccccc

SEQ ID NO: 28642 - DNA, 2251 bp, Heterodera glycines
  misc_feature (485)..(485): n is a, c, g, or t
  misc_feature (489)..(489): n is a, c, g, or t
  misc_feature (494)..(494): n is a, c, g, or t
  misc_feature (508)..(509): n is a, c, g, or t
  misc_feature (534)..(534): n is a, c, g, or t
  misc_feature (541)..(541): n is a, c, g, or t
gtgagtcgcgagcccatgaaccgccaatagggcaattagatgctcgatgcccagctaagccacaccgccagcagcaaaaaacttcatcactctgggggtttggaggcaccccttgcggttgctgtgcaatcagctccacaattcctggcgcaattggatattcctcatcagactaaagacgtcaagaattgtcgcaaaattttaactaagacctcctgatcttggtgcgccccctcttcaaaatagacgtcccacaaacccaataaatccatatcttaatttacgtttcttatcaaataaatatttaataaaaacctcccaaatattcttggagtgaaaactccgcagaaccactgccaaaagcaatgttccaaatcgcggcgatcagctgcgctctccgcagaattcgcccttgctcatcttcgccaagaatgttgaagtctggaaaacagttggagcaggtcgatcggtcagtccggtcaggnttcnaatcnttttaccaaggggnnacgggtccccaagggaattttgggncttgggngggggggggggaaaccttccccccccgggtggggaacgaaaccctttttttttttttttttttttttttttggcctttttttccccaacccccgggtttttttttttaatggggggggccggcggggggttttttttttccccaaaaaaaaaaaaaaaaaattttttttgggggggggaaaaaaggggggggggggcccccccccgggcgggggtggcccccactaaaaaaaaaatggagggcccccccccccccccccccgggggagaaaaaaaaaaaaaaatatttttttttttttgggggggggggggggttttttttataaaaaaaaaaggggggggcggggggtggtttgtttgttgttaaaaaaaaaacaaaaaataatatttttttttttttttttccccccaaaaaaaaaaaaaaaaaaaaaaagaggcacaacccaccaaaaaaaatttttttttttttttgggggggggggttttttttttttttttttggggggggcgccccccacttcttttttttttttttttttttttattgagaaaaaaaaaaaaaaattatttttttttttttttttttttttaattttaaaataaaaaaaaaaaaaaaaaaaaaaaaaaaaaaataattttttttttttttttttttttttgggtggagaaaaaattgtttttgggggtgttgttcccaaaaaaaaaaaaaaaaaaatattttttttttttttaaaaaaaaaaatttttttttttgtggaaggtgtgtataaaaaaaaaaaaaaaaaaaattaataaaaaaaatttttttttttttttttttttttttttttttttttaaagaaaaatttttttattattttttttttaaaaaaaaaaagggccccttttttttttttttttttctttttttcccccatttttttggttaaaaaaaatattatatttaaaggggaaaaaaaaattttttttttttttttttggtttttaacaagaaattttttttatttgccccttttggccaaaaggtttataaaaaattttttaaaaaaatatttcgccaaaaaaaataaaatttttttgggggggaaaaattttcaatttttttaaaataaacccaaaaaaagccatttttttataaatttaaaaggaaaaatttttttttttttttataatggatagaatttattttaattggttttttttaaaccccatcaaaattttagttaattaaaaaatttcaagtttaaatagttaataaaatccaaaaaattgcataaaagaaaaagcaaaaaaattgtaatattatttcattttaaaaatttttatatagagagtatccgcatagaaaaaccaatatcatggaaatattattgaaatattttaggatattaatgttacaaatttattttatagattttttcctttataaattgttataaattcattaggttattttaaataagctattttaattttctatatttataaagggtagaattagaatttctcttaataaaaaaactaataaaccctaagtttggtctttttatattaatgatgatttatatatttaaatatatttatttaacagattttttggtatatataaaaacatgaatatagattatagataaattgaaaaaatatataatattgatttttggaatataaatttaaaaaaattaaaaacttaataaaaacctaattcctc

SEQ ID NO: 28643 - DNA, 795 bp, Heterodera glycines
atagaagccaagaattttttttttttgttgattttttgggtctcgaactgggctgtgcgcaatcggattttgactgcgcgcaagccgcaattgcagcccttgaaaaaatccgcaacacgcaatggcgtgaagccttgctggttttcgaatcacaaccctcagtccgcttcctggaggtgatatttttactaacgagcagagcaattaacctctaacaaaagccatagatgcaatcggccgaacactttaaaattttttaaaaaattttcagggggcggaaacgataagagtagaaacggcgggggcgggaatggtaatttttttcaatttttcttgaagttatgaaaaattttagtttttggaaaacgatacggggggggagaacaagctgcttcaataaaatgtaaattgaaatttaaaaaaaaatagacgctggaattgcttacaatttgtacatattacacttaatgggatggatgatgtgatgaataaatgagtgttttgagtagtgatcagcggcggatgggcgaagaaaatggccggcggtggaagaagggggggggcggaaatgatcggccggcagcagaacaacggacacaataaattgaattaggtaaagtatgtctgtcttccgcccatccggacgtccattttttcgcgacgacgatttgctgaatttatgttgttgttgtactgctcccgacggtgttctcgcggcggcggcgcatgggaatgacgcccgtcgcgcccaccgcacacccgccgcggtggcggtggcggtggcgcgggcacccc

SEQ ID NO: 28644 - DNA, 1389 bp, Heterodera glycines
  misc_feature (199)..(199): n is a, c, g, or t
  misc_feature (414)..(414): n is a, c, g, or t
  misc_feature (416)..(416): n is a, c, g, or t
  misc_feature (428)..(429): n is a, c, g, or t
  misc_feature (432)..(432): n is a, c, g, or t
  misc_feature (437)..(438): n is a, c, g, or t
  misc_feature (445)..(445): n is a, c, g, or t
  misc_feature (449)..(450): n is a, c, g, or t
  misc_feature (479)..(479): n is a, c, g, or t
  misc_feature (654)..(654): n is a, c, g, or t
tttttttttttttttttcccccccccgggggggggggggggggggggggggggggggggggggggtgttcttttttttttaaaaaaaaaaaaaaaaaaaaaaaaaaaaaaaaacaacacccacccccccccccccccccccccccccccccccccccccccccccccccccccccaccaccaaatatattttttttttngtactttttttaattttttcaccgggttgggaaaaaacgcttttaaaaaaaccactgcaaaaaagagcttggatagagttggggatttttttttttttttttaaaccccgcggggcggaaaaaaaaaaaaaaaatatcccccccccccccccccccctctattgaggccggaaaaaaaaaaaaaaaaaaccccccccccccgccccccccagatncngttatggatgannccngacanngaatttngatnnaaaaaccatggacctccagcccctgtgtnttaaccatatatgaaccgaatcctaacaggctcttggtcctccattcgggtccaccattcccactgaaaaggggttgaaaaaattggtgcctttaattactatgcaaattgatgagaagaaatgccagatccgcctaccactaccctcccccctcccctctctttcccgtgaacnttgaatgtttgaagtgttaattatctctttcaatttttttttttttgtatctgctgaaaacccatttgtcttctcttcttctctagttcatttgtaacacacgcacaacaaaagtcaaagtgaaaaaatatatatgtaattattttattatgtctcaacatttttcatctgaattatttatggcaataaaaaatgtttgttttttttttttgtctgattttttcgttgaaaataattcttttttttattgccattcattgttcaccaaaagctgtattttcttataaatgttcgtttgaaattttttttattgactaaagaacaaatattatacattttttcattaatcgattagtgaatttgttaaatggtcgtagaaaactttttatttgttagttagcggacagtgccgtttctgcgccaagaattctttttgctagaccatcaaattttcataaatctgtatcattcgaacgagaggttgattgttcggtaatagttcagtttgtcccctccccctttttcgaaattttttttttgtgtgtttcaaaagtcatgaaaacatgtttccaaggcttttcggggtcgttgatcacgaatccggcacccatttcgactaatttcgaacctcagacccgaattcgaacaaaaagtcaaaaattcaaatttcgattttcacatatttggtctaaaagtggctcaaatgatcttttattgaagctaatgtcgaatttc

SEQ ID NO: 28645 - DNA, 1349 bp, Heterodera glycines
caatccattcgccccatcaccatcacatcccaatctgctgtctccctcccttttgccgttcaattcgcctcgtcatctcgtcccaatgccgcttcacgttcctgcttcctttccgcgcccacctctccaaacattttttccacgtccaccccccccattgccatgtcctcagccgttctccacgtcaaatcagcaattttcaaatgtttgtccgacgccattaatcagccatacctttagcgccgataaattcacgtaatttcaatgattcacatattttttataatataattatttcaatttaagcaccatcaaaaaaacgacaaataattgaggacagagcgggtaatctattaatggaaagaaattgctaacaaataattttgataaaaaaagcaaactaattccttatatttagaacgctggcgctgcggaacttatcgaagcatacgccgggatgaacgacgaccggacaaacagcactacggagttttggctgaccgaaatgggcgctgtgttgaataccgagcatcctcaagacgcatgaccgacgacaaaaacaaggccgaccgggaccgacgttcaagaaaaggtccgttgaaaattcgcaaaatttttttgtatttaataattttaaaaatttttgaataacctaattaatctcaatcgtttttttcccattttaataggaccgatcggaaatgctgatgacaaaaacaaggccgaccgggacgaacgtttaagaaaaggtccgttgaaaatatgcaaataaatttgaattggataataattttaaaaattttttaataaacaaattaatctgttgtttttttcaccttttaataggaccgaccggaaatttcgaggacaaaaacatgaccgatcaaaacaaggatggacgttcgaaaaaaggtccaccgaaaatatgcaaaaaaatttgaatttgataataatttaaaaattttttaataaacaaattaatctgttgtttttttcaccttttaataggaccgaccggaaatttcgaggacaaaaacaaggccgatcataatcgggacgtacgatcacaaaaaggtcgctgaaaatttgcaaatctgtatttaataattttaaattttttggataaactaattaatttcaatcgttttttcccattttagtaggagcgatcggaaattctgaggacaaaaataagtctgatcataatcgggacgtacgatcacaaaaaggtcgctgaaaatttgcaaatctgtatttaataattttaaatttttcggataaactaattaatttcaatcgttttttccaaaagttagtaggagcgatcggaaattctgaggacaaaaaca

SEQ ID NO: 28646 - DNA, 1191 bp, Heterodera glycines
cgcaattcgtccgacactttcggtcgtgccagggaaacacctcctgcacagtcctccttggccacgtggtgggcacactttttgtggcaattgtatttgcaatctgtcggggacaattcgaatgatcggatgaacgatcgaaaaaacgaacgaacggcgaaggaacgccaattaatcacctcggcattggagtccttgccggatcagtcccttcagcagctttttgcagtgttggcacaccgtcggccgtttgtaactgtgcacttggaaagtgtggggcacctgagaaagaaaaaataaatcaaataaattaagaatttaaaactaaaaaagaaaaattatttaattaaggatttaatgcaaaaagtgagaaaaagcagggccattaaagtgttctgctacggatggccaagttttgttctgctgctggcagtgtttgcctttattctgatggcctccgccacttccatccaaaggggcctcccactccaactgctgctgcgatccttccgcggcatttgcagaaactgaaattggaaaacattcaatgaaaatttgaaaaaatgggagaataaaaaaggagggggaagaggaagaggaggaattcaaaggaaccccaattacgaaaggatggcgaatgcaaaatgaaaaagagaaaaataacggcacatgggttggggcagtccaagggagcaaaaaatggcgagagagagaaaagggagggaaaggggggggggggggggggcattcaccggttgcaatataaatcagtagggctgctaatatgtaaatacatatttttttcctggcttctccatggtctaaatagtaggaaaaacactttcttttctttgtttgcaaacaaaaatcgggacttttatttacatattttgggatttttctacatattacatatgtaaatattttatacatattttgactttttagtacatatttagcaattttttcgtacatatttatttttttttacatattttgggaatttttgagaatttataaaatttcttaagaaaattttgataattttttttgaaaatgtacctgaaatagaatatttttagtatttaaatttgtcatttttaacgtttttttattttatttgaagaaattatttttttgggtaaatattaaaaaatcgggtttttccaaaaacagaaatcaaaaattaat

SEQ ID NO: 28647 - DNA, 980 bp, Heterodera glycines
aaaatatttttttcattttttttttactttttgtcagccgccatttcagtcccatcactgctattgctaatgtttccgccgctgctgttgttatacggctgctgaacaaattgagcaactggccagaacaggtataaggcctgcatattttggatggcaaaattaaatataaatcgaaaaagaatatttaacttttaccaatgatcggccagccattccgatcagtgcgatggtgtatactatgtataggcatagcacattagcaatcagcagctgaaaccagttcaatatttttgtttaattgttacgaaaaaatgccaaaaaaatatattattaaaaatgcagaaaatttggaaataaactgaattaattagcaaacaaatttaattcaaatgtcattcattatttttattttttaataaaaaaattaaaaatgaaactttattgttttttttcaaaaaattgtctgattggaaaacagtaaatcgaacttttatgaacttttgtgctcaccatcaaattgccgtggaagataaagcgcgatcgttggcattgtcggatcagtgccgcaacaccgatcagaatggcaacgccgagggcacaatggacaaatcggatgatgttactcaacgggtccaaaatgatcgatgctccgtggttgcacacttgagcaattgaatattgggacatccttgaaatttttttgactattcggaggtatatgtaaactaaaaagaaaaaagtcatagattttctcatttccgatttacaaaacaaatttaagtgcactgggtttccagtttttagttgaaaaatttgtgcaaaattctcacaatgtgcaagaaaagcaaaaatgaaattatataatgccatttttactataaaatgttactttaaattgaggaaattaaggaaaattattggagggggcggggaggggggggaggtaagtttaaaaaaatccaagaacaaaaaaaaga

SEQ ID NO: 28648 - DNA, 1302 bp, Heterodera glycines
caaatctcaaagtgatgccaacttttggagggcgtcgcactgatcgcaatgaattgcgtcgcatttggccacactttgcgcaaaatgtcgtcgcaacgcatcgcgcggtcgccttccaacgtacatttggaacagcagccgaaaaacgactgccgggtgaggcgcgacggcaccgcgccgcacagtttgctgacagtgcccgacggcggtgccatcgcttcggatgaaagtgccgtggggcagcaaaacgcaacggcactttgggagggggacggagtggcgaagtcgaagacgaaaaagaacagtgttggcacaaacggcaccagtggaggcacccaaatcatcaaaaaatggggtaggaaaaatgggggggggggggagggcgcatccaaggacaaacttgggaattaatgaacccgttttcaattgctacaattaatagcgctgacaaattttgccaattcttccaaaatttttataaaattttgttattcggggcaaatgtaaacataaaatatggacaaatggacaatggacgaattgtcctaataaattttttgtttagaaaacacaaagaaaaggggcaaaagtgtcggaagtgaagtcaattcgaaagaaaatgaccaatgttcgaaggcggagactgaacgttttttcacgagacaaattcataaaataagtgcgaaaacagcgagaatttagtcattgaaaatatttattaaaaaagtgattaaattaacgggcgaaagaaaattcgtaaaaacaaaattccgtattgaatttggcaaataatcatcagaaatagaatagaaatgggaatttatttacaacaaaccaaaataattaaagaatttaaagcaacttaaaaattgaaaattatacatcctaatcataatgacttttatgatcaaccaaatcaacattatttttgtcatttgatcgaagtctaagtgttctctattaaatgctcaaaaattattaattttgaaaaaattacagataaaaatgttaagaaaaaagattttttaatcttacttaatttattttagttattttcttagctttgattttattcatagctcctcaacactttctttactcattttgtgctttttttattaattgtataaatataaatctttgtcggcatttgctttgaaatgcaaatgcttttcctttggcactgttttttcccatttatggcattcttttcttttttggcatttttgttttctaccctttgaagcacattcgctaaaaatggtttgggcatttttgcttctcccgcgctaattgtttttg

SEQ ID NO: 28649 - DNA, 893 bp, Heterodera glycines
cactttggcactgacaatgctttccgcaatccttggcattgtggtcaacgcggtgatggacttctcgtcgttgctgccaatcttctcgctgatggaacggcgtcttgattggtattccattttttggctctactacagttcatgtttctaagtgacttttacacttccaataaatcattatccgcagtttattaggccgtaaaattttttcttagttcgtcaatgccttagttcttgatatcaaattgaaagcttaaagtctataaaaagtttatggaattctttaggaaaaaagtcatggcctgagaaactgagcatggtcatttattggacgagtatattttgttttttcttgctttacatgtatacacttactaattgtaagatgtcaaagtattattcaaattggaggtgttttgcgagggacaacagaacagctcccctatctggtccttatttttaagtttttccttattcgcggggtaaaatttgttggaaaaattgggtaattaagaaaattagttttcggtcggggtggaagcgttgtgcaccattaagctttggctgcgctatcaattgcttttagaatgagaataacgcatgttttgttggttcattcattcgctcatatttcagcccttatggtcaccagtccgtcgcaccaaaatgagaacaaacgtttgggcttcatgtacgcttttgcctttttggtatctttttgttgatggactgtcgtaattttcgttttttccgaatgatgatttactgtttttccctttttttagtttggttgggaggttagttgattgagtatgtggggatcgatgatccgaccattgtatttcacgcgatcttcgtcaccatggtattggtttttttgttttatcaaaaaa

SEQ ID NO: 28650 - DNA, 1122 bp, Heterodera glycines
  misc_feature (10)..(10): n is a, c, g, or t
gtatggattntaagacgttaatagttggcccagttgggacttgctccattcggaaatggaatcaaacaaaggctgtccgaattctctcttcgaaattctcaactgttgtctcacccgtggagggacgaggacactgcgcacttaccttctgcaaccgtcggcttccgtggaaataatcaactcacgtctggacatagtgcaagaattggtcaaaaaccaagcggtgaattcttttttttgagtaattaaatcaaatttcaccgtttttttttaatcgtttttagatgtgcgacagaatacggtcaatcctttcgaatttgcacgaccttcagcaattggtttccttctgcacttacacaaacgttgaacaaagtgccaccaatcgtgaggaatcgaagcgagtaattcgcaacaaaataatccaagtcatttacggcctaatgtttttagcttaataataaatttgtttttaggttattgaacttaagcgacttttggaagcagtcaaaaaaatttcagaagtgataagccattcaaaatcaccattttttatccaaaacaaaaaggtaaattaaatttgctttcatttctgtcgatttcattttcatccaaatttaattggaaaaagttaatcaaaaatatgtacgcactttttaaaccttcagaaattggatgactgccgacttgatgcaatcgctgaatttgtaaacgataaaatttcatcggaattgaccacacgcaaaaggaagggtttggtcgcttcctcgtccaaagatcaaattctttttgccatcgccgagtcgcaacatgtgctgctcgacgtggccaggcgcacttaccaggaattggtcgcccgaatcgtcggtcaatgaatggcatttaaatccttttcattttatttcgaccttcagaatttggcacggctcatcagaaggaaatccctggcgcacagctgtgctattcgcagtcccgaggttaccacttcgcattgcacgccaacgacccgtacagcatcaatttaccatcgcattgtatccaagtcgtgttcaacaaggcatcgctgacattcaccaccagagacctgatcaaatacaacggtgggattattgaggtcctttggat

SEQ ID NO: 28651 - DNA, 1090 bp, Heterodera glycines
aaaaaattgattttttttttttcgggggccatcccccccgaacccgatccccctaaatttatggggaaccggaatccttggggaatagcttccctttaacctgttctttattttgcgtgggattttgaaagcttcactattttatttttttagcaaaattaattcataaaaatttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggat

SEQ ID NO: 28652 - DNA, 1596 bp, Heterodera glycines
  misc_feature (10)..(10): n is a, c, g, or t
  misc_feature (1564)..(1564): n is a, c, g, or t
aatttacttnttgccaatttcaatgccaaattcctttttccatttgcttaatgttgctctgttaatgcccaattctttcgcaaattgcttctgttttccatatttggacattcttttaatctcttcgattcgttcaataaattcctgttttttctttttataataataaattccaaattcttttttccattcgtaaatttttggtcgattaattcccaattttttcgcaattttttgctcggttttaacccaaaattttgccgaatattttccctttttcttaattccttctctaattgcatgaaatttgtgaataatttcgtttttttgttgaacatccaattgatctgtctgatcagttaattcattttgatcattttgatgaaaatttgcattttgatcagtctcattttcattttcatctcctccaattattatttcattttgccattcttcgccaaatatttcagcaaaagttggccgacattttttacacagattaactgacaatgttttgtcagttgaattgtttatgattaagaacacaaatataaaaaggagaaaaagcatcactaaaaaaagtataataaataattaattaataagtttttaatatttttaatatatatatttgtattaaaattaagctaatttatcgaaaaatatatttaaattttaatgaatgtggagaagcattgccaaaaaggcgatcaatagtaaataagattaaataattgtaagccatgaatttcatcataatttcacatgaaacaaataatatagtgaataaaattaaattatactaaaaaatttagacaaaagtcagcagttgaacagcaatacacaaataagaaaaacgaaaaatttaagaattatttctttttcccatatttctaaagtggtaattccaattttcaataatccgggcaatttttttgtcattttaaagaaggatttacttattcatttcataataatcattcattttgctccttttttcatcatgataaatcgaattggacgtatgaataataaaatttgaaataaaaaaggtacttttcgagttatcagggcctatgttgtatgtaggtttttattaagagctaaaaaagtaaaaaattttgaaaaatcatatttctgcctattttggcgtttcgaccaaaattattaagaaaaatgcaataaataagaaaaatccaccactcagtagctcaaaactttctgaaaatgtattaaaaactcgcaaaagttcccccccccattctccccccccccctccgccaattgcccaaactttctttaatccgaaaatgccaaaaaaagacaataaaaaagagagaaattggcggatgaatcactcattcctttcctttctctcttcttctcttttggtttgtttaatttcgttttttcattctttttgcttctcaattcattgcaaatttggcctcaattggcgtgccaatttcattttctttccatccgttgaaaatccctccgcccaaaaacggacattaaaaagttttttatttattttgtgatttgctccccattctggtttctngtttttgtcatttattcttttttgactctaga

SEQ ID NO: 28653 - DNA, 991 bp, Heterodera glycines
tcttattttgaaaaattttcgatacgcgccctgcattgttggtgtaccccttccaagagctttatcgtccaaattttccaaaaaatttcgctaaatgtttccaaattttttttaaattccacaaaattagctttttttggtgaaaattgttaaaactggtaaaatttcgaaaaagttttttgtttcggcaccgccggaccccttccgttttaaaaagttttttgaaaaaagcacgccacaaaataaagtgtcataaaaagcaaaagattgtcgcccgggggtagtctccctcaaagcggaaattatggtcattctcggaccctttgggtgatgacaatgcaaaaattgggccatcagttttttgttttccgttggcagatccgcccaccgccaatctgttcctaatcgactcgcacacgggccaaattcggatgggtcgtcgcccgttggattcggaacggggccgggaatgggtgctgaatgtgctggcggtggaaggccatggggacagggcgagcagtgcacgcactacggtagagttacagtatgaaaacagaaccgagtgatcggagcgatttcttatcagtgcaattatttttgactattgctaagcgcatgtgataataggaattggcttataatgttgtgatcagattgtagtgattaattttcttctagtgatcgaaattttctctgttctgaacataatggatcaaatcatttaattactaatcgtgatccgagaaattttcagatggaattttctcattttaattgatacataacagaatatttgcttgctaatgatcagagagcactcattggctgattataaattagaccttttttttttttgaaaattagtgaaattttttagaaaatttgggtgagaggctaggtctggggggaggtaccaccaaggaaaatctaaaattttcagcaaaaatactattttttcttcaaatttcgggtgcggaggggccctgggggg

SEQ ID NO: 28654 - DNA, 906 bp, Heterodera glycines
tttttctagtctaatctactcaaaacggttcagaattcaataaaaataacattcacggtgcgaaaaatggggtatgaaacgtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaa

SEQ ID NO: 28655 - DNA, 1146 bp, Heterodera glycines
  misc_feature (1085)..(1085): n is a, c, g, or t
gcgacgaattttaaccccaaaaagttttttcttgaatttcctagtttaagcagttaggtaatttttccagtcccatttcaaatttaacttccatttttattttattttccaatttttaattcgtcacattttaatatttcccccccccccaatttggccacccgttccgctgacaaagcatgcccccagcgctctgttcgcgcacttctgctgtgcccgttgatgagaagtgccaattgtctccaccgttgggggcaattctcggcgcatttcacccgcattgtgtccattttcacgcgtcaccatcaatttgcctgcggtgtaaaagtaaattggcacaaaatgccgccgaaccgtcgtgaagtgccctcaggcgatacgaaaggtccgaactgctgccgtaaatgaacgaggcgtccaagaagctggtagcctaattagcgtaatgagcttgccatttgcgttttcaattctgttgctgtcacttggtttgcctgttccctggtgcccaaagagcagtttttggtccgcggggccaccatcgaccgcgaataatcaagacaattgacctaattacatgatttaaatcattaaatttatatttttttgaacaatttgaccgttccccgaaagcgtgggtcgtccccggacacggaaatgggaaagcattcggggtgccccggacgaccactgctgggcggcgtgaaaaagtgctgctccatggcacagcagggcaacggatgggtgtggtggggaaactctgaaaggggcgaaaaatgcagagatttcaaaagattgctaaattgcgctaattacccccccccctccggcactaacccgaggccatcatttgagtgctgccgatctgtgccagatcggtgtggatcagtgcagcccaatgggctgtgatggcactgatgccgactgcgtccaacggctgggcccgcggctcgcggaacaacaaattggagagcagtcgcgcgttcggcagctgcggggaacggtcgtccgacgaatgggacggagcggaggagcgacgcggctcagaaacgcctgggggaagggcggacagactgatcagttgnggtgatcaatgaattatttgcacaaactttcattgatcagtttgtatgatatggttttcag

SEQ ID NO: 28656 - DNA, 1887 bp, Heterodera glycines
aaaattttaactaaaaaatatattaaaaattttatttttttaaatatatattaattaggtgtaaaaaaaaaaattattttaataaaataaaaataaaacaaaaaattataaattcttaaataaaaataaaaatcaaaaagaccgaatcatgcaaatccactcacgacccgcggaacccgacatgttgaaaaaacttggccccgtttctgaacccgatttttggattttagcattacaaagatcgatttttgtcaaatgccagtgccaacactacaataaacaaaaagactaacacatcgctctttgtctttagcaaccggaaacaacaaaatgtgtaaataaaaatgatgttcaagttactgatgttgattcttttggtgctctgctgctgggcttaaacccaaccatttgctttgcttatgcgattttgctgatttgtccgccgacggtgatttggtgatgacgtcaacccaaacgtccatatcaatcatggcacccattaatcccggcgattctgtgtaatgtgtcccactcccatcccccccccccccccccccccccctccactgccattttgattgtgtgctgttggctgaactgagctttatgggagaagaagcattgaaagtgtgtgagtgtgtgattggtttcttgtgattttggggccacgtttttcggacacttcctgtgaaaatattttcaataaaatttggcttttaaaattgaaagttttaaagtgcattttttattttaaaaatatttggtttaatttaaaaatttttaggtagtagaatgaattttttaagcatattatttaaattcaattggctcaatccttgcaacaatttgtaaaaaatattttcaattttcttagctttctaatgcatttacatttcaacgaatcttcttttctttttcttattttactaattgctttaaatgccatttttagttgggctttaattgcttgctcgatgtaatgccatttgataatggcagaaagggaagtaatttttccgttaataccttttcaatttgtgagtttgtgagttcagccataaaaattaaatctaatgaggacaggaagtgtccatgggtggttcttgaagaaatgctcgagtgccatcccaaacaattatcttttactaatttttgtttttgttattttctatttaaatgtttttaggcttttcctaaaaataaaatttataagcataactgaaattttcttaaaaaacaaaatcaccatgaattttccagtttaaaatttttccaatttttaaaatacataaaatttaaaaataaatcacatattttttactttctaattttttttcatttggcattttctacgtagggatgagggttaaaagtgcgtcgtcttcttctcaaattacctttccaatttgccgtttccaccattaagaaaaaaaatcaagtctaatgagcttcgaaagcccccgcgggtacaattttcggtaaatgccgccaccaccaccacttttcctattacattcaatgaatgaatgaatggcatacttctccgcctcctactcccattttctttggcattttgactggtgccgcggctgcttgtgcctctcattttctcatttacggccaaatttccggccaaaatgtgtgtgctgtgtgaatgtaaattttcaaattgagaggcagaaattgttttttcaaacgtaataatcgctatgacctcacaatcatgcaaaatttgacattcaaattatctggaaattgaaaatttgagggattttcagtgttttaaattcaagagaaaggattattttttcgtttggcccctctaaaaaaattttttattttgtttttttctttaattttttttgtcatttttccactgattttttt

SEQ ID NO: 28657 - DNA, 1710 bp, Heterodera glycines
cccctgatggctaagtgttggacgggccaaacaaaggtcaggaattgtgttccccatcccaaattctcgcgggatactgattttcagaccatttggatgaatatgaaaatttcgattttccttatcatcatatagaaaaaaaatggggggggctccctgcaaatgtggtcgggacattgcgaattctgcacctatcgacccaattctttttgcgttagccatctgatctcccgctacacctttctaaccaggccaaagacaacaaaaaaatttgggaactgagatatgctaacttttttctgctagacttttagacaatcgtctcatagcgcctggcggcgcacctgtagcgtttcggtttttcttgggaaaagttgagccatggtatggggaccattctaaaaaaaaatttggcgagatttgacaagtctgaagggtcgaaatgggcgtgcgcccgagccctttttcccacatagtcagcgatcttctgatccttcaatgatagggagtctctaatttttttccccgctgctgtccattgatctgttaggcttccaaaaaaaactgctgtctctcacggggacgattttccctgagattcaatattcactgcgctggtgaccggcaccacctaattacaatggccaagtccgggatccggcacctcggaggaccgggaattcccggcccggtcccggtcccggtcccgctctactctagttttatttgagctaaaaatatctcaaaataacggattgtttaaagccctgtgctatctcttctaaagatgtcactgtttttcaatgtgtttatttagaaaactcccgcggcttattgaaaataattttcattaatattttagatgaaaaataaaactcagaaaccgatgaatagtcaccctatccgaaattgtgtgatttttatttttgacaaaatctattcaagaccatctacggaagatattataaagaatagtttagaaatactcagactagaaaaatgaaccattagagaatgcttcgaataaagggctcatgatatgatgcaaacagaaagcaaataaatatattttaaaccaattagactcgcatctttcagcagaaatttcttcagttttatttgagctgaaaatatctcaaaataacggattgtttaaagccctgtgctatctcttctaaaaatgacacttttttcaatgtgtttatttagaaaactcccgcggcttattgaaaataattttcattaatattttagttgaaaaataaaactcagaaaccgatgaatagtcaccctatccgaaattgtgtgatttttatttttgacaaaatctattcaagaccatctacggaagatattataaagaatagtttagaaatattcagactagaaaaatgaaccattagagaatgctttcgaataaagggctcatgatatgatgcaaacagaaagcaaataaatatattttaaaccaattagactcgcatctttcagcagaaatttcttaagttttatttgagctgaaaatatctcaaaataacggattgtttaaagccctgtgctatctcttctaaaaatgacacttttttcaatgtgtttatttagaaaactcccgcggcttattgaaaataaatttcattaatattttagttgaaaaataaaactcagaaaccgatgaatagtcaccctatccgaaattgtgtgatttttatt

SEQ ID NO: 28658 - DNA, 1109 bp, Heterodera glycines
ggaggaggggaacagagtaaaggaaatgagtaagcaaaagaaagcaaaagatacagaccatttcgaagactgtccgataaacgtcgaaactgaatttgtcctttctgatagccaagaaatcgatgcattcattcagtgacactcttttttcctcaataaatgtatgtgagacaattggaatttgtaaatgcataaatcttaaaatttaagttttccataacagcccacttctttcaaccgcaattccgacaaagggtcattggcaaaatcaaaaaccacggcacactgttttagcttctcgacgagcagaagttgtgctccccgttcgtccttaacctctaaaatggctgtcttatagaaacaaaaatggggacggaccgtcgaaatttgccaaattcggcccgccttctatcgaatgaatttccttctcctggggagattcgtccgtcctttccttcgccgatttaaaaggttgacaaagtgtacctgaagaaaaaggaacggttccaccatttgcggttatttttccaaactgaaacagacttgacacggggaccccctcatctgcagaaacacagccacagccaaagtccttcccgacattttcatcgtttaattccatcggaacaaatgttatttaatagacacgtattatttggtttaaagtaaagaattcgaaatagttatctttttgcaatttggtgaaaataaagaaaattattttatttataatttaaaaaaacattatcagatgaatgatattttctctttttattttgctttaaaatgactcgctttacaataatttgatcagtggaaaattgactcgttcagccggaaactcgaaacagacctttttctgaaaatgaatttttactcaataaagtcttttgaaacataacctccaaatttttgtttgccattaatttggccacgaccatattctgtttggccacccgaaaaagagaagacaatgaagcggaaatcgggttgtcttcgtttaagtccacatttttcatcagtgcgacagtctgaccaaagagttcagcggcattttcaaacattctccctcttttgtgtcccgtttcgattccgcaattctaaagcct

SEQ ID NO: 28659 - DNA, 1316 bp, Heterodera glycines
atattttcttggagattcatgcgtttttagacgttggacggttcagtcctaattgtaagccattttgccaattcagtcccgggtctgtaactctagggaattgtttccgccaaaaaattctttcggattcgttagttacagaccaagaggaatcgaatgatattattcaacaagaaaatcggagttgtcagtattcttcacttttaccctcttttatgacttataactattttttagggctttagtgagagtgaaatcacttcaaaagttaacgaatatcgtaaacttttgtttaccgagtttgagaacggtcgattggatatggacaccgaattggatcttcggaacactcattcgagggctaaagttgccaaaggtactaactattctagtttacaggtctaaacgtttcaattcttattttttttaaaacttattttagataacagagataagtggcgatcagcacttagaattgacgcagcttttgttgacggctcttcgctggaaaaattgaaaaaagccagcgaatcggtggttgaaatggcaaagaatgtcgataagaaggcgctggacaaagaaatggaaaaatcgcttatggaaaaattgatggaaaaagtataactttcccttacaaaataattctatcggtttttgaagattaaaaaggaaaaagaacaaaagaaagagagaaagaagatgaaacgcgcgatgcgcaaagagtcttcaagcgacagttccgactcgacttcctcgtcggacacttcctcgagttcgtctgaaagtgatgattcgtcgtcaacttcgtcctcatccgaaagttcggccgatgaaaaagccaaacgtaaaagaaaagccgatgagaaggaaaagcgcaaaagaaagagcaacagaaggcgcagtgaagagacgaaggtcaaaagagaaccgatcgaatcgcccgtcggaaagagaagtcgcaaatgaaagaggggatggaaatgtcggtttattacctatttatcatttcattgataaatgatggttttggcacttttcacgaaaattaaatgttgattcaacttacagtattatttttgaactgttaattgtaagcattatactttttagtagagtagagcgggaccgggaattttgagcaaaaccgggaccgggacctgaaaagccgggaccaaccgggacctcgatttttgtccggataccgggaccaactgggaaatttaaaaattcaaaaaattaaaaaaaatttaaattttatttatttcaagtaaaaataatacaaaattaaatttttattttgttttttatttaataaa

SEQ ID NO: 28660 - DNA, 1852 bp, Heterodera glycines
  misc_feature (1766)..(1766): n is a, c, g, or t
  misc_feature (1792)..(1792): n is a, c, g, or t
  misc_feature (1795)..(1795): n is a, c, g, or t
  misc_feature (1798)..(1798): n is a, c, g, or t
  misc_feature (1807)..(1808): n is a, c, g, or t
ttttaatatattttaataaatatttaaataaaattaattattcgaaagaattcaaattgaattaatttatttgtattgcccatcattttttaaataaatcattgttaaaaactcaataacattgtatcattatcacttcagcatcctcaattatcaattagggatcaattagccaatcagttcattcaatgagtaagcaatgtcacgaggcaatttcaatgggtcgatgaaatattctcccaaataacgcgaatcggcactgtcctataagtaaaaaaaagcattatctaaatcagtttttattagtattgttcggcaacacgatttaccggtaatggttacggtaaaaacagtagcaattaccgttacatgttttccaaaaatcgactgatatgaaataaatttaccattactgcgataaattattaccatgacgaacactagtttttctaactacttcctacggaatgcacgtcaaaattcctcaattaatgggaagaaatttttcatttttttaacgccatctttttctaaaaaaagtatttctgcttttttgttcgctctcaaaaaaattaattttcatcccattaaattacctcgtttaataattcggcatcttcttgaccatgtccctcgttaacatcattaagcaaaaagatcgacgaccgttgtccttgcccattcagctgcttatgccatggatttcctgcaattttttttaaatgctcaatgactataagtcgtttttgaataagattttgggttcatttcgatttattcaaagcaaatattgtaataaaaaagttgaaaattcgattaacgaaaattttgataaagacttaaattgactcatcaaccgttggccacgggcccaataacacttacctatttgttgaaacccaaactttaggaaaattgaaattttattgtaaaaatatactttgctgcggcggttgttgcggttgtggttgattttttggttttcctgaaatttagaatgagggaagtggctgcctcacatggctaacaaataagcagagctcggccggacctggatccatgcatggatttttcttggacctggactttcctggattttattcagcaaatccaagtccagatcaatttggtaatccaggtctaggcatcaaaaacatggatttcggggataattttttttccgtctttttatggcgaaatatatttaaaatgggtattaaatctaaaaaaatttctcgacggccctaaaaattttaattctcttcaaaaaatggctcaaaatctcgaaattttgtcatttcttgaacaaaatcgttaataaatcgcattaaaattacaaaattttgcaaagcgggcgcctatctgcaccgcccgacctccccctcttattaaaaatttgtttgaaaaaactggccgtaaaaagtgttttgaaaagcaaaaaaagattgacatgaattgactggatttttcctggacctgaattttgtccaggaaatccgggtctagatcacatgaaacccagctccaggttctttttacaaaatactgagctttacaaataaggtatttgaaaccaagccaaaattattcgtaaaattaatattaattaatatattaattaattactatttgaacctatgccaaaattaatttagtaaaattaatagtagtaatatacatattaattaattaccctttgaaattgcctgcaccgaaaaagttttgaatttcttgccaatggtcagcgacctcaaatccgagagttncaagtccaaaagggagcgtcaaatcncgntcnccttccttnncatctttaacgaaaaatttttttttttttgtgtattttttaagc

SEQ ID NO: 28661 - DNA, 989 bp, Heterodera glycines
aaagtgaagtatttctcgaaacagtacattttgatgatgttgccactgctgagaacctgaattttgccaattaaatgcaatgggacaaaaacggggaaaaaggttggcatttcatagggcagcgaatgttaagccacgtcaaaacaaattagaattttgaaagtaaaacaatttgccatggaatggcacggcatttaccatcgaaaaggcccttttagaggagaaaatgatgtagtcaatctctcttccgggaaggtatttgccgttgtgacggatcatttcgtgccaccacacgcaacacctttcacaattgtccaagtcattcctttccaaatagcggaaaattagcagccaaagttccgacgaaagacgacgatacgacggaagagaatggggctaaaaaaagaaggaatatgaaattgaaaacatttgccaaatttaataagaccattgaatttgtagaagaagccaactcattgaaagagtcactgcttttgggcagacataacagagaaaggttctcactgatggaatcggacatatgaaaacagtagaaggaaaacccaaataaaatgctaaaaaacaaatttaaaatgaaaattatttttttaaaaataaagacatcagatgaaagacgactattatttttaaagtcatttctgaattacttagtttttacacgaccaattaacactttcatttggccatctattaagtgaatacatctatatattattaacaaaatttgaatacatcaataattcaggaatttattttatttttttaatgtatatacacaccgagtcaaaaaacgagacatgtgtcaataaagagagagtgcagagaaaaaaacatctctatttttggcgtactatttctttatctctgttaatagagaaaacccgaatttacttcgccacatataactttttttctactcatacaatttacaccaaattttgcataacgatagagaaaaagaaaattaa

SEQ ID NO: 28662 - DNA, 1284 bp, Heterodera glycines
attaaaataaagaactaatttcattaatgaaaccatttgcccacaccagccccgcacgcgagacacaccccatttaaaatgcacccacgttctcccctcttaaattcgataggaaaaattttatttttttaaattttttaaaatttcttcattcttaagcctttatatatattttttttagattaataacctaatcaatggtacgaaaaaaacaaagttttcagcctatcaatgcaaatgcaagttcttctatagaacaacaaaataaaaaagaaattgatcaaatgggttcaaagctcccagtaaaaagcggattgaacaagattgaatgggttctaagctcccagaaaaagcggtctgtaaaccttgataacactgaaatttataatgaattatcaacctcaaatgaaagcattgaaagacttaatttgaaagaatgtattaaaaaaagatgagattttgttcgtttttatcaagtgtctctattttaaattaacacccctttttcgggaaaaaattcataaaatttttttccgtcgtcatttcgccttctccttttcagaatcttaatattttcagaattgctacgtacagttaaaaattcagctcgatcggttcatgggaagtggtcaaactcccaaaaaacagggtgtctttattttaaattaacacagtgtatacgcaaacaattttttttttacaatttttgctgatatttataattattttttatacatttctattttgtttatgttaaagagcgtaattttataatgaattatttttttatttaaataaattttttaaattatttattagaatgagagaaccttgcaatggaaaaaagtgcagtatatttaatgaatgtgcatacgcatacctcgacatctctgcgaccatccattgtaataatagtcaaattttagtatcaaaatattattgtatataaataaactaacccttttcaaggagttcataagaattactacagtttagttaatttgaataattggatttaccatttaccaatattacaacttatttttatcaatttattcagtgaattgatcgaagaaaattcgacgataaaaatgattaattggcgggctttaaacacagcaaaaattacatagtcggactaaagaattgatatttcacttctcatattggcgaactatttctttaaggagggaaaattatttttatattttctaataaatttacggcgggtgtgggtgtgttgatgaccatagatatttcaagatattctcaatgacatctaga

SEQ ID NO: 28663 - DNA, 1620 bp, Heterodera glycines
aaatttttcaagtttttcttaataaattttttacaggcttaaaaaacttatcgtttttgataaggctaatagagcatgttgagctttcgaatgataccaagattgttggatttggatgccaaagaaaaaagcttaagtggaaaaacgagctggcgccgaacgcgagcgccgaaacgcgtggttccccccaaacatggcaaaagtgctttgatggattttgcgtgaatgcttaaaaaaggaaggagcaggaccttcgatcagagagagagcgattgatcatttctgatcagtggagcgttgaatgataaataatacacaaaaagggttaaatttcctaaaaccttgaaattaatcgtttaggagagaaagtcctgctgacgccagacaggacagacacacatacatacaaaaatgttggtcaaattactgctaatagacacaaatacacaaacaatcgataaaatcaatcaataaagggcagagagagaggggaaaaagaccaatcatcgcttaatgatcaaaaagccagccgaggcccatacaaaagcaccatcacaacaaaatctgccggacgctcacttgggccagaaagggtgtgatcagccaatgggtggcgaagaaaaatatgatgccggtgaaaatggagatcggcaacgccggcaacgccttgcggtacagcgccaacaacatcagcgtaaaagcgagaccctggaggaaatggggacacatttcacatgtaaatttatgaaaaaataaaatggcgaccaggaaaatgcatcaaatttactaaattttaattgggcaatttgtgtgacagttttaaaatttattcggtgaggtaattaattgttaattggttttttatttggttgttgaaaatttggcaaaaagctgtctgaaattcatcggaatttttgatcgtggaaattaagttttccgcaatttttttttttgtaattcatcataaaaattagaaaaatcgttaaaaaattttcaaaatttttttcctgaaaaactatttcacactttaacccataaatacggaatgcatcgggctttccgatatttttggactcggatttcagaggtacgaaattttttttttttttgggggacattttcttggaatgccatcaacactcactcaccaccaacacggacacatagcatgcaatggtcacgttccaatccccaaaactgctcgccttgccaaccagcacactgtaaaagatgaagtcgcccaggcccaacttgacgccacctgaacgtaaaaattgcaaataacagaaaaatcttcatccatccatcaaatggacaagttttcctagaatttccaactttctatggtcggaaggccctgcccgccggccctcttctgctcgccgcctgcggcattttttaagaaaaaactcttacaaagttttttcataagaaaattctaagaaaaaaagtttttttttaaaaatttgtcgagtgtggggatttttccagcatggccccctccaaaattttttcgtttttgaattttattattttttgcagatttttcccaggaaaacggagaccactttcaagcaaccgtttttcgagctctatcgattggaggcatttttgaaaaaa

SEQ ID NO: 28664 - DNA, 1306 bp, Heterodera glycines
  misc_feature (98)..(98): n is a, c, g, or t
  misc_feature (100)..(100): n is a, c, g, or t
gcataaagcattgcataatttattcgaatgggcaaataaatggcaaataaaagtttcaatgcaaaaaacttttgtattatatttgggttcaaaaaccncnaaaagaaacatataaatttgatggaaatacaataaatgctgtggatacaattagggatttaggagtaaacattgataacaaattacaattttccgatcatattaaccaaataacaaggaatgcgtatttacgtatgcgttccttgtttagaataattaaatccaaatcgtctaagatttggattacgttatataaaacttatattaggcctttattggaatacgctccagaggtttggaatccgtctcttcaaaaaaatattaaaaaaatcgaaaagtgtcaaaaatatttcaccaaaagggtatttttaaaatgcagccttccgccaattccatacctaaatcggttagaataccgcaactgccaacacttgagaataggcgaaaactgtttgatctgttcatggcgcataaaattgtttatggccgaacagatctgaaactattttctatttttaatccctcaacgcgctttaacatccccttttacagatttaactcaaaatataaactgggcaaaaaattcattccctttgctgggagggtaacaaaattgtggaatcaactagataaagaactaatcaaaacaaattctttaaatcaatttaaaaccaaacttagaagttcactagggtaatgaaaccggaaagctagaattataacaaattcctaagtgatttggtatttttttatttttcgacctcatttgactttgacctcaatttatttattatttattttcacatatttttgtctttttttaattcctgtgatcatccatatattttgtcacttactctacgacacatttaccggaatagtcgtcagagtaagtggttttcgcccttctgatgacttttttatttttttatgaataaataaataaataaatataatatctattatttaattcaattttgaaaattttggtttggtataaattaaaattgtttttaaagataatcagaatctgaagtagttactatccagtcattgtcgcggtggtgattgatggcttttggtctttgatgtttgccgcgtgattaattacctatggggggtgattaattagtgcgcgagcctaagcctatgggtgattaattagtgcgcgagcctaagcctatgggggggggggtaattagtgcgggaatcctatggggggggggggtgattaattagtgcgcgagcctaagcctatggggggggg

SEQ ID NO: 28665 - DNA, 1524 bp, Heterodera glycines
  misc_feature (1459)..(1459): n is a, c, g, or t
ggggacctctagagtcacaaaatattttgggcttgtgaacaatttttataaatgaaaaatgcaataaaaataaataaatatgcaccattaataatcgacctaaaaatttttcaaaataaattgggcggagttttacaccgaaaatctttaaatggtgtttaatttacattggtgcaacagaaatggataaaaatgagtcaatttttgaaaaatttcgcttttattgagcagttcaaggggcgactaggggggggattaccccccaacgaaaattcaagaaaatttcgtaacaaatagtactcaaattttcaaaaattttcccccggcgtattttcagttttttagcaactacatattctggcagttttttagtaactaaaaattccagcccttgttttgtaacaacaaaagacaacgggcaccttcatgagtttgtcttcgtcgatatcactcacaaaaagatcgaacttctcatacggaataaccattgcctctggatattcatagggatccatgagcaaaatcttaatgtaacagtcacaaattgtgcaaaaagaggatatttattacttaagaacattggtccccaaaaaaggttacagcaaagtaccctgaactattaccaaagtacgctttccttgtaatttatgaattggaatttttgtatgaattcggttcgggtttcggaattttgtaaatcaaaggtcatagtcgtgatcagcgccacaaattaccatataaatgagtttatttgaaagtttcaggtgggaatctcaaaacagaaaagtacccaaaaaaataaaaatatttttttcacatttaaaaattaaaaaacattaataaagcttgacaaaaatcatagattatatgacgtcgtaagtctgatgttagatttgtggcaacaccctaaaaaatccccgatcacatctcaaattgcataaaatcattttttcttatgggaccaatgttcgtaagtattgccaaaaagagaaatgccaaacctactttatcatgcgcggaacggacttggctgatgacggcctgatctgtcacaatcggaggcggacattcggtgctgaaaacacaatgggacaatcaatcaccaagacaataaacttcatggttttgccaaaaaaaaaacagatttttttaaattttaacatttttactaagatcggcctggacctggatccaggcctggatttttcctggatccaggtccaggtcatttttcggcaacctggattttttttcctgggcctggatttttgtccaggaaacccagctccaggtcaaggcatgaaaaaaactggaaaaatctctttaaaaagtggctcaaatcgtaaaatttgtcattgtttgaacaaaatcgttaagaaatcgcattaaatttttcacggcggcggctatcggcgtcgccagacccaccgtccagaaaattttttagaagcgcgccgcnaatagcatttttaaaactaaaaagtcgtcgtttggacactaatatgagtatttttaaatcaatat

SEQ ID NO: 28666 - DNA, 868 bp, Heterodera glycines
cataaatctaacaaaaaaggtaaaatattaaaatccgatccatgaaaaacatgaaaagaaaatacaaaataaataaacttttttttttacactttccaattttttcggctgcttctctatatttatagggtttgacgatatcattttgaaaccggagcatattgacttgtttaatgctaaaacaattaaaaaattaattaaatttccggaaaaacaacgaatattttccaacaacgataaacaatatgagtgagtatttgattttgtgaacacccactcatagaataaatcaatgcgcgtgccaatccggaactagtgccattttatatgcttgttttttgcatcaaaaaataataaaataaaattccattataatatatttaaaaggtgtctttaaacattttatacaatgttgcaaaactagcggtttttcatttaatatttaatttttacatttttagcttacaaattagaaatgttataaactaaatacgacggaattctttaattatccttaaacagatacaaatatttattttgtaaaatttataaatttttccaaaaatttggttaatgagtataaaatactctcttctctaaagcaaaatccccttgctgctagctaatatgtatttaataaaatataagttaattaattaaaatttatttatctcaggaattcatttattaatgctatttttaattttactatgcaaaagttttgtggattttattatcgcagttggcaatccatgccataatttatgtgacgaattatgggaaaaagccccaataaaaatggaaaatttggaagggaatgaaatggaaataaaaacactcatgcaaagtgaacaaatcatattcgatg

SEQ ID NO: 28667 - DNA, 1355 bp, Heterodera glycines
ttcaaataaaggtggttgttggcttaatgttttttttacatttaatcattgtaatatctgtttttcattgcttctgtatttgcgcacccgataaagcgccttaaaatcacaaaattgagttaaatttagtaaaaaaaaacaaatcggaagggtggtaattagcttgccttatcccagaataattggcacttttttttttgtacattttgtcaatggccaaaaaaacacctccaactccttgaccacgtactcgccccgtttgatcagctcgcgcactttggcctcttcctgcacattggcgttgcgtgcgaatgcgttttttagccgttcatggaaccaacgcgagccttgcggataaacgaatcattgtcatcatgttattttgagaaaaaaaatcatccaaaaatggcaatattgttttggagaaattgaatttctgcaacgctatggggctacaccataacaaagaattaaaggaaccaaaaaaaaaattttttttttttttgaaaattgccaaaccttcggtactttttcactttacgccacataaaaaaatatttttatttttctgggattttcggggtcgctgatcacgaatgtggcattcatttcgaacaatttcggaaccaggacccgaattcgaacaaaaaatctagtttaatttttcgaatttcgtttaaaaatggtttaatgatcttttattgcatgagtggatagctttcagtttgtttccatgtgtttagtcgtttttagacgaaaaagagaaattggataattaaatttttgattttttgttcgagtttgggtccggatttcggaattgttccgaaatgtcacaacatatttatgatgcacgacaccgaaacctccatatttaaaattataaagtattttatgagggagaaagtgcttcggaggctgtcgaataacgacgtaggaattgtcaccaaaaaaagcacaactctgtcttcacatttcgaaaaatttttatcaaaattattagtagagaccgaaattctctcaaatgcccggactgatttgatattttcacaagcaatcggcttcgggccggcctctcaaaaactggtgaaaccggattttcggaaccggtttggtaaaaatttaaattttcacatgtatttcaaccccaaaatcgacaaaaatcgtgtcaagtgtaaaatttcagctctatttcacttcaggcgtcaaaaatgacctcttcaattttaaatttcataaattttcaaaaaaattaaattttctaaaatttttgcgattttctaacaaaaacagtaagtaattcatcataaaattgaaaaatcacgtaaacattttttcttaagatattcttatgg

SEQ ID NO: 28668 - DNA, 953 bp, Heterodera glycines
tttgtgttttctttgctatttgtgtgttgtaatgtgcccccccagtttgtgagtttgtaaaatgtgttttggttttcgcgaatgtgttttcggttttatttagtcatattaggccattgtaataataaattgcgtttttagcgtgccattcagttttcggaatgttaaaaagggtgcaattgtgtgttatcatttgttgtttgtgcatgtgtttttgtgtgcttaaccttaacaccttgcggaagtgccgtaaaatacctgaaaaatacaaaaatataaaattatgtgtgtttgcgcattggtatgatactttccaagaccgccaagtgcagtgcccgccgcaggcggcggcgtcactgcttgctgcgctgcaccacctccagcaggtcgagatccgccttttttcttgaacaaatttaatataaaaaagattaatttttatcaaaataatataaatctattaattttttaattaccggtttcttgatgtatgcccaagaatggtctcctggtccgcctcttccgttgcaccgctgcgtgttgcacggtgccgatccggcaggctgcgcttttgtgcgtgtactcggcggtttcactgatggcggcgattgttcggccgccgtttgctcatattcgggaccaattgagcccctcgatttgctgacagatgcttaaatataaataaagaaatgttttttatcaacattttttgatatatacaataaaaaatatataaaattaattcaaatttcactcacaaattgatcgcgtcggtgcagcgtagggttgcgctgcatacactcgtggtgcatcagttcccgctggccgtggaccggacgcatattcagtgcttggtgcagtatgaccaataaccctgtgcgcgttttcagaatacggctaatatttttcaaaaaattcatttattaagtgcaagtggcgtggatatgagtatg

SEQ ID NO: 28669 - DNA, 1712 bp, Heterodera glycines
gaaggaaaagtgggagggacgggggtataaaagggaaaggaaaggggggaaggagggcatttgtgagacggaaaagcgacggatacggcacaatgggcgaaccaaattcaaaaactaatatttttcacatttcaagcaattaataataaattagtgcaattaaagaaatgtccaccatttttccccctcttccgtttgttgccatttttttgttcgcactttttgccaacagcgcaaatgcgtggaaaaaggaggcaaattcagtggagtccgccgacggacacacaaaggcattcatggacctgatcagattcattttgccaatggaagagcccgagggatcggaggaaagggaaggagcaaaagcagagacagaagaaggagcggaagaagcagggtgaagccaaaccaaaccaaatcagagcaatcaattaaataatttaattaatagatcatttggcatgggaggaatatttttatttttttgaaaatttaaagacaaaaattcaattttaaatttgtggaaagcaagtcattcttcccacgccgttcatcgccctttttagaaacacgcaaataccacaaagtaaaaagctcaataattcacagaaaaattgctcgcgggacaatgatggacgacgtaatgagacggaagagaagcaatgcgttgggcgccaaatcactcactcgggcataattaatgaattaattaactaattaatttggtgataattcatcggctcgtcatttcttttcaaatgtttgtaaatataaacaattcatttttcaatataaaataataatttaatcacaaataacaaaatgccaatagaatggcacccatggccaccatttgtggccatccaacggaatttggtcgtgcgccgaaattgccgttttcctcagccgatgtgccaagaatgaggttgtactgcgggtatttggccccaatttgctcccaaaagtgcattcttcgaaggtccatgtccaaaacgacttgcggcattggcaaatcgatggccaaatggcggaagggaaagtcgcgcgttgcgttgggccatcggacggtgtccgacaaagagggatcccttggggggattaagattaattacgcattttaaaattaattaggtatttaatgagcccgacaaagatgggtcccttggggggattaagattaattacgcattttaaaattaattaggtatttaatgagcccgacaaagatgggtcccttggggggattaagattaattacgcattttaaaattaattaggtatttaatgagcccgacaaagagggatcccttggggggactaagattaattacgcattttaaaattaattaggtatttaatgagcccgacaaagagggatcccttggggggattaagattaattacgcattttaaaattaattaggtatttaatgagcccgacaaagatgggtcccttggggggattaagattaattacgcattttaaaattaattaggtatttaatgagcccgacaaagaggatcccttggggggattaagattaattacgcattttaaaattaattaggtatttaatgagcccgacaaagatgggtcccttggggggattaagattaattacgcattttaaaattaattaagtatttaatgagcccgacaaagatgggtcccttggggggattaagattaattacgcattttaaaattaatt

SEQ ID NO: 28670 - DNA, 1382 bp, Heterodera glycines
gggcggcttttggggttgcctgacgttacttgcaaaagatggtcaacaaatttgtttctgttcatagattattaaagctttcctaattagttttttttttatctaaaattagtttttgaaaattcaatgcaaattttggaattaataataaaatttccaattaaataaaaaaatatttgtaggaaattatataaatacattttgcaaggaggattagaatttttgagggggggggggggggtaaaacatatttagggaataaatgcctgattttacttaaaaatggtcatttcttttcccataaaaaatcagggatccagattattcatgaccctgagttttgacagaatcctaatttttatttattttcccgaataaaatatataaattcaattatatattgtatgataatatttaaatgttaaatttccaatagcttcgagatagtgctgaaaaacaaatgtaattaattaagttttcatcttattttaaggaaatggtaaagacattttccgcgttaatggatgcgcacgagataatgagaaaaagtgcccgacagtgttctacacattctgccgggaatcgggtgggaatttgtttaactgtcgccattgtgacgagttggtcgacggcaaagtgtgcaacagctttgatcagttgatcaaccttgatcagtctgaggagcagatgaacagcatttacaagtcgcacagtcatcacagtaacagcagcagcagcaaagccgagaagcttggccctgtttccgccttcacttggatcagcagcaatttgttgctgctttttggtaatggggaaaaaaactaaaaaatatttcggcaaaaaaggatagaatttgaagaattaaatgaaaaaaaattataaaaaaataaaataataattaggacaggcgaaaaatcatttttgcattaaatgccaacaattcttacataaaaataaatttttaaacaaaataaatttattattttaattaaaatgtttagtgacgatgttgattttatggcattaatctgctgctggtgaagaacgaagctgatggatgagtaatgatggaacgaattgaagataatccaatgccccaaaaaagaaacatttcgacccaatgatcgatcaaagcaaaagtaaaacaaaaaaaaatatctttttttattaaatttaattcttttaaaaatgattaaaataaatttgtcgctgaatgattttaaatattagtaattgtgataataatttattttttaccaaattttttttaaatttctgttaaaaatttttctattaactaaaatcataaaaaatcaggaattataataaagtaatattcgaaaatttattatttaattacttaagccaaccaatttttcaat

SEQ ID NO: 28671 - DNA, 1131 bp, Heterodera glycines
aaaaaatgtacgctcaagtgcaagccttttgactaaacattacaaggattgaattatgttattgtaaattttaaatagttaattgttacacgttacatgtcaggcctctgaattctataaaagtgcatcaagtattgcaaaaagtgttcattttttattatgcaattcagttcttacatgttacatgttacatgttagtttactcatttctttttctaatcaaattgtatacgtacacaattattaaaatatgtacgattccttcagggtattaaacaaaaaaaaataaaatttgctatccgagggccggccagccagccatatgccacacgattgggacgcaattgtaagtgaaaatgtttatgtgtgtgttagctaaaaataaagcgcaaatagggttggagtccgagtgaagatgaagcgtccgatgatggtggaaccgagggccaagaagcagctgcaaagagtgcggttgtgcaaccaaagacaacaagcggacgaacgaaaaaagaaggtaatctgcaagccagcagcaacataggaattcattctatctataatgaacaattttttttctacttcacagcaccaaaagaaggctctgtgacagctgcaaagagtgcggttgtgcaaccaaagacaacaagcggacgaacgaaaaaagaaggtaatctgcaagccagcagcaacataggaattcattctatctataatgaacaattttttttctacttcacagcaccaaaagaaggctctgtgacagctgcaaagagtgtggttgtgcaacaaaaggcaacaagcggacgaacgaaaaaagaaggtaatctgcaagccagcagcaacataggaattcattctatctataatgaacaattttttttctacttcacagcaccaaaaaatgcctctgtgccagctgcaaagagtgcggttgtgcaaccaaagccaacaatgggaggcacgaaaaaagaaggtaatctgcacgccagcagcaacataggaattcattctatctataatgaacaattttttttctacttcacagcaccaaaaaatgtcattgttcttcctatcaacttcatcctccactgaagatggcaagcgtaaacgaccaagacaggtgcgccaaaa

SEQ ID NO: 28672 - DNA, 721 bp, Heterodera glycines
ggggggagaaaggtgttgttggttagttaatatagcggaagaagtgggcgaactttgtcgaacaccttttggctgactgaatgcaatttgggaaaattgccttgggcactgtgccattcgcccgcccctcggggctaacaatcagcagaaagtcagttggacggaccaactgaaaactgaaatgaaaggtcggacgaacgaagcgacgccatcaaatttgttatgcaatgggttggaaaagggcaaaatgataaacaatggcaaaactcaaaattgggggaaaagactttgtggattttgggggaggaaagagtgaaaaaacggagcagaaatcggagggactaaacaaacgcacaaaacgggcggagagcaacgcatttgggcaaagatttgggggataatgtgccattgtaaagggccgaaattgggaaatgccaaaaaaggaacaaaatggaaaggaaacggacaaaaaagtgtcgaaaatgacgacgaatttttggagccggggggaggggtaaattgcaggaacatcagcataaggagtgaaagaaacaattgagagaaaggaaaatttgggggattaaggcgattaaccctcgccggaggataagcgatgccttgcgtcgacggagggggggggggcaaagacggcactttcattggcggttaaatgatgcaaattattgaggtcattctttcctcaaagaatgttgaatggcct

SEQ ID NO: 28673 - DNA, 1404 bp, Heterodera glycines
  misc_feature (1387)..(1387): n is a, c, g, or t
tcatgtttattgatgccggtgaagcttgagtcgctgaaagcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaagaaaagaaggacaaaattaacaataaataatttttcaggtacaacgaaaacaaggagacacctttttatttggatgatgaattgaaaaattattgccgaaacgacacggagattttattcctgtcaattattgagtttcgaaggatattgattaacgacattactaagggatttgacccactaccgaggagttgtacgaatgcgggggttgcgatgaatatttttaaggcaatgtttttgttgacggagcagttatcgattgtgccggagaagggatatgagcggtgtgatcgcgccagtgtgatggcaataaagtatttggagtggcggagccagcgggatggaattgagatacggcgcgggcggggaacggacgagaggtcaaagttggaaaatataaattggatggatttattgcgaataacggagctagggacaaatgcatcgaggttatgggatgttacatacacggatgtttgaattgttatgacccggcggcggaactgattggaggaaggacggctcaggaattgaacgatgagacgcaggagagattgatggagctgcgtaagactttggacgtcgaagaagtttgggtaagtttatttgacatttgaatttataaattctactttttaggggtgccaaattgaaaaggaactgaaaaaggatgaggagatgcgggacttcttcgacgacagagggaatgagaaggggccgattgatccgcggatggcttatgcaggagggaggacgggaccgatgaaattgtttgcaaaatcggacgagaagaaaaaaaattagcgtttacgatattgtgagtctgtatccgtctgtgaattacggtacagcttacccgattggattgccagagattattatacctaagagcgatgagattaatgttaattggacgagaccggaggatttgaagtatatggggctgtataaagtgagggtcaacccgccgcgggggttgcggattccagttttgcagttgaagtgtgatgagagattattgtttccgttatgttggagatgtgcgtcaaattttaagaaggagacaacaagatgtaactacaagtgccctcatgatggggcacagcggagatacgtggcgacttacaccagccttgaattggtaacaaattatatataacattaaagtaaatttcgtttttaaggcaanaggcattggaatgtggt

SEQ ID NO: 28674 - DNA, 1014 bp, Heterodera glycines
tcataagatgaaataaatagtttggcttaccttttactatattaattatgtaaaagattttatattatacaaattatttttcattttaattttaaaataatgaaaatattattgctattaaaaagaatcaaacggacgctagcaaaataaagcaacaaataatttttgataaaatatttggccaaggatggggcagaagaaaattcatgcccaattggtcaaataattcacggacaaattgctgtcataataagcattatgatcataatggtcattaaaatgatttaatttttgatgaacatttggaagtgatataatcgcttacagaaaagacaggtgtgatttaaaaacagtttttgtttcgtttccattgataataatcataattttatgaaatcatacatgtatgatgaaattttaaatttgttttcaaaattttctaatgtaaaaatcgatgcacacgacgtgaggaaaagggcgaactttgcagctgcactcggcaacatataaagccattgtcttggcctgtgtacagacgacatgcagaattctctgggcaggccttaaaaattcaaaaattcttgatttaaaaacgcgttaaaataatgtgaagaaaataaataagaagaaaggaatcactgacctgtggggtaccggacctggcgtatggattacaggtacggtagttaccggccaattcaacgggaacaagatttgctggttgaggcggacatacatctgaaaattcactatgcattcaatttaaaatacttaatgagacagctttttttaatttttcgcgcattatttgcgccgcaggcacggacatttgcattgccaagcataatcaacatttgtaccaaacaatttacaggtaatttgaaaatattaagctttccaagaatacagcatatttttaaaaacaaaattaaatttctggtgacaacttgtttcagaaaaaaagatgtcctttcactagagatttctgttaaatttaaaaaattttaagtagaa

SEQ ID NO: 28675 - DNA, 1476 bp, Heterodera glycines
  misc_feature (22)..(22): n is a, c, g, or t
  misc_feature (49)..(49): n is a, c, g, or t
  misc_feature (1473)..(1473): n is a, c, g, or t
aggtttttaatttactttattnataagtttctttataaagtcattgcanctgaagttcaatgttgatatttataaaaaatacaataaccacttagaatattgatacataaaagaataaagaaaatttacattgccaattggtaattaagagaagttttcaaaaatattgctattaagaaaaagttcatcgcaagggacatcaaataaaatttaaaatgaataacaaatttttgctttttaaatacctttagcatagttattccagaagcaaataaatgcataaaaacgatcatggtaaagttttttgatctgctgttggagggattcgatttgcctggttaaaaccattattataatctcaacgaattgaatttatggaacctaataatgaaaaaataaaacgtcattgacttcaaactgaaatcggatatcagatgaaggataatattaaatataaacagaagcctataggcaattcaagcagattcttaaaaaataaaaatgtaaaatcataattaaatttttgccaaatgcagcaattttatttcttaaaatacaaatattaaatgaaattttaaataattattaaataattaaaggtatgctatagtcagctttattaaattatttatcaaaacaaaaactgtattttaaaatttagttaaaaattgaatatttagaattctgttaacttatataaacaaaaagttggaaattaggcttagaaattcaaattgttgaccagaacttgagtaaaatattgaaatttaatataaaaatataacaagaaaaaggaatatttagaatattaacaaagacagcatttattttttttagtacatatgaatatgctagaatatttatattttaatttaataaataatctaattggagagagaaaaaatttattaatcacaaattactgtttaattaataacaaattaatattccgctaaataaattaaattttaatatttattccaaaaagtgaaatgcaatgctaattttatttaattaggctgaattttaatgaattgatcattgaatgttaagaacaaaaaataaataaaataaaagacttaatttaattaaaatgttgatcagcacaaatgacacttttattcgctgctcattactaagaaaacccatattatttaaaacaaaaaaaaactacaaattaatgagccttatgctataaaacctaaatttcaacaaataaattaaataaaaataaaaatatgaatatgaatactaaaattcaaaagactaataaaattaaaaattaagagaggttctaaagaagattattatcataatcagggttcccagattaaaattttcagaagccgaatttggtatataaaattctcatttttttaatgcgatttgttaacagatttgtccaaaaaatggccaaattttatgattttgagcaaatttttaagaagacgaaaagaatttatagggtccggntgg

SEQ ID NO: 28676 - DNA, 507 bp, Heterodera glycines
  misc_feature (325)..(325): n is a, c, g, or t
  misc_feature (391)..(391): n is a, c, g, or t
aattacaaaatttcaggaattcaattttttaaatttaattgcgaaaacaattttttttttcctaaaaagactattaaaaaatggtataaattttagtatttttgcatttattttggtaatttcaatttgttttgcctttctccataaattaatccaatttccccctcttcgcccccacttctcttcttctctccgtaacattcaattctttctttccgttcattttgttggtgccaattttttatgaccgtaatttttttcattttctctctccccccgccgtccgtcgcccgccaaagtgcggtagagtcggcgattggattgngcagtgataaagcagagaaaaacggggtgggaaaagagtgtgcaaagcacggagagtgggcgaggngaagccgagagtgagtctcgacctgtgaatttggtattattattttgctctttgcttctctgccctctcactattcctctccccccgcccccctccccaatgacagcgggcgcacg

SEQ ID NO: 28677 - DNA, 1012 bp, Heterodera glycines
  misc_feature (138)..(138): n is a, c, g, or t
  misc_feature (991)..(991): n is a, c, g, or t
tggctgcattcaacaagcaatgtttgtaaaaaatggaatttaaaattttcaaaaaatgtttgaattcggttcggcgtccgaaattgagcctaaagaagaccagattcgtgctaagcacctcggattaccccctgaaanaacattttctcaaaacttatttaaaaaaagttttcgggaccaattctttaccattgcccattaaaatactataaaaatccgcaaatgatgaatttttttcgctttccgcacgtttttcttacaaacccttgtaacaaattgataattgctacttgttttatatgttgccaaaaatgggatggggtgggcattctcttaaatcaccatcaaattcaatgactttttcattacatttccatcccttagacttccatttgacttttgaccattttctccgtctttccttatgcccgccgtcccttccggctaccaagtggtgcagcagggccgtcaaggaccttcgtgcatggacaagctgaagttgggcttcgccatgggtgttctgatcggtggctcgaccggcgttctcatcggcactttcacatcactaaggtttttcggggaagagatgtgcggatttaattaacagccaattaaagacttttttgcgttcagaaaaataattgaaaatttttattaataatttttggtagtactgccgatggttcctcccccaacccattttttgcagaagtatttttgagtcgcaaaatcatttttcttggggttttggtgtcgctaataatgaaatggcattcattttggcggatccaccgaccctaattcaaattattcaaaatacaaattataaatggttattttagagctcgatattttgaaaaaaagcctggacttgggtttcctggataaaatccaggtttacgtcggctctagttattttatacagattcaaaaataaattcaatttcaaagattagaattttttgatcggatggattcaatataggcccanaataaatgccccagaaatatg

SEQ ID NO: 28678 - DNA, 993 bp, Heterodera glycines
gagagggagacgggggcgcaatcgccatttaatttctcagagaatttttaaattttatcttatatccaagaaaaatgactatctcttattttgagaaattttatacgttacaaacgctctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttataaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcgtgataggaagggcggtgcgcaatcgccatttaatttcacagagaatttttaaatttatcttatatccaagaaaaatgactatctcttattttgagaaatttatacgttacaaatgctctcgagcatgagaggaagggcggtgcgccatcgccatttaatatcacagagaatttttaatttatcttatatccaagaaaaatgactatctcttattttgagaaatttatacgttacaaa

SEQ ID NO: 28679 - DNA, 927 bp, Heterodera glycines
ggtgatgagctgctccttcatcatgttaacgtaattgctgccgttgagcccgagccgatgggctatgaatttcccttcagcagtgccgaattgacctgggcaaaggtgaaattgggcgagaaggtcatggccgcggctgttgccgcacaggcattcgatgtgaaggctgatctgcggaagcacactctgttcgtcgagccggttgtcatcaacgagatctcaacccgaagcgttgtcatccaattcgtcatgccggtgacgagcattgaggagctcaccgaactgtgcaaaatctgggagatcgatttggcggtgggttgcaaagtcaatccggcagccaaggcaaagccttgtgcgcatgggtatgtgctaagcatcaaaaaaagggcgttatgtcgggggtacgaaattgatgttaaagtgatcctttcctaccaagaagcgaaggatcaggacgcgcaggaggaattcgatcagatgcgctgcggcgaactcgacggatgcgttgaactcatcccgcagacgtcagtcagggcactgcaggaacggatgttcactttgcggtccaatgactgctcgaaagtggcaacggacgaaggaaaggtgggccgaatcatgtcaattttattgggccgaccggtaaaaccggaaagcccaaaggccaataacccattatgacttttggggctctttcaaaattgaaagagggacaggttgacaccgcgctgtgcatgctcgacgaggtgccgcgcctggtcttccaacaggccgggcccggcaccggcaagacgttcagcgcggcatcgatcgtggccacggatcccacggcacgtgtgttggcgctggccccgccgaatgtcgccgtcgtcaagctggtgctggagatgcaggacgcactggccgccgggaaccacgtggagccgatgc

SEQ ID NO: 28680 - DNA, 1237 bp, Heterodera glycines
  misc_feature (1215)..(1215): n is a, c, g, or t
aaaaaggcttatatgatcttttgttacaggaatgatgactttcagtttgttttcatgcatttaagtcgttttctagacattaaccaaaatttctaaaatttaactttcgattctttgttcgaaatcgggtccggttttaggaattggtcgaaatggatgccatattcgtgatcagcggcccaagtaacccccgagtgtgacaaagaatcgtaaaaaaccgccttatttattctttttttatgggaccagtaaaagtaaccattacccactttttgacagtaagttagtaaaatcaattatcccataacttttcaatttgaccattttaatattaacttgacctattaattgatgcagaatttttttctttcggttatatccagagttcccaagtgtccttatttctaagatttgtccttatttggaggggccggatcttagaaaatgaaaatgtccttatttctaagatttatcttatttttgactcgacgtgcatatttcgatcttattttggatttgaaaataaaaatctacaaaattgaatactttattttttttattgaagcgaatatttttaattaattcgattttcaaataaattatattttacttccttttcttgagtgtgaatgcccaagttgcccccaaaacgtaaaaatctctatttgaagagctacgaaaaggaatggcacataaagaaaagtcgaaaaggcgaaggatttgccctttgtgtcgtctgcaacagggatggcacggaattccgacttacgaaatttttgataaagtcggaattttttcaaaaaattaacaaattttgcacaatttctgttaatatattgcatagaaattttcaatttttttccggcggcgcctatcggtaccgccggactcaaaaaatactcaattttctttaaaaattgctcaaattttgatctcacttgcccagaaatgtatcaggtgctcatttccaatcacaaactgttggatcagatcggtggatgggaaaaatactttgaatgatacttttttgaaaaaaaatattattttcaataataaaaccgttgtaattgtgcaaatttgttgtattttgcttttataaaagccaagctttttaactggttttacaaggtaaaaatcgattttttcaaaaaatcttatttttggggtcaaaatcttagttttaacctcgtttgtccttattttgtttgaaaaaanaaaaacttgcgaaccctgcttt

SEQ ID NO: 28681 - DNA, 979 bp, Heterodera glycines
atcactgattcattcgttcatttattgtaaaacataaatggaacagaattaaataaataaataaaaaggaaatgacaagaaaatttttaataaataaataatttttttagtaaaaactcaagggcatagatttttaggggtatatttttcgggtacactcaaaaatctcgccgccgaaatcgcgccgcccaaaatctcgccgggacaaaatctcgccgcagaaaatgttgaccccaaaatggcaaaattagtcttttttttggcgaatgctgaaatttttaaataacacagagaaagttttgactcaaggagcaaaaaaaaaaaaaaaaatattcgcattccctccccgggagcaggagtaaacatcgccgccgaaacgtcgccgaggcaaacatcgccacaattttcgaagattttttttcttacttgtcgaaatttgaattaggcggaattttggggtgcacccattttttagttacatgcgcaagcataagcctagccgcccatcctttttccctaacagtttatttatttgtttttgtcccatttatccaaaacaattcctcacaaatattcaaaaaatccgtcaacgaaattttgtcccgacgaaattttgggttgcaccctatttttccgggcttaacttctcgaaacgaatcgattgttatatcatttgtgcccttttttttacgggcggttgacaaaagtgggtacaccccaaaacgtcgccgggacataacgtcgccgcaaaaaaaaataaaatttttcaaaatttcaagaaaattgtaaagtattttagattttttgaaaatctaagtcttaataaaaactaaatttagttgaatttccggaaaaaaccccaaaaaacttgaaaattgtttttatttccttaaattttcttaataaaactaattgttttttaaatttttctagaattttttcgtattagcctaaggagctaaaatttttgacaattttt

SEQ ID NO: 28682 - DNA, 1389 bp, Heterodera glycines
aacatttctgacacacttccgaactcggaaatcgtagaaaaagtcgggaatttagaaatcattgatcgcccctcaccattcatccattggcgtacatccggaatgtattcttcgttggtattgttgcagccctcgcctcggcagaaccaatggagagcaatatccatcattcaaattttgctaaatatttgtaaaaaaaatgcatcaaaaaatctagcgcaaaatcaatggcacaaagtgaaaaaactaagcaaatacttaaattcatcttcgtttttgagtatggatcatttgaaagcattgaattttaatggtttttgacattaaatctcaaaaattgccttatttcagacaaaatctagtttgcaaacaggtcggcatccgctaatttgttaaagtttaaagttgaaaaaatttggactgaaaactttggcttgtcagaggattttttccaccaataattttgtgtcaattacttagtgtttttcactttaaattttgttacctatatgtatgaactttcggaaaaagggcctttgggtttggggtcgtccaacgctaaaagtgctcatatgtactgtatataatgcgatgatttgattgatggttagcattttgtacaaaactcgcacaacgtcggtgattccgttcccaaacgacctttttgtttgtttttttgctttccgcatgacttttattcggcgcgcttttttcaaaatttttttgacaacacaggctgagagatccagcgctgtgcataactccctaattacagaaatccgtgatcctaatcagtagagacaaacaaatcagcaatatatatattatatatcttttttctgctaacttcctacatatgtacgaataaaaatgcaataactacgaaaaagcacccttaagaatcgacctaaattaaaaaaaacaccccttaaattggaaatttcacaaatcgaaaaaaccagtaaccccattcgtaattacccgggcctaaaaaggccgtaaaccttgatatagatacacattcattcggattagtacttttccttccatcgcaatataccggggtttttctactaaatcataccgggccgaaccggctaaaattgaaaaagcatgatattgtgttgcagagattttttttgttccacgcttttaattttggtgtcacattaatcactgcatttcttttttttagcgctcaaatactttcttttgtcgtagcacttttaaccgttgaaatatcgacaaatggctgaagaagcggtcgttgtgccggagatggaatcgcttgctctcacttcttcgtcaccgtgttcgccggtgctctctctgctcagcgaggaaatgcttcagaaagaggttttttgacacaatgccacttacattttc

SEQ ID NO: 28683 - DNA, 573 bp, Heterodera glycines
tgatgagggccaatttttttttttttttacttttggacaaattagcgaacaaatatttatttgagaggggagagatgctaatggagaatggccacggatggggggggggcaagtgcccgatggccaaatggccgggccagacacgaaaagcgattagagagggagtgggaggaggggggggggatgggcgagaaaaactaatcggctaaatgaaatgatctggctcttaaatctcaagaaaaagtaatgaacagtacaaatagaaatttttaacgggtctaggaatgagattgattcactatggctcagaaaaagtaatgaaattgaaaaaagagagtctaattaaaaagttattgaataattaaactttgtaaaaaaataatgaaatgtgaaaattcaaaaaaaaaaaaaattttttagaaaaatctaatggatgaaaattctggtaaattagaattaatattttcaaaatgaatattaaaaaaatgattggcaacaaaatatgtagtaaaatcaaaattgagttaaaaatgcaaaaaatgaaatgacagctaaatgttcacagaaatgagg

SEQ ID NO: 28684 - DNA, 541 bp, Heterodera glycines
ggggaggggtggggggtgcgtcgggaaaagtgggttcgggatggaggatggtgcgcgggacggtgtggggtcgggttttgggggtgtgggatgggggttgcgcgagattttggggtgtgggggttaaatgcgcgggagtttcgccgcgcgggattgaacccgagagtgtggttggcccaacgcgttaaccagtcggccaccagtgcagttggcggggccgtgatattttgcgttaaatagcgcggccccctccccgctggacaccgccgccctttcgccgggcagcgcggaccccctctcttccacggaccccctcttttcactgtcgcggggccctctccgtcggcgcggagcccctctcttccacggaccccttcccaccattctgtcgtccgtcggcacggacccccctctctctccgttgtcgcggatctttccccaccattccgccgtccgggcggcgcggaccccgctcttcgacgtacccctccccatcattccgacgtccgtcggcgcggaccccctctcttccacggacccc

SEQ ID NO: 28685 - DNA, 1538 bp, Heterodera glycines
  misc_feature (19)..(19): n is a, c, g, or t
tataaaaatcaatattttntaataaatttatttgctaaaatgctttccagtttgttaacgaccagagctcgccaattttccggaacaaaaattcattgttcaaattttccaaattagttgactactcttcatctcccatggaaatttttatcgggaaaaaaacttttgtgctccttatctgaagtttagtgtctttattagatttttttagtttaatttcatttgcgaaatttttgttttttttaatattatcagtttattttatttcattaatttgaatatgttttcatacattccctccctgccattgaaaaaagccacaattaacccttccttatcttccgttcataatttttaatacaatagatttgagttttttaattgaactgcaatattaattataataaatttcattgtttgctaattttaaaaaatcaattaaaaaaatctgaaaattctctcatattccaggattcacttcttcataatttcatgtcacaaaaacttttttgccatattttattgtctaaagttggttcctttttttcttaatttactgtaggtgttgagacttaataaaaatattttattgtaatctttttaaacattaatttttaaatatttttaatgttgtttttttcgtgattcgatcaattttggaaaggtattcatttgttaatctatgttgatggacaacagctggtcatgaatagtcaatttcacagggaaaaaattccttaataaagcacatattttggcatttttgagtttttgcacaatttcagcattttttagaacataaaaatcccagctctagaaaaaatacatttttttttgtaaatttttggtcattttttaaattattgtaaaaaatttctttttgtatttttataaaaaaaatgtaaataaattgactcattttaaagattatttaataattaaataaaaatatttatttaactctgcgtgatgcagacgattctgagttctcaatgatatcttttcatttcaataattcttcagcgctcatctttctgtttaaattttcactaaattggcataaattttgttttcaatttttgcgaaatattttttatagtattatcatttttattactctatttttgttatttgagtgtttattttttttaaagtaatatttttacatttttactgaagattttatagaatttctacatttatttgtcgttttggaatgtttcttgtccactgaattcatttcagatccgccttttacaatagtcaatgggagaatatacgctatttgtcattttatatctttaatgttgttccactatttttcgaattttttgcaagaaagttccttcattcttgaatgcaacatgcaaatagtgcaatccttttttaaagatccttaataattgttttaaaatattagtttattttcgaaatcgacgtgccatataaatttgaatcactctgactgcaatattattatgataattggttttgacaaatagtaaattattttaatattaattgtgtctataatttaa

SEQ ID NO: 28686 - DNA, 1342 bp, Heterodera glycines
aatcaccgaagagaaaatttgctcatttttgggaaaatcgaaagccatgagaatcttccaacatcgtaagtttacgcatttattcttttttctttgcatgcaattgtttagatattggtgatgggatggtccttcacatggtcatccgaaatcaggcaaaaactttaaacacgcaaacatttgtaattacttaatgtaaactgtttacagccctcaacttcgacggcttccgccgcaacaactccctcagtttcgactgcgccgacgggtggcgctgcgccgaacttagctggaactccgccgtcgttaggcggaattggcgatcttttcaacaaccctgaacttgttcaaggcattctgaattcacctttcatggagaggtctgcgataatgtttgtttataagttcataaaccattttagtatgctggccaacccggacataattcgaacgatgctgagccaaaacccccagtttcagcaaattatccaagtaaagaatgggtcattttttgttgccttatcatgtgttgttattagaacaatcccgagctgggccacattatgaatgaccccggcactatgcgacaagccatggaaatgattcgcaatccaacggctcttaatgaggtgttttcaattaactaaaaacaattcattttattttagttgatgcgtaaccacgaccaagcaatcagaaatctgcaagttcggacaactcacatatatttaaccttttaaattcgtttacagggaattccaggcggcgaagcggcgcttcaacgcctttatgaacgcgttcaggagccgttgatgaacctaacacagcccggcgctgacaatgtcgccggttctggtgcacaaaatacaacagatgcttcaatggccggtacaaatattttggaaactattgagttaaggtaacatttactttcgtgcagcttctcggagtcagcatgccggagttgaaaatgcacaaccgttgccaaacccgtggagcagcatcgtgaaccaacaaaatcgtcaggctgcgggttccgctggcaatgcgccggcacagggcgcggcttctacaggcttaccatttgcaagtaaagtgaatgagtacagaattgtttatggattggacaaaggtctacaaatactcattgtttagacatgatgaacactccggggatgcaaagtttgttccgccagatttcttcgaaccaatcggcaatgcaacaactgatgagccaggacaacatgcgcaatttcacccaaatgatcggcagcaaccccgccttttttcagcaggtcaaaacaatttgtcttttgcaaacaccggcaatggtctataattg

SEQ ID NO: 28687 - DNA, 923 bp, Heterodera glycines
  misc_feature (33)..(33): n is a, c, g, or t
cgttttcgtaccgccattttcgtaccgccgttntcgtaccgccgttttcgtaccgccgttttcgtaccgcaattttcgtaccggggacattttcgtacgagttcttgtacaagcgtcagattcgattagaaaaacttaagaactaatagaaccaaaatttatcattttttgtttcccattcataaaattttgtagaaaattcataactttaacaaaaataacaaaatccgggacaataaggtcgcatctcatagtttcgggaaatacacacgaagaaaattgttaaggttttcgggactgacattggcattggcataattgtgctcattttgagggacaatattgttaagtccatctttactgaatttgtggaacacatagagtagagtgcaccatcatgcaccaatttatcattatttcgttttgttttaattatgtagttaataaaagcataaattctcaaaacattaaaagtaattacttaaagattaaaaaaattatttgaatgcaatttttttttgcaaatcaactcatacgaaaacggcggtacgaaaacgtcctggcccggaaaaaatgttttcttttgatggttttttgactaacgacaattttttttgagtaacatgatagcaccctgctgatcggcacaaaaatcaaagatggattggcccagctctgatgctaaaatgagtgatcagaatcaatgcaatagttttccacttctgttcttcgccttctcaggcgttaacactcgaatggacatgtcctgaccaaattaatccatttgtggtatcccaaattgcaaaatatgtcacatggaagcgtaaaaacatgcatattattttcccaaattgatggaaacatttctctaatccttaatttaagctaatgaaaatggctaagtaatacaatttttgaaattt

SEQ ID NO: 28688 - DNA, 1327 bp, Heterodera glycines
  misc_feature (14)..(14): n is a, c, g, or t
atgaatgacttttntgttttccatttcgcattttcaccacttttatcgttctttcatacaaattattattcccttttcccattttcattttcacatgggaaaaatgcatttttaaactttgtttttgtgtattgattgtcacacgtgaagtaattaattaattaattgaatacaaataaatatttatgtgcgaactaaaaaagtgttttatccaatgttttttttaatcaattaaattgcgttgttggataaggaacgaagagattttaacatttggtgataataaaataaaacagataaagtacatataattgttaagatttttaactcagccatacaataaaaaattttacaaaataaagcctaagcttaagtaggcccaagcaagcctaaagcttaggcctagctattgtacgagttgtttgtgtacaacttgtcataatacccgaaagacaactgttaattttaaataagattaaaaaatattataatttattttatttacttaataaaaaatattatagtttattttatttatttaattaggtatttttatttttataattcttgtaaattgttgtaaaggcgaggtcccaacagctgatttgtctgtcagctgagatgtccacagctgactggttctgacgcgtttaaaagtaatgtattttttcatttttcatttttggtatttttatttttttgtaaatttttcaaaaaatcattttgccatcaaaataagcattttgaggtcaaaaaccatcattttgaaaaatgtattcaaaatgaaaaaaactgacaaaaatgttttttgcggcgtgctttctccagaaaacatttgaaagtggctgtcggtgtgccggtaagcgccgccaggaaaattttgaaaatttgaatgcaatattatttaatttctcaaaaatcgcatctcaaaaaaatcataagtgacaccccccatgacctgaaaacgtcctgacacgttttttatcaaaccaattaaattcagctttttctatctattttcctttagtactctgtccttcttttcgtactcttttttttgtgaccattcttttctttttattcatttttttcaaaaaagtatttgcagtttttcaccgtgtacattcataatttatttcctcgtcgtcacaaattatccttctgctgcttttattgtgttatattctttacttactcaatttaatcattcatatttctcttttgcacaatgccttttttgcacctaatctcacaattattttcatttaacatttagaaattactcaatgacccgtaaaaggaatcgtttaaaaggcaaaggcaaaag

SEQ ID NO: 28689 - DNA, 978 bp, Heterodera glycines
tactacatgaaactaacaaattaaagtggctttaaataaaagttaagccaaattcaaccataacaaaataccaattaaattctcatccatcagtgatttactgtatttcctaaaattgagccctctggggctcaatttttcaaccctgctcaaattatcaaaatttaacccagaaatactaaaaattggcacttttttgatgtaaaatcacatacctattttgaatgaatgtaatttttacttttcaactaatccttgcaaattgcacaatttttcaatattatttggggtttttatcccattttttatacattatttgtctcggataaaattctcatttaaaagcaatttcacgacgtcattttgaaaatgccggcgaatgttcgaggggccaataaaatgactaatcgaactttgaggaaaatgtgagagaaattaggttaaaaataaaaaataaaaatatgtggttacattattttccacaatttagctggatttgcactgatgtttggatggacattttccccctttttgaccatcctcaactcggactcaaattggcactgatttcgccgcgtttcgatgttttagtggacacgcatttcaatggcggcacaacaaaatttataattcgaaaaacaatcaaaattaaaaaagtctttggcgcggaagaacccaaactttgtgtgtttaccggcaatgcaaaatttgtggaattttcgctgccggaccgtccgttacccaacaaaattcgctttaatttactttgcattgagtaatttttcaaattataattattattaaattagggttcggatcccgcccccgtcacccccgcccccgccggggacgggacaggttttttggcctcaccctcgcaattcccgcccccgccggggacgggacaggttttttggcctcccctcgcaattcccgcccccgcgactctgacccccgcaatccccgcccccgcgagtc

SEQ ID NO: 28690 - DNA, 1574 bp, Heterodera glycines
  misc_feature (758)..(758): n is a, c, g, or t
  misc_feature (836)..(836): n is a, c, g, or t
accaaaatcccccccccccaaataacaacaatttctcatcgattattccgtccatcgttaacgccgcaactttgggtctttacgttggcgtcgcaactgcctccaccagtcgcccctcctaaataacagcaatttttcatcgattctcttccgcccatcgccattatttccacaactttggatggcgtttaatttgaaaaaattattcatttgttttatgcgattaaagattttacaaatttaatatttaattctttaattttttacttatattcaaataaaaattaaatcccgaatcccgtaataaaaattaggaattattttctctcatgtgaggctttttttcattttattctaaaattatttaattttttaattaagcattcacaaatgattgaaataattattctttatgtattattttattcaatcatcatgcggctttgccaccgaataactgcaaagaaaactactttcatccaaatcttcgtcaagactcttggtggaatgacgctgactatttttgcccattccttggacaccatcgagaatgtgaaggcgaagatccaagacaaggaaggcatcccaccggatcaacatcgtctcattttttgcggtgggtttttagtgaaaatagttaaaaaacggcatttgtaattgttaaaaagaattactaaatcgaaaattttgaaactacaaattttatttgtttttattgtaataataaggaatgtaagtaagaattactaaaacatganaattagcgaaaactaatgcacttttcaggaaaaacgctcaaagatggtcaaactattgccgactacaacatccagaangagtccactctttacctgcgcttgagtctgataggaggagcgcggacgaggcggcagcaagcacaagaggtggcttaagggcactgtcttttgctcgcctgacggcgggcgctttgctcgcctgatggcgggctctctgctcgcctgacggcgggcgtatgctcgcttgacggcgggcgtatgctcgcttgacggcgggcgcttgctcgcctgacggcgggcgctttgctcgcctgacggcgggcgcttactcgcctgacggcgggcgctttgctcgcctgatggcgggcgctttgctcgcctgatggcgggcgcttttgctcgcctgacggcgggcgctttgctcgcctgatggcgggcgcttttgctcgcctgacggcgggcgctttgctcgcctgacggcgggctcttgctcacctgacggcgggcgctttgctcgcctgacggcgggcgctttgctcgcctgacggcgggctcttgctcacctgacggcgggcgctttgctcgcctgacggcgggcgctttgctcgcctgacggcgggcgcttgctcacctgacggcgggcgctttgctcgcctgatggcgggcgcttttgctcgcctgacggcgggcgctttgctcgcctgacggcgggcgctttgctcgcctgacggcgggcgcttgctcacctgacggcgggcgctttgctcgcctgacggcgggcgctttgctcgcctgacggcgggcgcattgctcgcc

SEQ ID NO: 28691 - DNA, 1610 bp, Heterodera glycines
  misc_feature (1518)..(1518): n is a, c, g, or t
  misc_feature (1535)..(1535): n is a, c, g, or t
aaatgtgaccaactgtaacagtctaaaaatagaaaattttttctttgggcaattttgaattaaatcttagcaaaaattagtaaaaataattgagataattaattaatctgtaatttcttttgtaaaacattgagtacccaataaaaataataataaacaatggaattaatgctatttattcaaagtgttagaattaagtaattactttccgctcattaccgttctcatctgatgcgccgccgattgattcaattggtttatttatttgtttttccccttctctaattagtgccgtaatcgatggctattagatgcactatcatacaaaaatgatatcccccgacgcacatttcgcttgtccacaaggaatgtgtgcaggtctccgcccgccatgaactcgctgacaatgcgcacgtcgtcgaacgcgtcgcggtagaagccgacgtactccaccacgcgcgggtgccgcagctgcgcgttgatgcgcgtctcggcgatgatggactgcacgcggaacgcgtcctttgacggcactttgaccaccacccggcggaattccgcttctgcgaagcggaaacggccgtaatacacgcgcgagttggggcctactgataaatatggggtgaattgaaaaaataatttacatgtttaaatttgattataaccggaatagatcaatttctcaatgtcgatcactgttgggtccaattcatgcacttttattggattgaagtacaaatatgcttaatgtcaattaataaatgtaatgaatgcaaaaacttgtcatgacaagactcttgattaacatggctcttaaaattgcattaattggcggacgaaacctaattgagaaaattcaccaagaatgaccaaattgagctaagtaaactgattagttttgacaatgcaatgccaaaatggacattaatgagagccagattatttcaattaaaaattgtgcttaattaccttttatgtccatgaaaaagccggcagtgccataggaaaagcgacttcgtcgcattttgaacaggaaaaagatgaaaaagcaccttaaaagagagaaaaatgaattgaaattgttagaaattgctgacgaaagggaagcagaaaatgccaaaagaagaaaaatgccggcaaaaaacgtaaacaaaaatttggagaggcaaaagtgagtgtcaaaatcagcggaagaagcggacagacaatcgtttttctaaattataaattaaaataatgagttttctaattatattttgaaattgacttttttcattagttttgccactggcagcccaagtctgttcactccgccaagttctcgcgcaattgtgccaattagggggtaggggcctaattaattaagcaacaattagagaagataatgaaagcatatttcaaaaatgataaaccatcatttttgctgtttgggcacacttcgttaaagtcgtcgtaatcaatcgcccaaatgtaagtgccgcccaatcccttctgccggagccattccatcttaattanatttaatcacaatttanattgggaactaattgcttggctttgctaatagaaaaccttaatccgaatgctccgctggtcgtcataactgaacc

SEQ ID NO: 28692 - DNA, 855 bp, Heterodera glycines
tgtttcaccggtcgtttcccacaaaacaattaaagggcttttggcttcagttgcgttgccccgggggaatatcctttcggtaatcactcatccgtccgcccaaaacttccgcgccacattcttttcccttttgccgtgccgttctctcgtccgatgactttgctaatccgctggtccccccatttaaccccctcaagcataatccccccaattacaattacgtcttttcccgctttacctttacctgtctcttcttcggcttttccagtggtctctgcgctccttggttcattttttggtaaaggccacaagcgttgcacaaataatgcccctgggcgtcgcgcctccacaagggtgtgctagtgacaccgcaattaacgcattggcggtcctccaaaaagccttaaaacgggggggggggggggggggttgaattgaccaaagcactgatttgatcaaagctgctgaatgccataatcaaaacccactgggcttcttcgcctttgttcccccattgtttccgtcgtttgcgtttcgtcccccgtcgccccttcggtgacttttcttcttttgtgcctttgcttcgttctgatggttggccatggacagcatcaaattgttgcaaaagggctgctgcagaagagtgggcaattccacctgaacaaaagaaagtcactgagcagcagaagagggaagcggcggataaggatttggactaaatcctcccgaatttgagaaaataaaaaacaaaattcgctttggaatttcacttcgggcgagtcgacggtcggcaggggaagaggcgccgaaatggaggagacggcggaagaaaaaagcggaacacgaggcggagga

SEQ ID NO: 28693 - DNA, 1056 bp, Heterodera glycines
atttatcctttgttatacctagtgggaacaagagggtggaacttcgatatataaaaccaagatggaaaaagaatttcgtactgtgattttacaaaatttaagctatttttcagacaaaattattttttgccacatcattattcgaaaaaacttttccagcagtgggtcgttgatcaagcggcccgcgttgaatggggaaggttaaattttattagaactcatcaaaaagaattaagagcatgcagttataaaggattagaggattttctttttaataaagccgaacaaacaggatcaattattcgaaaacaagtaattttaccttcgtcttttttgggcggaccaaggaataaagaccaacattttattgattctatggctattgtgggagagaatggcaaacccgatttatttttgacatatactataaatcctgaggatcctgatataaaaaaatgtttattgaaaaaccaaaaaacagaagataggccagatattgttgcacgcgtttttaaattaaaatatgataaattgattgaagaagtcgtaaaaggtgaaatttttggtaaagtgattgcttattgttgggttgtagaatttcaaaaaaggggtttgccgcatttacattttttaattaccttgcatccaaaggacaaatttaaaaatacaaatgacattgaccgattcattcatgctaatctcccaaataaagaaaaagaaccatttttacgttcattagtaaaaaatttatgttgcatgggccatgtggagaataaataaaactgctccatgtatgagaaacggaaatatgcgaacggaaaatgaatcacaaaattttgcaaaccaaattcctagatgtttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagaacctgtgaagagctttcgaatgatatcaagattgtttgattcg

SEQ ID NO: 28694 - DNA, 987 bp, Heterodera glycines
ggggggacttcccccgaaaacaaaaaaaattgatttttttcaagttttccgtttgggggtttccaaccaattatgggaagcaaaattccaccccagaattaagtacagggtatagggaagttattcccgaaggattcggtctccccataaatctgggcgcatcgggtcgggggggactgcccgaaaacaaaaataaaatggattttttcaagggtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcccccataaatctgggcgcatc

SEQ ID NO: 28695 - DNA, 1245 bp, Heterodera glycines
  misc_feature (107)..(107): n is a, c, g, or t
aggattatcccgattaattagctaaatgctttttaaatctgagtaatatttcagtaatatattttttcttttattaaaattatagtaatatgaatctaatatttatntagttaataatttacgggtgaagcgttattttctttttaatggattaaatataaatattgaattatttacacacaacataaatttttttgatataattcctctatttttccaaggtttagagtaagatttagtgctatatttgcctttattaataaaataataaaaatatctttctgctataagttcatattactaaattaaattatatctattaaatatttaattttcatttgattaatttaaagtattatttactaaataaatctatttcttgtataaatcattgctaattatatttaaataataataatttgagtattatttttggtattcatgatttgcattttaggttaatttgtaaattttataattgccttttttggattttattttttatcgaaaatatttttttacaatactttgaattttttatttttaatagattattttatgtgatatttttttatttatacaataaaaaaagatgtcttctttgcgatccgttgttgttaaaattatttgaaatttattttataaaatttatattttcttaattttttataaataattattttactttaattgccacatacatacattatttttaacgtggtgcgacatttgaggatttgacatttgaggactgacatttgaggacatacacattttcaaaaaaataaataaatggaaattttattttatataattataaaaagaagaaaatgcctttcccaaagggccagtggtaaatttggcaaaagtctttaaggacaaccgaataatcctaatcttctccacgtacagcatatagcatgaggatgccgagatcggcatttgaatttttctcgttggcagtttccaaaatcattggcattagtcggtaatgcaaagatctgagatattttaaagtggatttccgaacattcctgctttgggttcataacttttctccgcaaattccttccagataatcccaggcaattatcatgtttccattcctttcccatttcaatcattcacattaattacccaagttgaggtggaacaataaagatatcttggttaatatttggattactacgatcctgagaatggccagcccgtttcactatatgtaggaattgcagggaatttcag

SEQ ID NO: 28696 - DNA, 773 bp, Heterodera glycines
ccgttccttcgtggtcagagttttcagggtcggagtggtcatttcagtggggatttcaattgtgagatattcgttagagaagtcaatgtccttctcgccaaaatggcacaagcatttgtccttaaaattcttggcattaaatatacagtagttttatgcagaatcgtggacactgacatattactttttatcaaaaggcactgattgagcatttcaacaatctccccctctctcagtcgatgaacacttaattatcgcgctacggccgccatcatttctagccataccatttctcctccgtatccttaccccccccccccctataattaattaccaccccttccccgaaacctattaattaccagctgccccccatgattaattagggcggcaagatcaaagggaccccctcccccgaaaacccattaatcattttcacaccccacgatgagagtggtagggtaactactaattataaatgcagaatatgttatttacatcgcttataatttattttcattgaaagaagcaacagacctttcaatttatatccctttttaaaatttaaattttattttatcatatcaatttatgtaaaaattgtcattaatttttttaagcattttaaaaatccaattttttgtttgaaaatgtttttccttcgcgcttttatcatcattgccgccgcgtccacctttggttggtaaaaagcgaaaagggcgggggggggggctgtaaataaatgttatggaaaaattttactccagaaaatt

SEQ ID NO: 28697 - DNA, 1551 bp, Heterodera glycines
ttttgagttgaaaaattttttcaccaaaaatcttctaaaaacatgtctttaggggttatttgggccgctgatcacgaatacgtgatcagttttcacttttgacatcgctaagccctcagaatccctgtgtgattgggattctgggacatcttctgaagaggggggcggcaggttcgaatccggccggtgtaacattatttttctgtgcatttttacattattttcaatgattttaattaatttaaaatattttgttgagttaataaataaaaaaatttttacattaaagaatttaattatttattttttgaatttgtaaatttcatcttaaattattaaatattcaattgttaattttcaacgttattttcaattaataaatggaggatttaaaaatactacaaaagtccgcaattttttgctctataagataaattttaattcatatttttgtcaccttcttacaaattgctataaaaataaaagtgattttgtgctttgggtccaaaggggggtgcacatggtttttaagtggaaattttttttcaccaaaaatcctccaaaaatatgtctttaggggttatttgggccgctgatcacgaatacgtgatcagattttacttctgacatggttaagacctcaagaatccctgtgtgattggggattctgagacatcatttttggggagggtggcgaagttcgagtccggacggtgtaaattattttctttgtattttttgctgtttctacatattttaattaattgaaaatattttgtgttttattcgttaataatttataaatgttttacatttaaaatagttatatatatatatatctttttaaattaagttagtaccaattttttgaaaatttcaaacaaaatgacaaaaatcttctgattaagaatatttttttggatttttcgaatccggaattggtcgaaatagattcagaatgcggggggggggggagaaatttaatacatccaccaaaaacaaaatagtaataaatcgaaatttttgccgaggtttcaaaaaaaaattttttttttgtagttgaatttttcgtctggcactgacaacagctccaccggcgccgccactgcctcttcactgaacagttcaaattcatcaacaacaacaacaaaaacaagcgccaatgatggagatgaactgcgaaggattaaaaggaccaaaacaatggcaacgacgacgaccaccactgacagtggaaaaagtagcagcaaaagccgaacaacaacaaccaacacgacgacgacgacgtcgagcagtacaagcagcagcaaaaaattgttggtggtggatgaaaatgcaaaaacgtgtggtggtgttggcattggtgctgatgggtaagaagtggttgttacgaaaaaaatggaaaattggaaaaaaaaatttttttttgaattaaattttttttcgtaaaaaaacttaaaaagatttgaaaactaaaaaactttttaaaaaaaagttgaaggtggccatataaagctacgaccttctcccagaaaatttttttgaaccatc

SEQ ID NO: 28698 - DNA, 1272 bp, Heterodera glycines
  misc_feature (15)..(15): n is a, c, g, or t
  misc_feature (30)..(30): n is a, c, g, or t
  misc_feature (1206)..(1206): n is a, c, g, or t
agcagcagccgatgngagatggtggagggnccgaccggaagaagaagcgaaagcggcgtgttcttttgtgagtttggccgacaaattcccaaccgaaggaataaataggaagaaattcattttgaaattgccgacgcattgggaagaaatattattaattaatttaatcaatcattgttttggaatttaactggcaatttgttcagttcaaaagcacaaacttttgctttggaagcacgcttcagcacacagcgctatttgtcagctgcggagcgggaaaaattggcgcaagaaatccaattggcaccaacgcaagtgaaaatatggtgagacagatttttattaaaattattatcaattgttaatttttatatatatatatatatatatattaaatattttaattatttcttgttaaatatttaattttaaattggactgtaattttttaatttattaaaataaaattaactctgaaattagtgacagaatataaacaaatatgctaaaatgactttcaatcaaatcattaatcattattaggttccaaaatcatcggtataaggcgaagaaatgtccgagtgcaagcgcaagtccaaccgtcgctgagcacaactttcatcatccacaacaacagaacgggaaaaagtgtgcagccgatttgacgacgatgagcaaattgttacagcagcaacagccgcaatcatccgcctcattagcattgtcgggtaattaatgaatggttcccataatataagccaaggatgggagccggtgccaaataagtcaggaacagaacaaactgcaaaaaaaaatcataaaccggaatgtaaaaaatggagattaggcttttggctatgttaatttttgaccgggtttatatgggattcaaatattttttaaatattcattttgacataaaatcaattaaatagcatttttagcttggtttggaaataattgggtttttcgctcaaacttgaaccgagtttttgtgaaatgttttgtccatattaatccggtatttaataatcataatacaaattggaaaccgtccatccttctccctctgataggtgatgatccgcaacagcttcaccagcaaattgccatgggcacaatggcgcaacaattgcagccaaatcgggcaccaatggcgcccaatgcggcggcactttactcaccgattggcacaactttaatggngccaaccgcaacaatgggcgctggtattgggaacattcgtccacatggcaccacaacgatgttgcc

SEQ ID NO: 28699 - DNA, 1107 bp, Heterodera glycines
  misc_feature (34)..(34): n is a, c, g, or t
  misc_feature (77)..(77): n is a, c, g, or t
atttttaaatctggtgaaatttaaagtgaattanatactccaaattaaataataaaattaacaaaataaattaattnatggaattttttgtaaattagtaagattttttaatataaattatcattttttatagacaaacattctgcttcccttcattgcaagaacgacaacaataattcatcacaacaaattggcacatcaacaacaacgaaaccatccacaaattatgccattcaaaaggcacaatttttttaattgtgatttttcttttcatgggctaaaaaattctaaaactaacatttttaagcagataatcattaataataactaaaattctcatttttcaaatttttctttagtaaatttctcgggcatccagaaagaaattgcttggattgaaaactctttttttattccaatgaaattataatattttgatttaacaaataacttcattggtgtttcattaatttttgactcaaaaatgtaagaaatgacaaaattattgccaaaatcttatggaattagcttaatatgctttataatattaaaatgcccaaatgctttcatttacaaaattcgactgtattaacttttccaattttcatgataatttaattttaaaatgaaactaaattaattttccatttttaaaatccattttttcagctcagtgctataagcagcggaaagcggaaacgacggcaccgtacaattttcacggagtaccaactgtacacgttggaggaggtgttcaccgcctgtcagtacccggacgtacaaatgcgggagcatttggcggacaaattaaaattgcgcgaagaacgcgtggaagtacgtgaaactattttttaaaaatttaaaatattttcgtaaattctaaataacataataaatagtttttaaaggtattttatttttctaaaaatatttcgcaatttttaaaattttttttttgcatttgagtttttggacaaaatttattatgaaattgcattttgctgatttctcgattttttaatttttgtgctgattttggcattttgaagaattttctaaaaattttcagtgattttcaaaaatttattaacaaaaaagcaataaaaa

SEQ ID NO: 28700 - DNA, 833 bp, Heterodera glycines
  misc_feature (17)..(17): n is a, c, g, or t
  misc_feature (31)..(32): n is a, c, g, or t
  misc_feature (54)..(54): n is a, c, g, or t
  misc_feature (56)..(57): n is a, c, g, or t
tatacatttaaagtatntcgatgggatgatnntatcaattatctaataacattngnnatggctggaactaaaaattgtaagaattactaattttattcttttaaaattaaatggcaaaaaaaaaaggctggatgaagcagtttcactggatcgttcaaagcatcaggagagagagcgagagaaagtgggggtgaaacaaatttggtgatccaaaaaaatgagctgactctgatctgcctttcagacagattatgatgctgcccaggggatatgtgccgacgcccttaaaaatttcggcaatcgaaaatcggcattcggacggctgaaaaattgggcaatcggcaaccagccagaatgttgactcatccctggtgcatgtgatgcatgtatggtactgaatttcgaaatcgaaatttctgggacatatcccgaagttttggtccgcaatggcggtcatcaaacccgaggaaattcacagaattggggaagcagttttttcaaatttaaatttttttaatatgacaggtaaagtggctcattttagcagtaaaaaaaactataataggtaggccaaaatttggggtatgaaacaaactctgaacaaatccgtctacaatttcattttgatcgttccattaacatcgaacgatgaataactttcgatcaattccttcgcaattccgatggctcagcctttttgcgcggtttcttcggatttttggacctgcttctgcacttgcagcttggacaagtgggtgcattccgatggatcagctcctgacatgacgtgcacaccttgaacatgataaacaaattaggcaaaacttttgtgg

SEQ ID NO: 28701 - DNA, 978 bp, Heterodera glycines
  misc_feature (865)..(865): n is a, c, g, or t
  misc_feature (933)..(933): n is a, c, g, or t
acgcgaaatgagttgccaaatgaatgccaaagtgagcacaatttgcatcaagtgaagtagagacggtgacgcgaaatgagttgccaaatgaatgccaaagtgagcacaatttgcatcaagtgaagtagagacggtgacgcgaaatcagttgccaaatgaatgccaaagtgagcacaatttgcatcaagtgaagtagagacggtgacgcgaaatgagctgccaaatgaatgccaaagtgagcacaatttgcatcaagtgaagtagagacggtgacgcgaaatgagttgccaaatgaatgccaaagtgagcacaatttgcatcaagtgaagtagagacggtgacgagaaatgagctgccaaatgaatgccaaagtgagcacaatttgcatcaagtgaagtagagacggtgacgcgaaatgagttgccaaatgaatgccaaagtgagcacaatttgcatcaagtgaagtagagacggtgacgcgaaatgagttgccaaatgaatgccaaagtgagcacaatttgcatcaagtgaagtagagacggtgacgcgaaatgagttgccaaatgaatgccaaagtgagcacaatttgcatcaagtgaagtagagacggtgacgcgaaatcagttgccaaatgaatgccaaagtgagcacaatttgcatcaagtgaagtagagacggtgacgcgaaatgagttgccaaatgaatgccaaagtgagcacaatttgcatcaagtgaagtagagacggtgacgcgaaatcagttgccaaatgaatgccaaagtgagcacaatttgcatcaagtgaagtagagacggtgacgagaaatgagctgccaaatgaatgccaaagtgagcacaatttgcatncagtgaagtagagacggtgacgcgaaatgagttgccagatgaaatgccaagtgagcacaatttgcatncagtgaagtagagacggtgacgcgaaatgagctgccaaatgaatg

SEQ ID NO: 28702 - DNA, 1729 bp, Heterodera glycines
  misc_feature (9)..(9): n is a, c, g, or t
  misc_feature (29)..(29): n is a, c, g, or t
ataaaaacnttttaactggtttaaatatntcggtatttattcatttatattgactaaatacaaaatttattttaatctcaattaataatgattatttttaaattacctttgaaaggtttacataaaaaaggaaataaaataattttgacaatttattattttccattaatgacataattaggtaatattcaattgacacttgctggcattgaaaaggcatatcgatgacatatgccatgcaaaattaattaaatttgcttattgctgcttctggtcacttcatttgataataacagcggtgacaaacaacactaaaatttaatactattttactacataaaaatttagttttattattttaaagaatatttaataaaaatataaaaaaaaattaaaatttaaatgcaaattcaaaaaaaaaataaaatatgagaaaaatggggacaaaaaattaaataaaatattattcttcgcataattttttttttcaaaaattttcttgcttttcaattttcgaatactttattaaagcaagtttaataaataaaaattttaaattttaaaaatgacgacaaaaaaatataaaatttttgaaaaaatcagtaaaataaaaccaaatttaatgattttatgttttatttctttttaaaagcaagcttcctatgcttttatttgtagttttatttgggcgtttctgtcgtcttccgcccgtccctgggtcgcctgctccctgttttgggcacaatgccaatcccatccggcacggaatatccggcacaacggggggcaggggtgggaggggctcagccaattatatggatttgtcggcgggaggttttggcattgatggaaaaccttgagaaagcaagaatccgacaatttttgtctggattttgtttggaatccaattgagtggaccgccccgagagcgaagggacgggaaattgggacacacacaatttatgccaaaaaaacggcacctggcggatgcctcatcgcgcgatgcgttgaattataggcgaaaagaggggggggggggggcaaaaagctctcctctaatgggatttattcattcatttttcatttattagtcccgctctgtaattaatgagaaaaattttaaaggaaaaatgccaaatttggaaaaaaaaatattaatcaatgggaattaaataggcgaaaagagaaaacaaaaaattgctcagtgagaggaaatttttaaatttatatctaaattagaacttaaatagaaaatcactttttcaaaagcattattttaatttgagtgggtgggggtgggtttagtctgagccaactttaaagcatcataatttattatcagcagctggccaaatttgaaaagcatcaaaatgttgatatgtaaatcagcagagtttggataactgattaaaacattttttttattacgatttatcttcatttccctctctccattaatctacactattttctctatttttgtgtgtcttcactaccattcattcgtgctgggtcgtttcctaaaaaccgccaccatgggcgtttcctaaatccgccagggcgtttcctaaaaaccgccaagtgggcgtttcctaaaaaccgccacttggggcgtttactaaaaaccgccaatgggtagaaaaacaaaaaatgtaagacatataaattcatatcttggcccaatcgcaaccaaattaatatttcaaagtttcattcaatagctctatgt

SEQ ID NO: 28703 - DNA, 2166 bp, Heterodera glycines
ccactggtaatgaaggccgggacactgtatgtgtcgcaatatgcacgaattgaagaggaaatgttggagtatcgttcccgactaaacactttgcccttagctaccttacgaactatacaaagaccaaacattacagaagtgattaagctgatcaaagctgaagctaatgagacacttggtgttgtgttcggaaatacgggatggattgaaatgatgaaaaatattccggaaaaggcacggaatattgtgaattacgtaaaagggatttcagtggtactgattgcagtcggaataattatacttacagtaattgtcatttacgtaattgtaaagtaccgatttattattatggcgggactcagagcaggcacaattatggcaagagtaattagagcaatattcggtgttaaaaggagaacacgagttgccgccgtgccaacggcaccagacctagactcagtggaccaagaagcatacattttggattatcttcccccaagagttgctgcaattacaaatgaccctcgaaaattaccatcaatacgagtttatttaaatggtttgccaacttcagcgttggtcgattcatgcgctagtgtttcttattgtcgccaaagaacagcaattaaagcgggactcgaaataaaggacttaggcagtgaaaacccaaatttaacagcagcaaataattcatcaatccaaattattggaaaagcaaatgctaaattacgagttggagatacagaaacaggaaaatgtgcagaatgggaggtaacgttattagtgtcaatcgataaagattgtcctggcccattattactcggactgccattgttaagtgatttaaagggtgtaatagcatttggggaacaaaaagtgcgtattggtgaaatttggacaaacattgtctctgttcttgaggccgataaacccaatcaaattaaagttagcctcgatcagactgaaacttttgagccaagaacggaaaatattattacggcaagagtaaatgagtgtttttcagcaaatcaaaattttttggtaaaaggaattaaacatcagtacccaagtataataatcggtagaactttggtcacaccaggggacagtaattgtgttacaatacaaattttgaacgctggaaaaatgccagtaaaagtatataaagggtcaaacatcgcggaattggaaatggtcaaaattaatgctttaccaggggatgaaattccaccgaaagattatattccccccgagacaaaatggcatgaaaaattaccgtatttaccgacagaagggaaaaaacgactaccatctgaaagaataaatctgacggggacaagattgagtacaaaatcacaaacggaactaaaaaatattgtggacaaacatgatgaagcttttgtgggcgatgatggcaaaattgggttatacaaaggaccaattgtccataaaattgatttagttcccggttctttaccatttcattttcgaccctacagatacccacccgaaacgcagaaagaaattgaaagacaaattaaaataatgttggaccagaatatcataagagagagcgaatctgagttcgcatcccctatcgtaatggtgcccaaggcagataagaaatcttggcgttttgccatcgattaccggtcgctaaataaaatgacaaaaaagcgagtattccatttaccaaatattcaagaattgttagacttaatgggctctaaaaaatattacacatcaatggacatgcaaagtggtttcatgcaaattccaatgtcaacagaagacatagacaaaacggcatttatttcacaccttggcatttatgaattcataacaatgccatttggtcttactgctgcccccgatacatttcaaagagtgatgaattcacttcggaggcgcctaacagcagcaatgttaatttatctggacgatattataatcggaagcgaaaccgaagagatgcatttgattgacattgaaaactttttaaaattattaaaagaagttggatttaaattgaaaatggacaaatgccattggggaatggcagaaattcgatatttgggatttttgctaagtgaaagaggtattcggatggacccaagacaagttcaaacggttcaaaattttaagccaccaaaaagtctaaccgaa

SEQ ID NO: 28704 - DNA, 2043 bp, Heterodera glycines
  misc_feature (35)..(35): n is a, c, g, or t
agtttcaatgtcgtcattataaagacattcaatanccataatgaatagaccggatttatatgacaaaaaaatcgtaaattaaggacaaaacatggacaaaaaaaatacgaaaatataaacaaaaatttttgaaaattgatttgaatttttgaaaaaaaaaattcgtaaaaccataaaattttttgtcaagaagaaaaaatcattttaatattggaattatatgttgaattccataatgagaactccttctttattacttaaggaaaaatattaaaagtttgaaaaaaaaattgcaaaaattagaaattttctgtaaaaagtaattttaagcgaatgttgtcaatgaaatttttttcacaatttttgtttttttcaagagtttttgattttagtggtgtattttccataaatttccaaaaatttcccatctttttaggtatgtgtttttgaaattttcattaaaaatgccaaaatatggatgtaaaaaattgaaatatggataaaaacctgaaatatggaaaaacatgaaaataaaacgcatcctaaaagcatcaaactaaatttattcattgatatattgtgaattaaaacagtacattttttgtagtttttagcaaaataaatcaacagaaaaaagacaaaaaaatactgaataatgatcgaaagctaattagtagtgctgttcgagaccaaaaatttcccgagactcgagaccgagaccgagactcgaccccgagaccgagaccgaaaaccccgagaccgagacccaaaaaacccgagactcgagacttttttcaaaaaattttcctattcgcttaaaaatcgttaaaaacattttttgactctattcttaactaatttttggtttttttttaaattttgattcaatttggtacaatatttatcatttcaaaaacgcacaaaacaaaaattcattaaatttaagtgcaatttgttaactgatttagtccaaaaaatgaaaatattttacgaatttaattgttaaaattatgattgaattcccaccgaaaaatgaataattttgaaaaattagaagaaaaacaactacttggaggggaattactttttttttaaattttcttatttcttaaaaattatgaaaaattactattacgtttgaaataattgcatttattcaactgaaaaattatgaatcaaaattaaaatgcaaaaaaacagagctcccagatcaaaagtttcaaaagcctcatttggtatgcaaaaaagcctcatttttagtcaaaaacctcatttttacaactttattcaaaacacgcttattccaaaaaacttttggggaacaaggggggccggcggtgccgataggcgccgccgggggaaaaattaagaattttgaccatatttttagcagattttcattgaaaaaaattcttaattttgtgaactttggaaattggttattttatgaaaaatttaacaaatttttttggaaaatttgggtcagattttcgttttttccccaaaattttatgggtcctcaaaacctccgaaaatggctttgataagaaataataatttagggagaaaaaaacacctaaaatcactttcaagcactggaaagatatggggtatgatttgagtgaaaaattgtgaatgaaattggcgtaaagaaaattttattgaaagattcaaacaactaaatattaatatttttaaatttttattgggaaaattcccggtttgctttggttctcgtcccgtacgaaaatcgagttttccgtccctgtcccagcttctcaactcccggcaaatcccagtccaggaattgtccaaaatttccgcactactctagtttaaattcatcagagcttttggaaaagaacttcttactgaatgataaaggagaattaagctccttttaagtgtttttcaaacatatttttaatcattgagaaaattttgccggttcttttatttctttttttatcgttgaattaaatttttcatataaatttagtcattttttcaacaaaacaagttccaccatattttttataaaag

SEQ ID NO: 28705 - DNA, 1462 bp, Heterodera glycines
  misc_feature (1406)..(1406): n is a, c, g, or t
  misc_feature (1436)..(1436): n is a, c, g, or t
  misc_feature (1449)..(1449): n is a, c, g, or t
catccaaatatacttattatttatattaatgaaaaaatttgatccggaaagcgaaacaaaaaatttcaatttacagagagagtcctttttaaatgtaaaaatggtaaataaccattaagtgcatggtgaagtttgccaaacattaataaatacatttaaaaaatttaaatcacactgctttttgctgctgaatttgttccgacaaagcaataagcattggcaaatttgccttttgtataaattcaaaggacgctgtaacttctgcaactttttgatttgattttggacattctaaaatgattataagcagaaataattttattattaaatatattttaattcattaaaactttagtgttaacgtgagaagctttttgcttttcgccattacttttgtttccttctcaattttggcaattctgccactgaatttggtcagttctttaataatatcaaagatggaggagacaatgctaaaacaaaatttttaaatttgggtgaaaattattttatttatatgtgaatttcagtatttattaccagttgtttgagcagttttcgtgaattaattttttgtccatttaaaatttgaaaataaagtgaaaaagacaggattaaaatcattttaacctttaaattagaaaattattaagctgataaacttaaaatatatatatcaaacaaagattttatttcccaaatgtatgatgattattacccaaaggagaattggctggagatgggatttggaaaaaccgagaccagcagcaggagttgggactaaacagaaagagaaagggagggaggggtccgtggtgtagacactcgcccaaggggagaattttgactaagacatgcaaagagatttgtacaacttaacgccacatgggcgtttaataaatccgtaaaaaatctaaaattgatgaaaaaactaaacagttattttaaatttattagctactcaaaagaactcaatcaatgtgccctagtcaaattaaaaaaaagtacagtaagaaactgttaaaccgtaaattcacgaccggacctgcccggaaccgggaccggccgccaaattactctctcaaaagaaattacaacaattaattcaaaaaatgattaatataaagaaaaaaatgttggttaattttaaataaataacgaaatgaacatgaaagaatcattaaccattcgtgaatgaaaatgggcatacaaaggcaaaaaaaaaagtgaaaaggcacggcaaaatcaaaaaacggaaactgtgcagaaagggattaaaaataaagaactttaattcgacaacgacactttattcgataatcattactagggatgcgatttttaggcacaaaaaatcgcgaaataggcacctaaaaaggcagaaaaaaatcgcaaaataggcattnaataggcacaaaaataggcaaaataaattntttattaacgctntttaggtaacaaa

SEQ ID NO: 28706 - DNA, 807 bp, Heterodera glycines
  misc_feature (779)..(779): n is a, c, g, or t
aataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccataccttgccagagagtggagatagaccctttgttgatacatttggaaatgtcgagcccgcctagcgcattcgaataacacaaaatttgtttgcatttgccaccaaacaatccgcttatgacgcgccgaatgaaaattcacaaaaatttggcaccggaaaaactgcattttttcatgggccagcataataaagtaaaccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaaagctgaataaaatttctgttgcaataggcatattggcacaagacataaatgtagagcaggcacaaaatagaggaaaataccaaagattanaaattcttgtttatgccccactctgctt

SEQ ID NO: 28707 - DNA, 961 bp, Heterodera glycines
gaagaaacacaagggcatcctccgatttttcgctcattttaggggggggggggcgcctctcccagcacttcgactgaattagttggattgtttgctccgccacccatcttttatccaactattttttcgcgttaatttgcgcgacttactgccgcataagtgccgacaacaaatgccaaggtttgatctccgtcctgctcttgccaaggcattctctgtgcttcgtcaccaatcgcgcgtttcttcgcctctccgtcggcccttttaagcggaggaccatttgcactcgttgccgcccccttgtacgagcagttgtgttcggtaaccgtcctaaacgcggaattcctttggtttacccctacaaatgccacgattggtctgaggtcccaaactcaaaatagtcccagattgaaacttcttttgacgttaataatctcaaatccatccaaattcacttgagaaatgtccgatttccgtccgctgtcgtgtgaattcgtccgctgcacttttcgccgccctttctcttccgaacgcagcgccaaaaaatccgactcccatctttgctgatggtttccctctcatacacaaaaccatcatgcacatgccttctcaattcactttttctttccctggagcaattagacatttcggactctaaatttgaggaatgcttaacaaatctcttaatatgaaaaagcaccaatgaaaaagataaatttaattgtaagaattcgtttatgaataggaaaaaaatgcaaataaaaaatatttcagatttattttcatttatttacaagaacaaacaatagaaacaaaaaacaataaaacagtacacacaatatcacttagttttcgagttcgtaagtttgtagtacaaaaggaacacttttttactctgaaaacaaagaaaaatttttgatatgttttctaagaatgaatagagcgaaattctcaccagtgg

SEQ ID NO: 28708 - DNA, 1865 bp, Heterodera glycines
ctgaaaatgccaaagaaaaagaatggcaccaccgaccaatagggttgccttctgatcacaaattatttcccaattcgtaggagcaagcgcataacaacgaaggaacttgaggtttgttttattgcagttttctcgttttttccgatattaaaaacatatatatggttttcttgtgaattatacaacaattttaaagaaatttaagatgtgggccttaataaatgtggaacattttaaattctccagcaattgggcatttcaaatggaggggttattcctaccaattgtttcaaaaaagataattaaataagcattttcgctgccatggtcaaaatcgacacaaattttgcctaaaataacaaattttatgacttttggggcatattttgtcaaaattaatgcaccggtcaaatatttgaaatttgttaaagtttggatcattttcaattacccaatttcttttttctcttaaaaaatcatttccctcctcctcccatttccaaggacatcaaattgaaggagctcaaggagttgatcgacacagggttcaacgaggaccatttggaggtgtttcggtgttcggtgaaggggcgaagtgtccgtgcgtcgaaatgctttcaaaggggcgaatttgttgtggagtacaaaggttttccgggcaaaaaaaatgcatttttatttccaagttttttgttcatttaggcgacttaatcagtgtgaagacggcccaactccgcgaacaacggtatgccaaagatgagaacgtgggctccttcatgtactactttcggcaccgggacaatggtacggattggatcattggtttaggagtcgatatttcgaacaatttcgaagtcgaacctaaattgaaagttcaaagaatttttgttcaaaattacatgaatcggaagtattaatgctgttataacgcacttttaactaatttattttctgctttttttgtcgaatttggctctacgtgaattttacgggtccaaatttgagtcacgaatccttcaattattttgatcaattccgatttcctaatctaaatttgaacaaaaaatcataatttgaaaaattcaaaatttcgatttttattcgagttcgggttagggattagaaattagtcaaaatacacgtcagattcgtgattagcgacctttaaaaccccggataaaaaattatcatggtttttatcttaaaaaaattttgcaaaacaaaagggtccccccccccttttgtttcaaaaactgtcactttccatatagtgcccaaaattttagggtagtttaggccgatccattatgaattttaaaccgattttggacatgggcacaaaagtcatctaacaaccggtggtgaatttgtagggattctcaattaaaacaccgattgtggctttgaatgggatgccaaatccaaaaattttagattttgtgtaaacatcaaacaaattttagtgttttgtatcgacgcgaccgatgaaacgccgtacaaaggccgactgatcaaccacagctatttgaagcccaacctcaagacgagggtattcataatcgggcggacatgtttaataccccgatagtttcttaatccgctccatgaactccatattttcttcccaattcgctattttgccaggtggccgacttcggctgtgacggcttccatttggtgctcgtcgccatgcgcgacattgacaacggcgaggagttgttgtacgactacggggagcggcggccctccgtgctggcggttaacccgtggattttgggctcataggtggcgagcagtgtgcctctatttattcttttcattcactactgttttttctttcctttccttttgtcctttttgaaacg

SEQ ID NO: 28709 - DNA, 1520 bp, Heterodera glycines
tttgatacacaaattttttttattaaaaattttttttttaatttcaacaaaacacaatcatgattcaaatacccgccattattataaataatatgttgccattattctggcaagagatcaataccaatggaaaagtatttagggagttagtgttaagtaagtaaaaatggtcattttagaggtcggcatttttgatggcagatttaaagaaaaataaattagatacagagccagagaaatagtgattaaaaagagcaaagttaggactataagaacacaaaaatataaaattttaattacaaaaattgaattattggagagccgagactgaaagtggtctccaaaaacggcatttttcaagaccaccaagtaacataatgttttaaaagtggttttggaaattctgaatttaattaaacaaggtaaatcgggtatgttgagttcgtatagtcttagatttggtctctgggatcgcaacaaacctgtacagctcgaacttcatgcatggagttggagcagtacaagctcaggttgaaaagataggtccctttaaggccatattcggattctactggtctaaattgtatagaaaaactaagattttgttatatcagctttggtttttgaccataaaaaattcgagaaaaattagtgggccaattttcaattttggcatggtcgggaaaaaaggcagaaaaatctatcaatcaaataaaaagtgaaacgatagtaagatataaaagaggacaccatgaagaacaaaataaaaaaagaatcatttaaataggcgcagaaataacggagttatgaatttttaaaaattggaaaaaatttgggtatcataaattatgttccaccctaaggttataaagcagcacattagaacatttaataaatatattatctatagaactaaaattggatgaattctttatttttcataaaaaaaaatctatataattgaaactatcaaagaaataataaacttaaaataaattttaaagaaaaaataattattattcattaaaagaaatgaaaattgtataaaatccttgttttaatgtttcaattcattttgacatgttaaaaaaatataataaaatttaagaaaaattaccaaaacatacatagtgtaaatgaaattgcaaattaatataagtattttttattataaattcatagaatagaatgaatgatattagatgatattttcatatttgtgaacaagatataaatgcaattaattcatttaaaaatcaaagggattaaataatttatattttacaatcagtgtatcattaaaaacatttttagaaatcgcaatataagattagattattaaaatagtgacagcaacaataaaaattataaaatttaaatattaaatattaaaaaatatttctagtttcagaaacttaaatcaaggaattaattacatatgggcagtaaaaacaaaaattatgtatccataaatcatcaaaagttcataaaaaatattaaaaaaagaaaaaaaactaact

SEQ ID NO: 28710 - DNA, 1398 bp, Heterodera glycines
  misc_feature (216)..(216): n is a, c, g, or t
  misc_feature (1254)..(1254): n is a, c, g, or t
  misc_feature (1312)..(1312): n is a, c, g, or t
  misc_feature (1352)..(1353): n is a, c, g, or t
  misc_feature (1360)..(1361): n is a, c, g, or t
cagcggtatatataaggcctccaaagctctcaaactcattgtcttcaaatcgtttctcatcgatacagcccctcctgggcctacctatttcagtccctcccctcttaatgcgcgttattttaccccatcggtcaaatctgatcattgtcgaacccgtccatttcagtacccttacggtcatttaattatctgcatttcaaaagagtttgttgttgnttgcgccgcaattccactttcattgtttaatttgtgttgtgtgtgccccccgtccgtcccccggagggctgactgatcagttacaaaaacaaatttttaaatacggcatgggaaaatttaaaattttaacgggggaatttagggaaggggttggaaaatgcaaaaaaaaaaagagaaaaattttttattaaaaaaattgcgatttgtatccgcgaaagaaaaacctgtttaaaaaatttaccggtggatcagcgaaaaaagttggacttggaaaaaatttaaaaaatgagtcatgaaaaaattacaaaaaattgtgctttttgtatccgccggaagaaaaacccgccggaaagaagaagacacacggaaatgaggaaacggataaaaatgaatgtgtaaaaaagatgattaatgaagtaaaaatgtttcatgaaatcggagaaattcaaaaaaagaggaggctaaaaaaatttaatctgaaaaatttcgaaattctaaccaaaaattggggagggggaaccaacaaatttgaaaaactggatggaggcctgttggagaatttggcatttagacctaattaggccgaaaatagaaatatttttggcatttagaaatttaaaaaatttaacaaaaataaaaaaacggagcctagtggctgatttaaatttattaattaaaaaaatatatgtccacctcttcaatggtggcaagctcatcctcgggctgttgagccatgtaggtatttcttgagaaaattttaaatttttgaaaagttttcaccaaaatttactcacaataaaaatttggaaatttgtgggcccgccttggacgaaccggcgaacagggaaagctctcggttgagcaatttgcggaactaaaattttgaatttttttgaaatttctaaatttattttttttaccttgctggaggccatttcggtgagcgaagtgcggaacgatttgacctgttaagcaaaaaatttttaatgatttaattttgtttcagatttttaaattggtgccaataacttttcttanaatctttgaattattttttagaaaataataaaaattttagataaatttgaaaatctanaaaaaacaagtgtaaagtaagacttatttattttttctannatccttnncaaacatatttatcttttttatatatttttgaaaaaa

SEQ ID NO: 28711 - DNA, 1899 bp, Heterodera glycines
ctcggatcccgttttggattgtcgttttcgcacataacgggggggcgatcggtgcggtgaccttagattgtcgttggtttaccaagcaaagcttgtacggagattgaccatcgcctgtcgctgcggctgtgcaacttcgctgtttcgatttgatttgcgatgagagtcgaatgagccgttgttcccgttcaaaaaggaacatctgccagtggaaaaggttgctttaaacagtgatttgtcgtgtctttgcgcttactttgtatctcttccgccatgctatttcgtccgtctcgtcgtcctcctccgcttcctcctcatcactgccgaactcttccctcaatttggtcaattccttcccaaattctttcttgcagtgatttttccacaaataattcgtatcctcacggagatactgaaaaaaaacgaaattgtaattcattttagccttagcaaaaatagaaattgcaccgggtttttcttctccagtcgcatcagctgttcggcgttagctttctccatgatcggccttaacacatcaaaaggaatgtcgcccgtctcatcgattgctaaattaagcaaattccatgctcattatcagtctgtggattggaataatgaataggccgtcttgcaattacttaaacacccttttaaaggtgaaataaagttttggtatgcaattgttcatgatagggctaatccaaatcatttttgaaaattcccattcccaaccccgaattggcaaataccgtctatgttgttgagcaaaaatcgcatgcaaatgtcgaaaaggtagggcacaatttgcacatcgcccgtcgtttttcgccttcccgcataaacgcgtttcttttctttgggcgctttgaacatgtttatgttgaggtcggtgggcatggatatttgctgattgtttggttggggttgggctaacaataagttagcattcattagttgtttccatttaaccaaatttagaaatttaccaatggacggtccaaagttcgatggattcttcaacgaatccagcaacgaattttgaatgctttctgcggagggcatcgatacctttttgggctttttcggtaaacttttttgtactttgtcagcagcggcaagttgggaggcgaaggcgtcgattggctgctcatcctcgaaagtttcgcagtcatcgtctgaaccggactaatcttatcaaattatatggtttatacattcccaagggtggcaagccgatatgaaattttttagaggttttcaggaaagctaaaatttctgaaaaacttggattaaaaaaatttaaataggaaaatctctaacgatggaacgttagaaaattaaagtttttggtcttttaatttcaggggggaaacgaagcggggtgaagcccactctttggatgtgtttcatccattcgctcgtcctttacgcaccaaagtggtgtctctttttcgcttccgtttcttcgttttgtcttgctgattgtgagagtaattttgttgccgatgaattgttgggtgttgttgcgtgtttcgttggagatgcttcttcctgcggttcctttttgattctcaacacaagtgggttcggtcgcgattcctcgttgtcgtcgtctgtccctattcaattcggtcttcgcttgcctttggtcgaccctccgttgtccccaccttcttcgctttgactcttcgctctctcctcttcctcccgctcgtcttcctcttcgcgttgtgtctccgtccccattttcattctgtcgttgcgcctcttccgccgcgcgtgccgtctccgcctttgccacttccttccacctggacaccaatccggccgccctttcgccccacacgatgatgttttctcgagagcattcaccgctttaccaactcctttaaaaaataa

SEQ ID NO: 28712 - DNA, 1067 bp, Heterodera glycines
ttggcattggacaattattattttttaagaatatttttgtaaaagcaaataaattgttcaatattattgaattaattaattatttaattgaattaataaactttttccattctattaaaatcaaatttgtgtaaatagtttagtattgtccttttttaaaaatatatatttttaaatttttaatacctttcttttaaaaaatattatatttggtatttttgaataaattatgaattcttattagaattattactgttgattcaattaatctattataaataagttttaatatgtccacgtcgtcgtgtgattttgatcaaaatgtttcaattaaataaattttcaaaaatacatttatatttcattaacgcgtattatttgatttgattaaatatgattttagtcttgaatttaataatatgcttttaaacgaaaacttcagtcaattatttcaaataaaaactgagtaaaaacttgaatccagcactttgaaaatcctggctttattttgagtttttagtttccgcccgggattcccaaatcgcttttttcatttctcgtttacggaattttttacatcgattttatttgtagggtaaaatttaccaacgttaatcaaaaattctgaacaaaaaaagaatgataatgattgtattggtttattggtgccatgtgatttcgtcagaagtgatttcgtcagtggttgatttcgtcagaagtgatttcgtcagaagtgatttcgtcagtggttgatttcgtcagaagtgatttcgtcagaagtgatttcagcagggattgatttcgcaagtaattaatttccgtcagtaattgatttccgtccggaaaaattatttttaaaaaaaatttaactattcaaaattaaaataaattccaaaacgccagtgatattgaactaattatatttcatatgacctattaatacatttgtatgcaataaataatgaaaatatattcatacattaaaatacgaaattttatttgcctcttcactctccattggtcactcttatcagagaaaaagaattcttttttgagggttgcctctg

SEQ ID NO: 28713 - DNA, 813 bp, Heterodera glycines
tctcttttttgtgagaaattttgtaccataaaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttatatttattctctatgccagaaaaatggttatctcttttttgtgagaaatttgtaccatacaaatggtcccagcat

SEQ ID NO: 28714 - DNA, 1096 bp, Heterodera glycines
tttaaataaaagtcaatagcatccaaatcaaaaattgtttctctgactctctcccctcccctctcctccctccctctcttctccttcgtccccttgtcggcattcattcgcattcgatccctccctctccaccccattttgcatatccctccaatgttgcgcttaaagcggcacttccccggggaagacgatgaactgatgcttatcttccattgatttttcatctaataaaatgactccgtccattcttcccgcctttcttttctcttgggaattcgcttgtgccccccacgatttttaattttgcaacaattctatctgcagaaccctcacataagtgggaaagtctaactttaaccggtttaaggaaaatcatgaaaggtttcttaagtgtcgggtcatcttcaaatttagggtaaccgatgaatcggttttttgtaccgaatgaattatcattcgaattgtgtcacatccggacgaatcatccgtcatacaatagcactgaattcacttcttttcttttcaaaatttggattttctttggaattctctttaattaattgcactctcaatttctttggtatttttctgctccgaaatgctccattgttttcacgttgtcagatgaaataattttggatttgctttatccgcttccattcttttgcttttcattaaattcccttattatttttcattttgattgcattttccaccttaattaatttaatggctgaatgattagattaactctcttttttcccttacggtgaaaacggactttggcattccgtcggttcgattcattttctgctgatcaatccgaattatttgtctttgatcattctcaattcattgttctcaatgcgataatgcacaaagaaagggaaatgtttttttgtttgcaaatgattcccttccgccgctatgcgttaaaatcgtttaaataatttgcgtttttgcaactgatcgacattaattaatcccggttaatttaatcgtattaaacaaagctttatttttggattttgtgccgatttaaatgttttatgataattgggacccggcgctgcccatagacaccaccgggaaaact

SEQ ID NO: 28715 - DNA, 1194 bp, Heterodera glycines
gtcccgtacttttggtccagcgcaattcttcaccggagcgggatttttaagatttccggtcccgtacttttggcccagcgcaattcttcaccggagcggaaatattaattttccggtcccgtacttttggcccagcgcaattcttcaccggagcgggatttttaagatttccggtcccgtacttttggtccagcgcaattcttcaccggagcgggatttttaagatttccggtcccgtacttttggcccagcgcaattcttcaccggagcggaaatattaattttccggtcccgtacttttggcccagcgcaattctttactggcgcgggatttttaagatttccggtcccgtacttttggcccagcgcaattcttcaccagaacggaatttttaagatttccggtcccgtacttttggcccagcgcaattctttaccggagcgggatttttaagatttccggtcccgtactttaggcccagcgcaattcttcaccggagcggaaatattaattttccggtcccgtacttttggcccagcgcaattctttactggcgcgggatttttaagatttccggtcccgtacttttggcccagcgcaattcttcaccggagcggaatttttaagatttccggtcccgtacttttggcccagcgcaattcttcaccagaacggaatttttaagatttccggtcccgtacttttggcccagcgcaattctttaccggagcgggatttttaagatttccggtcccgtacttttggcccagcgcaattcttcaccggagcggaaatattaattttccggtcccgtacttttggcccagcgcaattctttactggcgcgggatttttaagatttccggtcccgtacttttggcccagcgcaattcttcaccggagcggaatttttaagatttccggtcccgtacttttggcccagcgcaattcttcaccggagcggaatttttaagatttccggtcccgtacttttggcccagcgcaattctttaccggagcgggatttttaagatttccggtcccgtacttttggtccagcgcaattcttcaccggagcgggatttttaagatttccggtcccgtacttttggcccagcgcaattcttcaccggagcggaatttttaagatttccggtcccgtacttttgatccagcgcaattcttcaccggag

SEQ ID NO: 28716 - DNA, 1013 bp, Heterodera glycines
gaaatccctctaacagattttgactgctgccgctgccgtgttcaatgcctctgcacccgttgaaacggctgctggcggttttctgatgccattgcccccgccgccgcatcaccacgccaatgccaatgccaaccacgccctgcacgcgtcgtcctcaatgcttttgcctccggcaatgccacaacattcgcagcagcagcagcaaccgccgctcccatcacccgtggcactgctcggcacttttggcactccgcccgccagcgacaaagtgatgacgccgccggtgtgtccgccgctgttgcccagtccgaccacaaccattgcgccgacggcactgcctaacattgctcattgtcagcagcaacagcaggtgatcagaggggatgattagaaactcatccaacactgacaataatcaatgatcggaaatcaattcctctcttttccctcataggtttcggcacagaatggcgcgccaccgctgatgcccgccatggcacggatggagacaatgttggcattgctcaacgcattcagcaacagtaataatggcacaaatggagtggtcccccaacagctgcaactcgtcgaagacatcgtcaaacagcaaatgaatccatttgacgctgttgggcctccggcactgccaacgccggcggcgacagtgtcggcgttgcccaacccgagaccgatcaacccgatggatctcgaaaggtgccaatgaaaatgctaattttaagtaattcgttcaaaatttctcacaaatctaccgtaatttcctcctacttttttaaaaataaatccaccataatcttttccacaatttttcagacttttgctgcaggcgattgccttccaaaagcaaaaacagcagcaattactagtagaaatgccacaacagcagcaacaacaacagcatcaattgttgctgccttcgctggtcggcggcgctggcgacgcaacgagggctccgcagtcggcgacggggggagcgatgtgccgcccgccggcga

SEQ ID NO: 28717 - DNA, 1176 bp, Heterodera glycines
ccccccccccctgcctttcccagctccccccctttggcatatgttacacaattcgcgcagcatttgtccaaatccgccgcccatacgaatcgcccgcctattcatcaattcccatccctaattgagtgtgtgtggttggctctgttctcgcccccccctttctgtcggagaatcgcttcgggggattatctccccgccggggatggaatggatcttctccaccccaacctaagcggggcggcaatacatttccgatttgtggggacggacggacggcgggcggatgaatggcaaacaacaaattgcccgatttccgtattttacatgcatacatctgcagagagagagagggagagggggagagagtgtgtaaatgtgtgccccttttgccataccaatcattttcggagtttgccttttcgagactctcgacttgtttgatggatcattttcaaaatttgatgcaattttattgcctatgtcagtcacatcatcgcttttcgcctcctctgcctttaaatttaaacatcgctgcggcaaccgttaggtgaattgccggaaacaattggcgggcccgccagccgattccttccgccccgcggtgccgttttatttctcagcccgtcgtcgttggctgtgccaccttttgccgctcacttttggcacttttaccggcgattgacccctcctcccgcccccgacaatttgacctggccgggcgctcaaattgggcgcaaaatccccctaaaattgaacacaccggcaaatgatgaagggcgatgaatgacagtggcaaaaagtgatggggcggaaaatgggggaaagtgagggaagggcacggactttaaactgagaggtggtgagttatttgtccatttgagttgaatgaccgcgccgaagttcagcggagaaatgaaaaggccaaattacggtagtacagtaatatacagagcaattggccataaaaattttaaaaaattttcacgttggatgggtgccgagattcactctcgactgagattaattaaagttcaaaaataatgcttctccccctcactaatttttaaatattttttacaacgtgctgtgacacgcaccacatgttaattaaatgttcaataatgctctctgatgccttcactatcagaaagggatatgaataacaaatctaaaaat

SEQ ID NO: 28718 - DNA, 1388 bp, Heterodera glycines
  misc_feature (1360)..(1360): n is a, c, g, or t
tcttttcataaatgccagaatttgtgccgttctttggagaggtgccatttttaaaaatgccattgatgaggtttcagcggcagtgttcgatttatgcgaatggttataagtggtcggtgacgcaaaaatagtcttcttttggtagagtatctgttttttgactgcgcaattttctctttccatcggagtgaaagtgccaaagttatggcggagatcaaaatctaaaaaaggaaatattgaattgaccaagtcattgttaaactcaatttaataatggaatttaccttcgtccttcgagtggttcagtgtctcgttcattggaaagttcgtttggtcggtgctcatttataagtcgatttgatcattgtgaaaaatacaataaatgcataaatacatgtgctaaattgttatttttgaatagaaattaagagcacattaaatggttttgacaaaggcaaccaattaaaaaaaaacaaattagcagcaatttaaaaatgaaaaataatggcaatatttctatttgaaaaataaatcaggtaaataaacagaacaaaacaaaattgatttctccttttattttatacccgcttacagaaaaaaattacaatgagtattcagtgtgatggcaccgagaaaagttgaatgaagaaagacaaaatgaacgataatgacttagtaagactaatgagtatttatttatctgtctacatccgtttgaatctcttcgggtcctcgcgataatcgtccggtgttctgaacattgcatccggaaatgctggagaggcgccttcaccgcaccagcgaaattgttgaaaaatgacccgagcctgataaagaattaatttttggaaatacgctttttgaattcccttgcctgaatcgtcgcaaaaattggcatttccacgcgtaccgggaacccctcaggcagtttagcggtgcaaaattcgcgtaatttggccaccgtcggattcaccggctccatgacgctgagaatgtcctggagaacaccaaattacaaaatgtcaaaagttttatgttttgtttaaaagatgagaaaagaaagacccgcaaactcttacaagtgccaaattgaggctgatcggaaaatcggtgctctgtaaaaaattgtttgagtgaaatcacaaaaagaggcaatggacagaccatggcaagcattccactcacgtccttagtggtgactttggtctgaatcggtctccccaaatggctttgttcgtcagaaacctaaattttttacatttttaaaaactttctcgacaacataaccctgaggtaattggaccaactgatttttggtcgaggcggaggttcgagactctcgaggagattctgaaagaanttggagaacggaataaacgcaaaaagca

SEQ ID NO: 28719 - DNA, 2365 bp, Heterodera glycines
aagcgggggaatccaaaagggaaggttgaaattcccaaaaatttccagtttaaaaattcggtgttgaaattgtttaaatttgtttccaagcttaaaattttagccaaaaaaaattcgggaaaaataagggaataattaagcgtcacaaattttttgttgccatttccagcaccataatgacagaaaaatccatgaagaatgaatgggagaatggaataaggagggaaataggaaaaaaggggcatttttatactaaaatattagcgtaccaatttgggggtgggaaaaaaagtcgaaatcggcgtttgtcggggtataaaaaggaacggggtcgttgacggcgaatgccattctaggtaataggtaagttttctgtagcaaagaaaccttttaggttctttatttagcactaaaaaattttatatagaaaataggtatctcaaattttcgcattcattattcacaattttttcaaatttgtcagagtttgtgattttgaccaacagcaatctttgaaatccaaaaaaagacgctttctattttgtacgcagagaaatatggagtttttcacttaatctctgcatatcctgaaatcactgtgcttcttttttaggtacgcgatgcaaaggaagctcgagatttatcaagcgtaatgtccgtcgattttgtataataattgattgaattcgatatttcggtactaattttatatatcattgcacatttcgttcctcattttgtataattcaggcagaaatgggccgattcagaccttaaaagcagagagacagaacgctttttattttgtatgcagagaaatatggagttttgaattctatatgcgtttttttgttgtaaattaatgtaaaatatttctgcttttggatgaaatttatatttttgatcgtcctaattaattatatcggatcataaaagaaaaagctgcaaaaacctcttttaagaagcgtcggggttcggggtcgggattcggggttgtcggggttggaagcgtcggggttcggggtcggggttttccccgaaatgaccaaaaatgtcggggttcgggcggggtcgggggttgcaacccatatttcaaaataaaaattatagattttaaaatatttctagttacataaaattgaatttaatatataaattcttttaattttaattcttttaaaaatgattagatagttcatcatttttataaaataagaaaattatttatttcttttttttctaagttttttacaccgaaaaattttgtgattgtgaaaaattgcagttccaaattcttacttccacgcatcaaaaatataaaattttttctatggatactaatgtttaaaaaggtcttgaatacgtatttatgtgctcgagagaacaatctgctgaaatgcatttttaccagatgaacagttggttttgtggcagaacatatattttgcatcagcgggacattctttaacgatgaatggctcttcctccggatcaacaactccgattgacccttgagcgcattccaatgctcaattaagaaattatttaatttaatcattttgttaaataaaaaaaaactaaacaaaattaccatcacaaaaattgtgcataaatgcgagagcaaaaaaacttgcgacaacaaaaggaaggcgacgaatggacattttgagggtatttaattgtttatttttatttttggaatatctgacggacaaaaaattatttattttaattcataaatacataaaatattttgtaaaaaaattaatcgaactaaaattcctttttatgaaaattaaaaatgaaaaaatgagagaatgtgaatgtttggtgaggagcgtaatgattatgatgattcatttggaacagaggattttattatattgaataaattaaatggtagaaaatcatacagctgtaatcagaattaaatcaaataaaaaataattttataaaatgaatacaaaaattctagttaaaatctttgacttaatttgaaaaatcaaaggaattgttggttcgcgttgaattttggatttatgttgaatttttactgttttgtccaaaaaagtgttttaaaatttagccacgtcatcctctgaaaaaaacacagaatatgaggctctttgcatagttgagaatcattttgtttatgtatttttaaaaaatcggcaactaatattgttcattttgataaaccattattatgcaaagaaaattttgggctttttaataagccttattacagatttttattatgggtctatatattttgataattttataaaatcaacttacaaaaatgcaatttttttgaaatttttgaatgaatattatacatagtaattgcgaaatttctgtaaaa

SEQ ID NO: 28720 - DNA, 961 bp, Heterodera glycines
  misc_feature (941)..(941): n is a, c, g, or t
taatccgcgacatgttcgggggggggggggggctatatctctctgctcactcgtcgggtgatgttggaaatatatgtccgcctatttagcttctcgtcgtaccagtgcttttctagcattgaaaaatgtccgaaatttggttctgccgttgtttcaggtggaatgtcccaacgtttgctggacgaaacaggacggccaaacagtctaaaacagctttttttcctaatgataaccaacaatgttggatttggtcggaaagcaaaaaaaactcacgcaataagttcatttcttgtaagaataacttgttctttttttctgagtagcctttttgaacactaaattttttgtaaaaaaccaaaattatggcctagacaattattaaaacttactcgctcaattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggctgatttgcgtcatatgcccatttttgcttttttaatacatcgaacacataaatctaaattaaaaatttctaatcattgcattaggtgttgacctttttaccaaaatcatgctcatttcatgcgcaattcttttatctgattctgaaggcattcgggtcttaaaaatcgaataatccgcgacatgttcggggggggggggggctttatccctctgctcactcgtcgtgtgatgttggaaatatatgtccgcctatttagcttctcgtcgtaccagtgcttttctagcattgaaaaatgtccgaaatttggttctgccgttgtttcaggtcgaatgttccaacgtttgctggacgaaacaggacggccaaacagtctaaaccagctttttacggtaatgataaccaaccaantgttggatttggtaggaaag

SEQ ID NO: 28721 - DNA, 1713 bp, Heterodera glycines
taatttccccccccccctccccctagggtgcttattattaagctgccccccccccattttcattaatgcattttcagtgggaaccttgcctgttggatttttaacccaaaatttagtttttagtctttatttatggggaagaaacggcacggcgccttcggagcattggcacaaatccatggaaatctgatcggaatgaaaaataaaagagcttaattgactaattccctaatcagatttataaataaattccatttaactcaaaatacagccaaaaaatgtcatcattaaaaaataatgcatcgtttttgatggaaaaatcgcttccagaaaaagtaaatagttggaaaaaacaaaattatttttagagcccggacgagacttttggtactgagactggttttttttcactcgagaatttcgtaatgaaatattttgcaaaaagtttcaaaaagcccgcaaaatttttccgctcttggccttacaatttaatttgaatgaaaacgccggcgggcaatggcatgccaaaaagcccgtttttgccaactgagcgccgaacaggctttttccggcatttttaaaacgcatttttcgttaaaactttgctttaaaaaaatctggaagttatcaaatttagcaagcattaatgttaattatgagtgtcatttttgagaatttcccaaaattttttattgagaaattcttagttagagaaaaaaaaagcccgtctcagtaccaaatgtcccatctgctgactgggctcttattctttttatgtgtataattaaaaaataatgtttttcataaaatttagaattccacttttcctgtgattgtaagtaattaaaaataatgattaaaatgaaaaaatttaattaaaattattatacatatggaaaaacaaaaaattaattctcaatttcatcaactttacaacttgaggcggtggtgctcggatcaatcggtcttatcatccttttcgccatattgttgttgatgtgcgcgctgatcgtgatgatccgccgcaggggtaaaatttcaaaattaaaaatttattttattccaaatattttgaaatttgaaatttcttttttcattgcgtattatttcatggcaatataactaattaatgcattgtgattgacttggcaaaatttgttagacatttttcattttttttttgccaattttttggccatttttcccctaatttgagccatttttttattttttcccctaatttgagccattttcattttttattttttcccaatttttgggggccattttcccccaaatttgtactattttttcatttttccccccaaatttgcgccatttttccgcaaatttgcgccattttttcctaatttgagccattttcattttttattttttcccaatttttgggggccattttcccccaaatttccttttcccccaattttagctcttttcatttcttcccaaatttgcgccatttttcccccaattttggcggcaatttttcccccaatttacgccgttttccctattttgagccaatttttaatttaaaaatttttttttgtagccagcactgtccgttcacagcaggcggttgaccagcagggctgggctctagtcatccgcgaactcaaaaaacatcatgctcggcacggggcggccaatggggcagccccacggagtgcatcggccggcgagctctgaaat

SEQ ID NO: 28722 - DNA, 1639 bp, Heterodera glycines
ctctggctctgacaccaaaacactgattctcacagtgaagcaatttatctctcgtttggagctctttgtgttgaacaaaaacagtggcggcgaacgcggcgaaccccgcggcgccatttccggtccatttttccaacaacgacaacaaaaacaacagaggagcagagaaagagagagaaaacggcagacgacaacgacaccgccttttgtccctcaattattatctaattattattatcaatatttccgtttaattgatcatccgatccgtcgcaagacagcaacgaattttgtgtgtgtgtttgttgtcacataattcagggaacagcaacatcatcagagaacagtccgacaacaacaaattttctgtttttgttttctccctaatctgctgaacgcggcggcgcactcaacacaaaaacaaacgacgaaaatgtgagacaaattcccactcggaccccacccaaccacgagttcgagcagttcaatttatgtgtttatgtgaccaaaaacgagcgacccccaaattggttgaacctttttgatctgaaaatgcaaatttaaattaattttccgacaattcggagaattatttcaaatatgtatcagttaaacaatgatcagagcaaatcagcaaaacccaataaacatgcttttcttgccattcaacttaaaattttgcaaaaatgagggatatggctatgtctttgccattaatttccccattttccaagtctgaccaatggccaagcaatctctgagcttaatctcggctaagccccccaaattgttaggaggcacaattaatggccaatgctttcccagccccatccatcaccagcggcaaaatctgtagaagaccacggcggcgggtcgcgttccccggggaaaagggagcaaaaagcgtccgaagcgaagaaagaatatgtaatcggggaaatcttttggcaaaaagtaattcatcgccaccaccccaacccccgtacacacttttttgctgtcctatttttctggttttacacataaaacttggtaccctatacctgtcccactgaaaaataaattttaaaaattttgaaaccatgaaaattggatgaaaatgccgggaacaatgaaatttttgtcggttttttaaccaatgtcgaaaagcataaaaatgacaatactggatgccagaagacttttattgcccaatttaaaaaaactcggtaaaagttcatcaaaacattccacaaaaatccgctttaaaaaaaagttgtctcctcattttggggacgtgaagtttgacgagaaaaaatgggtagaagcagaggacggacagttgggtgaggtgacgctatgaaattccaccgctaataataatgactcattcatctgtcaaatggaatgacaaattgggggcatacgaccgccgccatcggacggcgggggtttagcgattccgaaaagatagcacccgcaaaccaccacaaaattaattcatgtcactgccgaccggcttcattttccatataatgtgtgacagcggcagcagttttgtggggtcggcggggtcaatcgcgttttgtcaaaaattcacattttccgtcgaaatttcaatttcactcatcactcacaaattagatcactgagtgagttc

SEQ ID NO: 28723 - DNA, 1930 bp, Heterodera glycines
aattacttaatctcgcccacacactcaatgtggaccaagatatacgcttgtaattcataatggctcattttacgcctacactcggcaaattccgtgttagctagtgtgagttgagaaatttactcttgcaaatccataatcgatttattaagtcgcttcatctgtctgctggactaggattctgtgtaaaaaaaatttgtttttgctagatatttaccctatgatgtgtttatggataattcaaatccctgggcactgtaaaattcctaagaaaaatttttttttatagaatactacgccattattcatttcaagattcggttggacatatctctgtgaattttcaagtaaacaattaattgaataaaccattcgaaagctgcttttgagctctttcagaaaattacttaacctcgcccacacactcaatgtggaccaagatatacgcttgtaattcataatggctcattttacgcctacactcggcaaattccgtgttagctagtgtgagttgagaaattaactcttgcaaatccataatcgatttattaagtcgcttcatctgtttgctggactaggattttgtgtaaaaaaaatttgtttttgctagatatttaccctatgatgtgtttatggataattcaaatccctgggcactgtaaaattcctaagaaaaatttttttttatagaatactacgccattattcatttcaagattcggttggacatatctctgtgaattttcaagtaaacaattaattgaataaaccattcgaaagctgcttttgagctctttcagaaaattacttaatctcgcccacacactcaatgtggaccaagatatacgcttgtaattcataatggctcattttacgcctacactcggcaaattccgtgttagctagtgtgagttgagaaatttactcttgcaaatccataatcgatttattaagttgacggcgttgtcgttggcgactaagtgaagctggaggtttgggtccttcaggccccaaatcaataatttgctcatcatcatcgtcgctttcgttgcctctcagtgtcttcagaccttttgtaatttctacttttgctggtttattttgttgttcatctctcaggtggagataacgggacaattcctggttattgttggatgtgttgatatttaatattattaagtttcgacacgaatacttttattgattagttatttgttgatgggtcctctcccatcgactcattctttgcatttgtgttattttgcaattcggtgtttatttttcggactttctaatttgactccgtcgttattttattattattttgtgattctaattttattgtttattcatttaataaatttatcttgattgtgagttagaaaaacacaacaactggagacgcccgggcatttttgtgcttaaccgtgaattcacctaaaagcgaatctgacggccccctcacatcatccctaacttatttataattctccatctgtctgagccagaacatctgcgccatatattgattgtacgaagctatgctcttcattggtgattgccatcatcgagcttgcaatgagcaccccccctcattgcttgggttgtcttgtcactgttggacccaaaacgtggcgacatggttacccaaatggacgaaacgacgatcagctccaaaagagaggggcgagcgggtcatattcgaatttgtccttcactgaatttgttgacgtgccaggtgttcttgtcatttgtcataagaatgcattttaccgaatgttcatatttttgaacaattcatttttttgctcttacctaaaaactgttcccaaaactttctttttgtacattttcctatttcgcggaaatcccattctatttccaagttttttccttttcaggttccccatttccttgctgaaacttctcc

SEQ ID NO: 28724 - DNA, 1753 bp, Heterodera glycines
atccgcacaaaactgaggtaatcttacccagctaattaaataccgataatatttatgaatagaaatggctcaatgtttatccaataatatctttgcaaaattattaattgaattttctaataaatcaaaaattaatattttaatgacaaaaaaatgaatttaaaatacaataatttatattaataattgtttttcttttaagtttaaaatgttcaaagaaagcttccttcaatctttctcaccacaatcccaccaatttaaatgtttcgctttgtttggaatggcaacgttaatttttatttggtgagagttaaaagccatcacttaaaaacaattccaattaatgagttttgatttcgcaggtactcaacggtaatgcacgacacggaatgttttgaaattaaatggccaaaaaatgggcaaaaaaatggagaaaatttggataaacaaaatgttgaaaaggaaaagcataatgactggtcaaaaatgtgcaaagtaaatcaaacggaagaagaaaatgaaaggcaaaaaatgattaaataaatattaatcaattaataggaaaaaatttaatttaatttaaaaatataacaaaattttttaatgaattattttaatattaaatttgaaggcttttcccaagagattttgacaaatatttattcgccacttggggcggactttgtggcggaattggaaatcagatggtactctaaacaaacacttattaattaattaatgatggccgtttagtggcgttttgcttctttgtatggcattggaaaaccgtacgggcgaaagccaatttttaaggaagaccaaaaatgcgaaaaagcacatggagcgcacgaaacggaaggagagaatgaaatcgaaaaactctttcctgtctatgccagccaaatcaaatacattgtaaaaacaaattaattaaaaatatttaatttaatttcttattatggcatttagaatcctaaagaaatggaaaatgacactttttatgtgcaagaatttgctccgggctgctgttcatatgaggacccacaaaagttgtcactttgactgatttaaaatttgaaaaattgcctttagacgtgccatttcacggataaaagaaaagtacataaaaattgatgtaagactttaatatatttttcaaattataaattaattttgtcgtttttagggatattattttcaatcgtataaattctttgaaaatcgaaggacggaaattcgtcaaattttccaatttggtcacgaactctgtgaaacagtgggcacatacaaaagcgaattatttcagttaaattaaaaagaaatttaaatgttattcattttttatttttaagagatgatcattctcacaaattttgtgtccacgttcggattgaagattttaagaattttggtattgaaacaaaaaaggatttcacagagcagggaattgagttcggatttcaccatttaaaggtaaaattattcattttttgttcttgtttttttatttatttatttctttaaaaattaagaaaaaattcaacgatatttccgtcgttttaatgggagttgagaaggaatttttgaataatttagcaatcaatcggcaggtaaaattatttatttatgttaacattggcatatttatttatttgtctttcatttttagctaattccaaaagtttatttgcccaaagaaatgtcgcgaggaaatgacttggcatttgcgacaacggcatgcgattcgctgctg

SEQ ID NO: 28725 - DNA, 982 bp, Heterodera glycines
  misc_feature (976)..(976): n is a, c, g, or t
ttttaggtaatgcatgaaggccttgcgaatgtttgtctgatcggttcttcaatgaccgtggtgaagtccaaaattgacatgcaggttggtcggaacgggatttatttaattgtctttttagtaattaaaaattgtttgtttttttcagatcgctcgcaaacggaagggactgtcctcgcaacatgacaaaagtttggtcgcctttatgaatgcaatttgtgccgcatttgttcggcacgtgaacatcgaagtgactttcccccccccccatctctttttcactgccaaaatctctcaccgattttcagctgatcaaatgcgttgttgtcgatagtccgggattccttcgcgatcagttcatcgagtttttctggcagtacatcgaacgcgaagggctaaagcagcagttcgccccgcacagaggtaaatttgtgctcgtccattcgtcaagcggcttcaaacacgcgctaaaagaagcactttcggacgccactgtcagccaacggcttagcgatacgaaggcactgatttttggaaaaatggcattttccaatgttaggtcattttaggcacaggccgaagttaaggcattgaacacgttcatggagctgatgtgcaccgacccacagaaggccatctactggtacagacacgtggtgcacgcacgcgaacaacagtccatcgacactttgatggtgtccgactcgttgttcaggcaggcgaatgaatttggcatggaaataattggcagaaacatttaaaggtccaaagaaattgcccagaggaggaaatatgtggaccttgtggagagcgtcaaggatcaggcgagaatgaagcttattggccaccgctttatatatttttaagtgccaaacgacgaggccgagagggaagagaacggacggacatgagaagaaagcggaggaaaaagggggaaaagcaccactcgaggattggttttttcaaatttcattgntcccaa

SEQ ID NO: 28726 - DNA, 1487 bp, Heterodera glycines
  misc_feature (1410)..(1410): n is a, c, g, or t
tccagctatcctgggggaaacttcggagggaaccagctactagatggttcgattagtctttcgcccctatacccaagtcagacgatcgatttgcacgtcagaatcgcttcggacttccaccaggagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactcctaatggcgcaantgtgcattcgaatgttttgtgttcaaggtttctaaaggtcgcactaattatcgcagttggctgcgttcttcatcgat

SEQ ID NO: 28727 - DNA, 1077 bp, Heterodera glycines
gaaaaactatgagtgcttgaattttcactaaaaaagctaagcctaaagtttttcgctcgtttaaaaagcaagtaaaaatttttagaatttttattcatcgccctttttgatagtaaaagcatcagagggctttgttaacttgaaaataaaatttggtgcgtttcagatcactctctgaaaaaatattaatgaatttattttttcaaaaatttgaaatgtacgcaaaataagaataccgaaaaaatttcaaattccacaaaatgggaaggaaatttaaacctaattacctcttcttctcagctgttaccctgcaaaatttggtgcatttctgatcagaacgcgaaaaactatgagtgcttgaattttcactaaaaaagctaagcctaaagtttttcgctcgtttaaaaagcaagtaaaaatttttagaatttttattcatcgccctttttgatagtaaaagcatcagagggctttgttaacttgaaaataaaatttggtgcgtttcagatcactctctgaaaaaatattaatgaatttattttttcaaaaattcgaaatgtacgcaaaataagaataccgaaaaaatttcaaattccacaaaatgggaaggaaatttaaacctaattacctcttcttctcagctgttaccctgcaaaatttggtgcatttctgaacagaacgcgaaaaactatgagtgtttgaattttcactaaaaaagctaagcctaaagtttttcgctcgtttaaaaaccaattaaaaatttttaagaattttattcatatccctttttggtattaaaagcatcagagtgccttaattaacctgtaaataaagtttggtgtgtttcagagcactctctgaaaaaatattaatgaatttatttttttcaaaaatttgaaacgtacgcaaaataagaataccgaaaaaatttcaaattccacaaaatgggaaaggaatttaacccaattacctcttcttttccgctgttccccggcaaaattgggggattttctgatcaaaacgcgaaaaaatattgagggtttgaattttccctaaaaaaattaagcctaaggtttt

SEQ ID NO: 28728 - DNA, 1090 bp, Heterodera glycines
tttttcacaaatactcctttattgtccaaaatcgattcaatataccaaatggccacgaatccctattttctatccaattcagtgcatttgaatcaattttggagaatggagattgattttggtaaaaaaaaatgtcgactgggttcgaaattggtcgaaatggatgtcatattcgtggacagcgacccctaatacccctggaaaacactgtttttaccgttaaaaacaaaaaaatcttctttgtggtccaaactgtccaagtaccaagtttttttaattttttattttgaaaactgaaacttttattataaaattccattctgaccatgtaaaaggtatatgtttaccaggcgtaccgtaccgtattaggtacaacttagcccttttgtgaacccatccagaaatttttttacatttttcatacactgtgtttattttatggtaacgtgcaaaacaactcaactgcgttttcagcgcccaaaattagccaaaaaaaaatatatatatataaaaaaaattccacgaggagttcacaaacgggagaagtaccccgtattatatttaaaaaaaaatataggtatagaaacctgcacttcgtcaggcgcagtgccattgccgccggcctttttggattttgcagaaaacagcgggaaacagcgcgcaattgccaccgttgaggccatcaccgagtcatagtccgtgaacagcacaacattcagacactgaaaaagacattcatttattgtattacatgtaccgtttgtcctctacgctgttaacacttaatgggaaaagggcgggttcgaatcccttccgggatggcgaatttttttgaaaatttaattttgttacaaattgtgttatactaaaattttgttttcttaaaagattgtccaatgcgtgccaaacaaacatttccttgatcattcacgaaagttcgcggttatgaaaacgcatcggtagaaaatgggccaaaaatgccacatttcctttgtttggaatttcaatttatgccatgttttacaacgaaattctttggttcaattttggtcaaagaccatcgaattccgtaaaggttaatggcaaaaag

SEQ ID NO: 28729 - DNA, 642 bp, Heterodera glycines
ggggggggggggttgggatgatttaaggtgaatgttgggagtgagaaaaggttcactagacttttaataaccatgtttagggttcaattacatgctttcaacagagtctgacggattggagcccattaagccattttccgtaccgaacccaccgagaaaaagtttagtgccaaaattcctggttcccaaacttcatcatgtcgccatttcaacaatttaaaccctggaaaacaaatctatgagggacgatgagggaaattaggaaaatttaaaaaagtgtagggccggaaaacaattaagatagagatggtagagagtcaaaattttgggtaaaattcaatttcggcacagaatcagcccggctggtaccaaaccgtgatcatcctcgtcattttggccttcatcgtggaattggtctgtgattcattgtgatgctcgagaccgaaaattccccgagaccaaaaaacccgcgactttgctcgagtagataatgaccggaactctcgcgcatcactagtgatttacttggcttcctcttcactttgcccccccccccaaaggacgtactgacttggaccgctctctcttgggtcggattttgtcccaccgcgctcaattttccgctcggtttcctttgagcgg

SEQ ID NO: 28730 - DNA, 754 bp, Heterodera glycines
tttgagacaaaagtcaatttgttaagaaaattcggtaaattttttctgggaattttggtggggggggggggactgcccacgcccccgctgttgcatcaattcacctggttgaccgactgtacgggcagcaagtcgtagtcaggcactcgcgcggtcgccaaaatgcgttggacggatgaactgacggcgctgaaacgcatgttggagcacaactcgtgcaaatcactgcagcacaacaccaaatgagcatcggcagaaagcatttccctttgtttaagaaaacgacaaataaaagaaaagaaaaagaaacggacttaaacgcatcgacgtagaaaaggagcaaattggcgagacggttcagcaccacacagttgccctcttttgtgatgcattgttccacccttagctaattgaataaaatgagggcgaagtccgccacggatcgaggggggggggaacggagggcacacccgcaacggttggcacatcgcttccgcgatggaagtgagcaccgcccgcgcttgggccggtacattctccgccccgccatggcgtgtgcagtcgcgcaacagtgcggccaacatttccttctctaccgccactgtgtgttggatccaggaaagcatttcattgacatatctgtcaagagaagggaaaacggtcaatcgatggaaaagtgggaaaattaggacgaaattttaaaagagggagaaaatggaaagccaacaaaacaaaaataaaatttataaattgc

SEQ ID NO: 28731 - DNA, 1851 bp, Heterodera glycines
  misc_feature (20)..(20): n is a, c, g, or t
  misc_feature (33)..(33): n is a, c, g, or t
  misc_feature (89)..(89): n is a, c, g, or t
tttttaatattacaatgccncaggtcaaggccnaacttaattgatggctcattttatgaatgaattaattgtctaattaattatctatntaaatcaaacttcagtttcaactggtgtgttaacaatggaagaaaggttcggcgtgtttcagcactatttcgatctaaagttaagtgatgcccctgggctttttccatcgaaatttcccacgcaccgacggaacaaaaacgaaggcacaattgagatggaaattgaaaaagtgtccgaatttgcggtggaggaggtgggaagtcgccgatttagcgatgccatggacattgggggaatgccatggaaaataatggcagaaatcgaaacgaaaaacgaaagcaatgagaaatggttgggcttttacctttccgacgatggccttgaaaatggtaaaaaaaagtctttttcataaatctgtcagggaaaaacaaaaatatattattttttactcattgctttaagcggaggaatacatttactaaattcttttttccagaggtttttaaatattatttaaatcattcgaactaaataaacgattatgtagacaattttctacaaaaatagaaattcaaaaattgaaaatgtaggtgaaaagtaccctttcaacttaaataagtaccggatttaatgataatggtaattttattgaatatttatttattgtgcagaatattggacttgtaaaagttcggcaaaacttcgaattgtttcacaaaagaatggcacggaggatttaattggaagaattggtgattacatttttaataaggaagggagcagttatggtggatttcctaatttcattagttttgcggtgagtgggattcaaataaatttaataaacttcatattttgaaattaaaatttttaaaattttaaaaaagaaagtgacaaaaaatagaattttttgaaattttttggttataactctttgtaaatttttttctagattttaaaaaattaaataagataggatttgataggatatgtaatgcatcgtttaataccaatttttattaatttaactaaatttaagctaagttatgctttcttattagcaataaaattaaaactaataataaatttaaatgtttctatcattgacacttttgtaactttggctcaccatgattttatattacataattgatttaaaattaaagttataatcggaaacattgctgattttcatgttaaaaaattaattacaatatttgtcaaatttttgtattgcaaaataaatcactaaaaattaaggaattgttggatccgggcaaaggattttacatcaaagatgaggacaaagtcacattggccattgatgtcattgtggatgagccaaaaactgagaaaagcatttccgatccaaacaaatccaacggcacactttcgacggaaattgaaaaactatcggaatttgcacgagaaatcgtttggagtgaacgtaaaagtgaaactgtgtacataaagagaatgccatggaaaatattggcaaaaattagaaagaaaaatgaaagcactgagaaatggttgggctttttacttttgtgcgatgcttctaaaaaaggtttggttatcaaattattaatagaaataaaaattattttttctataaaattggtgtaattaattattgaaaaaacttatgtaaacagtaattttttaacataaaattaaaagtgattttttaaaggaaatgcgttaaaatataaatttgattattatttaatttgctttaagatggaaattggagccgcaaatgttcggcaacacttcgaattgtctctcaaaagagcgggggggaggattttaagagag

SEQ ID NO: 28732 - DNA, 1634 bp, Heterodera glycines
cctggtataagcctttcaaagtgaacttaagagtccctaatagcatggattcgggacccctgatcataaggtccaccgattggccgactgggagcaaattcaacaaagtctcagagttaaatcggcattctgttccattttcattggattagcattcttcagtattggccgttatagtggtagggactccatttcctagggggatcccttggaaccaacaaattaaggcaagggccatgcccaattttgtcaaaggcctaaatctccgattattgaatcttttgtaccgacggttttcataatcactttctattggccgtttttgcttccttcctttcagattttggaacatgcgacaacaaattgttcgacaacaacgtttaactgcgcggaagaaacagttttgtccaactgagaaggcagcacaaaacggttgatacaatgcctacaacaagggcaatgcaaccgatcaaaagagcggagaaagtgggggagcagtgaaagttgaacactctttcccagcatacatagcaatcgaccagcagacagatgtccactggggcgcattgggccgagtatgaagtggaaacattgggtcccatccaaaaaatagctaggcaggaggttccaagtaataaattttcctctggaatcggaaaaaagaaaggttttctgtattcccggtgaccgcaaatgccgtcacagcaaatatcaactttttcggtttcggggagtccctcgagcattacccccttggaaactcaggaaaaaatgcctgtggcgtttggttgtgtggataaaagtgcagctgagagtacaggtgctgataaaactgctgttccgctgaagaaactcaacacaagcagcatcgttagcagagtactcagaattgtggccgaaattgttgggcgaggagggcgttctgcccatttgaatttctgccgaaaattgccacggggtggcttttttgcccatcggaacttttcttttggattttctttactgaccgattctgaaaccggctcgaccacatccatcagatttccctcttggggatctcccggggggcgcgaaagagtctcacacacaatcccgggtggttcttctaacggcaccaatttcgaaacgggacgggataacacccgtccatttgccattaaaatgttggcacttcgagggtttccttcggggccctggacttctgtaatttttcccataggccaggtattcctaggaaactcctcattttcaaccaggacaatttggtccactttcggtaaagatttggatataattctaggtcctttgtgtttcgtctgattgcgttgtcttaacaacaacaggtactcctgtgaccatttttcccaaaactgccgaattgattttgctgtcccccaccatcgggcggctaacttttcagctggggaaggtcgaaaaacttcgtctgacatgttcggctcatcaaaagcgaggtttgcttttggagataaaaaatcgattggccgcaatggaaaaggaccatcagcttcatctgagacgaaagtgatgggtcgcgaattgatcgcggcctcaacttcagtaaaaaaagtgctaatttcctcccattttaaaattcggcgtcccaaaattcgtct

SEQ ID NO: 28733 - DNA, 1715 bp, Heterodera glycines
ccaatcaaagcatgtgctgacaaactggttgagggaaattgaacaatttggcaatccgccagtgtttggctaccaaagcagcgaagaaatgtcaaaaaacgggacagaattagcgaaacaggaggaggaagtggaccaaatcattaaggacaagagcaagggcaaaaaggtgatcgtcaattttgcatcccaattttaataaattctttagagcaaggctttggcgaaaactgtggctgccaaattccaatggcaaattatgcaatcgttgggcctcaacgacgcagaaattgccgagttttccaaatccgagcattggctgacctatttcccgcccaagtgtatggcggacctgcgcaaaatgggccttgcggtggactggcgacgtgccttcatcaccacagaggcaaatgcctatttcgactcattcgtgcagtggcaattccgaaagttgcgctcagaaaatctcatccaattcggcaaaaggtgccattcccgtgtcatttttatcccttggattgttatcataatgcttatgttgttctcattcttgacaggtacaccatttactctcccaaggatggccagccgtgtatggaccacgaccgttccaccggcgaaggggtcggcccgcaagagtacactttgatcaaaatgcaggttaccatcaaaaagtaaatttttctgttccactttttttagattctggagcccaaacccaaagttctgtccaatgtctctgcttccaatggtaagccaatgtttttggtggccgccactctccgccccgaaacgatgtacggccaaacgaattgtaagttgattgtttgtgatttcatccaaaatctgtgatctattcgttcattttcaggcttcatccatcccgacatcacttactccgtgttttttgtgggtacaaacgaccaagagattttcatcgcaacggaaaggtttattaggcaacggacacaaattaatgtgctctaatgtttttttgtggctgtttagggccgctcggaacatggcttaccagggcatgacggcggagaacggaaaaattcgctttgtgcccggcgtggaaagagtgaagggcgcggaattgattggctgtgcgttgaaggcgccgttgacgagttttgagcgtatttacgcactaccaatgctaacgatcaaagacgacaaaggtcaaaagcatttctgggtgttaaatgattggtccaatttgcctaattaggcgacagaataatggcaaattgatttatgatccgttaatttaacgaaaaacgcataatccgtttatctgtaaaaaaaccgtgcaacaatacagtgtttcttcctttttcctccaggcactggcattgtgaccagcgttccgtccgacgcacccgacgactttgccgcactgatggacctgaagaaaaagaagcctttgcgcgagaagtacggcatccttgacgagatggtgatgccatttgagcccatcccaatcctcgagattcccgagtatggtcgtcttgccgctgtgcacatgtgcgaaaagttgggcatcaacagccaaaacgatcgactgaaattggaagaggcgaagaaggagctgtacctaaagggcttttaccagggggtgaggggaattaaataaattgtttacaaccaaagcatggttttgtttcgcaggtgatgttggtcgagaattaccacggatcagaagacggagg

SEQ ID NO: 28734 - DNA, 1964 bp, Heterodera glycines
aagggcagcagaacggtattttgtgacttttttgccccatcaaacctttggcaaataaatgggcaaagggagtctcgacaggggggaggtcgtagcgcaagggaaaggagagaaattcctagagaatttggataatttcccattactataaaaggccaaaatatttcccctacaatgggcgaaatcaccgcccgccacttttctcttctcattctctcttttcagaatatgtcattctttccctcgtccgcactcgttcggttggccatttgcggtgctttccattcgtttcccttattattcaaatcatttcttcggcttaagggatgtccgtcgtttggtggtcgctctttcccgggctcggctcggattgtacgttttgggaaggctttcgctgttccaacgctgctatgaattagccccggcattcgaaagagtgcgttcattttccaatttaactattttttgttttgctttttagttattgaaatttccgactcgtctcgccattcttcccaatgaacaattttcggaagatttcgatcggaaggtcggtacaatgttaagacatttcattttctttttatattagcccggcgatactccgcaaattacgccaatacaaattgagggcactgtacacatgtcgcaattcgtgactgaattctacagaagcaatttggagctgataaaagggcgatttttgcccggggacggaataggggagaaggagcaaccgatggaacaaagcgaggcgagactctaaaagaggaggcgaatcgaccccgaatttgtttagcaaaccgtactagcagcaacaacagcagaacccgttgaggagcagcagtctaaagagtctgcggaagatgcaatgccaagttcaacaagtgacgatcaatcgaacgaaccagtggaagcagcgattgtgtttgaacaagtcgatttcgaacgtttgcaggaagttccaaaatattgatcaactatttttgttttcatttatatattatttctttgtttaaaaaaagcgtcttttgaatgcaataaataatgactagggcatggattttaagctatttaacaatttttggcctgaaaattcatcattttgatgagactattcgtcgctattttggaaaatgtaataatatacactaaaaaaaacagaaatttggagatcaaaacacattcattcgccaatatttggtgttttacgccattcattaggggtcgagtcgaaagcactgttttaggaacttcaaattacagcgtatgcatgcgatcgttagcatcagaagtatttcgccgatcagaaggacgatgaaaaagtgggttagccatcggtctctttcaagggcttctgaaatgtccgatttgtggcgaatgcgtctcctccgttggctttaccctctgccgctgagttttgcgattgtttcgtcacttccctccgtcggccttccatcgttcccatcgcgcgggtgaaaccgaaaatgctggagaaagcgatgatggccaccattttggcgaaggcaccgagcgcctgaggcaacggaagggccaattaataaatggcaaaatgccctttttatacgctggcaattgcacacagccaaagcgtttcttctgtccgactgttcattgctgcacaaattgttatggtgaccacgaggagaggaacgatgacacaagtgatggacaaagggtaggagaacagagcgagacacgccgactgaacaatgaatggagtcacaaagtgagaacggaagagaaaaaggaagatggaagagaaggaaaaggggaaaataaactggagaggagacggaaagggaaacggcaaaagaagggagaaaaagtaggaaaaaggagggaacggaaagagaagcggcaggaaatgggaagaaagagaagccatcaaatgttataaataattgcacaatgaaatataattcaaccattctaattgactg

SEQ ID NO: 28735 - DNA, 1522 bp, Heterodera glycines
aaaaaaattttgttattttttttctcattttatttaaaaagacacaaaaaaattaataaaaatttaaaagaaaatagggcccaaaaaggggggatggtttaacgaaaaagattttaggatgggacccctcccattttaatattccctttttttggtttcacaactgggccaacggtgactgtgctcattggcaggtagttgtccaattaaggtacttggactttccacagtaaaatgtggtgcaaattttgaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcatttgtagcgcaataaaagttttttgttttgaatttttcacaatttatttaaaaaagccaaaaaatccggatccaattttaaaaacgaaaatagtgcacaaaaagaagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcacccttttctgctccataagaggtcagaggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagttcacaaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagattttaggatgggacgcaccccatctgatattcccatttttctgtttcacaactggccaacggtgactgtgctcattggcacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaggagccgcctcacggcgggggttaaaagcatttgtagcgcaataaaagttttttgttttgaattttttcacaatttatttaaaaaagccaaaaaatcccggatccaatttttaaaaacgaaa

SEQ ID NO: 28736 - DNA, 1452 bp, Heterodera glycines
ataaaatatgctgaattttttgtttaaaatatatttacttttatgtaatgaattttttaatttttaatattattatttaataatttttttcgtttttccggtgcaatcaaaatattaaaatataaattggaaccgaatttgcatttgaattaaaaatgtaaaatttagaaataataaagccatttcaaaatttacagtgaattaaattttttgttcaacatttcaagctaatgaattgcatttgataaaactaaaaaagaacaactattaatgaacttatgcttataatacaatgataaaatgataattaataataaatttgaagttcaaaaaataaaattggttattgataaatatctaaatctttagttgttttaaaattgtaaagataaagaattgtgcaatctcttttatattttaagtttttaaaaaattcgttttttgttttaaaaataataaagaagtgcgaagaattttgaaaatttttccataaataacaaaaaaagttaaaaagtccaaaacgctaaaaattcaaacaccatcaccaccgtgtacttttcataacagccggccaagttaactgtattgaaaaaataaatatttttaaataataaaacataaatgcattaaattgaaaaaagcgacttaaatgtttttaattagtaaagcaaattttcaatgaagaaattaaaaaacattaaaaatatgatcataaaaagagttatgattattaaagtaacatagaaaaaaacatataaagcaaaaatgatttataaaagaaaatttaaaaacattaattaaaacacaaataatgatgaaaaggaaaattaatttttcattaagcaaaactaaataatttataccaaaattcaagctttaaaaaagttcgctggttctctttttaccatttttcttggtaaaaatgaacctttgtaattaatagtttgcatagaaaataccattatgcaatttaattaataatttcatttatatttttttaaaacccaatgctaaaaatcaaattaaacttcgcttctcgaacaagaaaataaatttttgaattaaaaccagccaagcatttaaataaaatttaaaaatttgaatgaactaataatttaatactttctagaaaaaaaattgacaacaaaaaacacttgaaaacaaaaatttttagaaaaaaattatatacaaaaattttcgatttaattatcggcaagaattttgtaactaaaagtaacaacaaaataaaaattaaataaaaaataatataatattttttataaaaaatagcaaatacacttacaaaaaagcaatgacataaacatatttggttatttcttattaaattttaaaatatttctaattatatgaagttgtaaataattgcttaatttttttatctattaattttaaaagaaaaaaaaattcaattaacatgacttgaatataaaa

SEQ ID NO: 28737 - DNA, 1385 bp, Heterodera glycines
  misc_feature (75)..(75): n is a, c, g, or t
catcacctataaaaactttcactcttgactttttgatgggaaacaaagaatgaaaagtttggtgatccacagcgnccgaaaggaatggttttttgcaccaaaaaaatgaagaattttcttatcaaacgaagagagttgtgctgaaaaaaaagatacaaactattaagcttattaaaaataattacagtctgaaagagtcggtccgctggatgactgaaagtccagagattgacttctgtttttgtttgtccttttcagctttcgattcaagagcattcagcttttcagtgaattcggagttttcgtgaatggcgtgaagatgagtatgcaaagttttaaccgttcctttggcaagctggtattcatattttagctttccatttgcttgacattcaagacaaattgctgtagtctttgacgtttttttaaataggccaaagactcattctctaaaattaaaaagaaaaagacctaaattatcatttctataaagtagaattctccgaatggaaattttaaccagaaaattgacaaacaaacatttataaacattatgccaaagagattttcgtaggaaaaagaacaaattttgtttatatcataacccggtaaaacccggtcaaaaatgccgggttccgggccgggttgcattttcaaaaacgaccgggttccgggcccggcctctcaaaacccggtcaacccggatttccccaaaaatcgccgggccgggttgccgggcccgggaaaacccggtaccgggcccggcccggtccggtctctacttactattacctgttttagttctcgaatatatttggtttgaaaatattgagattgatgccagtgacagtctcaggattagaaacacttaattcgctgaatgtttatgaaaatatgtattaatttttaaaacagaattcaggcaaaaaagtcgcgaagacaattaaaaaaagggagaaaaaggaactgaagaaattggaaaacctgaagatgaaggaaatgaagaaaaagcagaaacggagaccttagttgttgagcacagattcggaggaggagaataagcgaagaaaaaagacgggaaaaagggagaaaagtcactgaaaattataataaaaaaggaagaaaaagcaagggccaattagacactattttaattggaattataaactttatatttttacaatggcaccacagaaccttacacatttaatattcatttttatgttgtgtaggcaaaacagtcataaaccgtagcgttaggacctcattttaatccatttgcaattccacaattaaacgggatggtattaaattcatccatttaaaatccgtcctgccaactcactcattaaagggtggtccccactgatttgtttatatctgat

SEQ ID NO: 28738 - DNA, 1301 bp, Heterodera glycines
tttggacccaccggttttcggtttcggtttttgacccaaaaaagccggttttcggtttcggtttttgacccaaaaaagccggttttcggtttcggtgcggttaaacgaccgtgacccaccctagttttagctttaaaattaattttaaattttaaataataatcctttagtatttatcaaactaatattttttaaattttgtttcaaatttatttttaacaaatatattttttgcttttagtttaatgttcccatttttgacatttaaaatattttccgtataatattaaactgatcacacacaacaatctttccctgtggcacccattcatttcattcattcgtttcattgtcttttgtgtgactcattttcattctccaccatttgtcattttctctcgactatccttcggtttctctctccattttgctcccaataaatttaattttaatttaatctttggtccgtttttctcgaataaatttccataatattttaattaaattaagtaagcatataatttttgagtgaattaagcaaggaattcgagttttttattgttcccgcaaataaagaaacatttttatgtccgtttttcaacaacagaggcggagggcagagaatgggcgcgtcatctttcacataaaattgtgaaaaatgtccataggaaatgttttttttggcgttccactgaggccgtaaagaatcaaaataataaaaaaaaaactaaaaattagttaacaatagagtcaaaaaaaatttttttaaaactatttttaagcgaacaggaattttttttaattgggtctcagggttttcggtcggggtccggacaatccgtcggtggacaatccgtcagtggtcaatccgtcagtggacaatccatcagtaatggacaatccgtcagtggacaatccgtcagtggtcaatccgtcagtggacaatccagcagtgaaggacaatccgtcagtaatggacaatccgtcagtggataattcgtcagtggacaatccgtcagcaaattttttttgagcaatgatcaaaaaccttgcgaaaataattgttaaatataataaatataaatttttttatagcttcttaacatttctagttacttcatgcttcaattaattgccatatcgaaaataatcaattaattcttttttaaaatgattattcgtaattttttttaaataacacaaattattaattcaggattttagcgacttaaattaattttcacatgattacaaatagagatgggtgttttaaaataaatttgcttatggattagttactg

SEQ ID NO: 28739 - DNA, 1480 bp, Heterodera glycines
ctcagcgacgcaaatgtccattttataaaaaattagaaagaggattttatttttttaaaattccaataagattacacaaattgatcctaaaaactcacctaaaaattcagaattgtttattttgtcatctaaggacagaatactgaatacttgctgcaccagtaaataattttttatacattttctaaaaaaaggattttaaaaatccaaatttcctttatttaatatttcctttttttgcattttcatcattggattttcttggtaattttttctcatttgaatcctggacatttgcggcccgtttcttaagatccattaacggacattttcggcccagtttttttttggtgcggcctaagccaaaatcggacttttgcggcccgcgacatttgcgtcccggacattggcggaccgtttcttaagggcaattttcggaccttgtcgacccaatttttttttaaattttgagtcccaagccaaattcggacatttgcggcccaacatttacggcccgacattggtgtcccggacatttgcggcccatttcttaagatacattttcggaacattttaggccaattttttttgaattttgcgtcccaagccaaaatcggacatttgcggcccaacatttacggaccgacattggtgtcccgaacatttgcggcccatttcttaagatacattatcggaacattttaggcccaatttttttttttattgaattttgcgtcctaagccaaaatcggacatttgcggcccgatatttacggcttcacccaaatttcaccatcggtagcggcataaattacttagcatgggcacataagggagtaaatttatgagacttttcggtaaaatgttaactcctatctgtgcggatcctttttgcgtgaggactgcaaaatgcccaaattgttacttttttatacctcccaaatagttgaagcgctatttttggatattctgtgggcttttcattgaggttttaaaactcacatgtgactgccccaaaccgtaaggtacctactttgcttcatcatttaaacgcatatagtatcgctttattttttgaactttcatgcttatttttcttgatttaattaatatttctttgattttcttttttattttaattttggttttatctttattattattttttctattcgatatttcactaggctaccgtatgctgcattattcttaagggtttataattttttctttatgaatttttaatttattttattttgccaaattaattatcttttttcaaataaaattattttctccctagaatggaaccctttactcctgacgcccaaatttgttttaaaattgacaatatttccatttttgctcaacaacaagttggcacgaaaaaaggcacccgaacattttggaacacgagcaatttaaattcaaatgctacttgtattcggtgaacatccgtgatccaacggacctgtcaccg

SEQ ID NO: 28740 - DNA, 1140 bp, Heterodera glycines
atcgatttctccagtgtccgtttggggtcctcaaacatttagggggagccaaaatcccacgcagcatttaaagtacaggatatacggaagctattcccaaaggattcggtctccccataaatctaggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaaggattcggtctccccataaatctgggcgcatcgggttcgggggggactgccccg

SEQ ID NO: 28741 - DNA, 1870 bp, Heterodera glycines
  misc_feature (213)..(213): n is a, c, g, or t
  misc_feature (1756)..(1756): n is a, c, g, or t
  misc_feature (1763)..(1763): n is a, c, g, or t
tttttgaaacggtgtgtcaaggatgattgtgcccgaaaattgtacgattcagtagcatttttttcaaaataaaaaattaaatatttcatacaaaaaaaaaaaatcgatagaaaaaatttcaaaattttttcttgcaattttttatttaaaaaaattttctgttttgaaaaattaagtcgagaaagtcttgaatacgtgttgcccaccggttcnagagttcagatggaagcgcaatggagtgccaaactcctgctgttgtccaagctgtccagccgggttcagcggaaagtacggcgtttcctcgaaatgaatggtgtcactgaaaacaatgccccaggcaattaggaaaaattgcaaaccgaaaaacgaaaactaattaaaaaaacaattattaataatagtaaatttgtattactgcgtatgtgcggcaaatttaattaggtaattaggatttagcacttccgactaatcaaaataaatgagcccgtgccatggatttattaatttattttaatcaccagagttaatgtattaatttgcttggaataagcaagcctaaattcattaattgcccaagtaggcgttaattacccctaatgagccctgcactttatggccttactctgccgacagcacaaacacagccaatgacgtcagacagttgtagccgttgcgttgtgggctcgcatgtaagcaacgctcattgcccgccgggcatgtgcacagacgcgagtcgggcagccgaaatccggggttagcgtatgagcggagttggacctgaaaagccaagcaggtgaaagcaggggctgaaaataagtttcagaattttccaacgccgcgttaacatttttttatttgaattttcaaattattactttttcaaaaatttaatccgccataaatttagaaatctcgagggtcgaaaaatttccatgactcgaaaacaaaagaaatatcctaaatttctcggtccggccgcctggaccgagaacctcgactcggattatcttcactgttgaaagcccacctgcacttggacagacccatgaccatggccaacgccaccgccaccagtctctgccgacccaccggcaccaaacattcgctgctgctgctgctgcccaaatgccattgttgttacgttttggctggcatcagccggtgccatttgaccaaatgtgccgctcccaatggcactccatgtgccattgttgcggttgttgatgatgccatgagcattttgctgctgctgattctgttgatggccatacagtggcaacaacattgggtcgtaagggtttttcaaatttggctgtcgatgttgttgttgttggcgttgtgccgccgggtctgccgcaggcaatgtgccaactccaacaatgcctccagcggaaggctgctggtttctcatctgtggttgttgctgttgctggtgccgaaagtccatagattgggcccggaaaatgccaacgacggaaatagcacacaaaagcaattgttggaaaaaagttgtgccgtgccgcatatcttctgctggtcactgaaaaattggttgagtgaacgatgtgggccttgtgatcaagcaaaacgcaacaaaaaaagagcaacaaatttttctaaaccccgaaaaaacttcccggtaatttcggaaacttcggtaggtaaagtccaagcaaatttatccggttaggcgcgtacggatcgacagcggtactaacctctaactattttttaatgccccaggcgataattatgnaaagtanaattaagcggtcaatcatcatttttaggatggacatcacaacacaatctgataatattcttatcgacaagaaactgctgcaaatcattttgtgggcagcacagaaag

SEQ ID NO: 28742 - DNA, 1347 bp, Heterodera glycines
gagacattcagtatcatccatcgatcctattggggagacgatataaaaacgattcatgataaaatcttgttgtataagaaaaaatggcgccggagcaaaataaaaaaaaagccaaaaatttaaatagtaaatcagctatgcctctctctacacggtaaaagaggtttgaaattgatttgaatacttcgagttcgaaagttcccttgttagcattcaaaggatgatttgttttttggcattatttgcttggcaataaatgcaatcaaccaatcaggagaaggctagtgaattttttccgtagcaacctatgcgctaccctatttctagcattgcaaaattatgaaatggtcaaaccgaagcctttggaaagtctgccgatccgagaaaatcaattcgcgtgttgtagaagtggccggccaatggcccgggagatgcttgttccagattttgggcgggaaatcactgggatggactgaagtttacgcgtgcttttacaacagaataggaagaaaaccgttttccttcaattgaattgggggggtggagaccaaacacacgaagacaaagccacacacaatatttatttttgaagtccgaggagatcaccaatgtgaagcaaattgagaacgaaatttagagaggaaattttggaaaacaaattaatgagaataatgagaagtgaaaaaaaatgtaccaaacataaattaaagaggtcaacaaacataaaataaatagagataaaatgccataataattttaaattaaaacaaatatcttaattaaattaaaatctccaacacccccgaacaatctcgagaggcgtcctcgcctcaaaaacatcactcgtccatcgaaaggtgggtccacgagcagtcaacggcgaaaagggcgagagtcggacggatcggaacgacgattcatcggcggtccatagcgattggtgttgcgccattgtccagcatacggatgatggcgagtcgaagtgccacggcgattttggggcgggaacggtccaatccgacaaggatcgactcgatctcttgcggtaacattcggggccacaacaaccgtcgggttcatacgagaatcggctcgattactcgtagagacaactgcagaattgacggtccgaattttcaaatcctgatcgcccgggaatttcgtctgggagaaaatccaggccttaagcattttgcagccattattacacattttcccctctttggaaacagtgtgtttgttgaaattttccccgaatcggaaaatttccaaaactgatcggcctttgtcggtggtgaaaattggagagagcggcgatttggtgatgatggcgtgcattttcgtgat

SEQ ID NO: 28743 - DNA, 1038 bp, Heterodera glycines
cattaaaataattttatccaaaaaattttttttgggttttgggggcattcccctgaaaccgtgcgccccagacttttttggcagaatctgatcagaatagcaccactatagcagggatactgaaaggaagagtttggatttttttccatataattgagtcagttcatcaaaataatttttatcgaaaaaatcgatttatttgggttttcggggcagtccccctgaacccgatgcgcccagatttatggggagaccgaatccttcgggaatagcttccctatagcctgtactttaattctgcgttggatttttgctccccataattgtttgagtaccccaaacggacacttgaaaaaatcgatttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctcccccataattgtttgagtagactctaacggacacttgaaaaaatcgatttttttgttttcgggg

SEQ ID NO: 28744 - DNA, 1071 bp, Heterodera glycines
gtggaagggtcctcacatctttttgaggagtatccgggaaaactataggaaaaaaatcagcgcggacgactgagtcccgggaagtgatttgtcactttttcgctcattttagggcccataacttttttcataaaacccgaatcaaaaagtttccgctggtagggacctaagttgaagtgttgactaaaattcaaaaaaaattccaggcctctacctataatagggaaggctgtaggtgcgtagactttttcagtaccaactttgtccagttcagtcccgggtgaataactcattagggtttgatctgagcggggggtcgccagcgggactattgtagagcttgaaaagctcgatttttccaaatttaaaaatttcgaaaattttcaaaatttctcgagctaggcctaaaaaactgttttcgggtttttgaattttaggattttttaacgatttttccggggaaaacggagaccacttccaaaacatcattttttgagctctatcgattggtgatatttttgaaaaaatttcgattttttcccggaaatagaaaaaatttttggcctgagcgggacatttcagtcccgggcccataactcgttaggggttggttttatcgaaaaaacgccttagggcaaaattgtagagcttttgaagctctatcgaatggtttaggataggtcgagaaaatttcaaaaattttcgagccaggccccctagaaattttcgggaattttttttcggacgaaaatgggggtgaaaaatatttttctggggtaaaataaggtgctgagtacgaatatgatgtctattttaagtttcagaatttttggaattttttaaaaattcgaaaatatttggcaattttttggccctcgggattttggcctaatatttgaaaattcataacaaatcgaagggttgatcaattttacaggaataaagccttaaaaatagagaaaaatctggagaattttatgggatttatttgggttttctaacatcaatatgaaaaaagttattccagaaattctggaaattttagatttttctgaaaaaaattcctaattc

SEQ ID NO: 28745 - DNA, 1486 bp, Heterodera glycines
ctgatggtggctcttcggtggtcgcttcttcggcctgacgtttctttcggatttgcgcgacttctgctccattagcaggcggttcgccgctttcactcgactttgactgaaataaattaattttacacttaagcacaatacttatattctaaacgcatgcatctactaattattgatgtagcttttgataaaatgagataattttcataatttggctttgcatggctaaaatatttagccctttttgtatcattttttgtgcattttcatttcagaagaaattaaatatgggggaaaattaggttctaatgaatttttaaggggacccgttattctcacaaaaaacggtttatatcaccaaatctcaaaaacttgctagacgcgctcaaataccgggcaaacattttcataatctgacaaaccgaatgaaaaatagcaaaacgatgaaaataacaaaccaggcaaaaacccgagaaaccgagaaaaaagggcacgtatcctcaaaaccaggcaggcaaaacatttttggccattcaaagccaaaatgtgatttggtataaactgcttaaaaattaattaaaacccaaacttaatattatttttttaattttaaaaaacgtactgggaatgagttgatcatttcacaaattagcagaaggaagaaaattgagaaaatgctttgggttcgcattttgtttactggtttctaaatgccaatttcaaaatgtgctaattggttctttcattgctgattttatagatgcaaattttgaactttttcaatcacttaaatttgcttagctgtaaatgccaggcataaatttcatcaaaaaacttaaaatttatttaaacaattgcccatttattaccaatgtgtctgttagtgcttaatgaatccgttaatcagactgaataaacaaaattcttaatgaactgaattttcaagccatcaaattataactgccacgtaacttttgttggttgttaaaactaaatatgaaatttaataaaaatatattttaaatgaattagtttaactatttttgctgataactatttttgctggtcttcaattattattttttgactttatgccatttttggcgcccagtaaagatttttttcttttccagattttcttttcggaatttttttggtaggatttttaggaaatctgcaaaaacccacgatgagatcataaaacaacaattttttctcattttgggcccgttttgtgcatccatcttcagcagtttccatttactcggacagattaatattaaaccaatataaacacgattgaatgccagaagaaatttttttcatagctaaaaaattgtaagtttttaatttcattaaattaaaattatttcgcattttgtgaaagaatggaaatgcaattgcggtaaaacggttctcaataaaatattttttcatcatccctaatcttaaaatccaggaaaatcaaggctaatggaacttttat

SEQ ID NO: 28746 - DNA, 1404 bp, Heterodera glycines
  misc_feature (1389)..(1389): n is a, c, g, or t
gaaaaaaaccagcaaaaaaattttcaattttttttctttttcatttggaaggtccttttttctccaatgggaaatatttttttttgaattattataattaatattaaaccaaatttttaaaaaaatggtgcagcttccatgccatgttcgtgtccactttatcaaaaatatgaataaacaaattttgtttggcccttttttgtcaacagaaaaagcattattgaaaaatttgatgaatttggtaggtttttgtttctctttgtttaccattttcaattttgcttcgagaccggggttctcaagcattaaaaactttatgaggatttaagagtattagttttccattccgtactattttagtaaatacggtaggtaatttacaattcgatgaacaatatttaaatttatatatatttagtgtttttttaattaggacatgaggatgactcatgctgggtccattctgagtggatggatgcgcaagaaatgatggccaatttcattgagcaacattcggtcggttcagttctctcggcatttgctggtcatcatgtgccacaacatattgcaaatttgctcaatgagaatgaagaatccacgcagggtcaaatctttaaaattaatatttagtttattaaaatttgacattttacttttaatataaaaaaaaataaaacttaacaaaataacccaaatttttaaaatcaagagtaaattaaaaatatttaattttttttgttactgaatatctaattttttattgataaattccgaaacaaactcataatatatgaaaattaatttatttctcaattcgtgcggttaaattcattcttttttcaagagcaatttgtcttgactggcgttcacttcgccattgttgctctgttgcagaaatttcagtaaaagagattgtggatggttggtcatcatcaaaatcatctccggctaacggcaaacgcattttcaatgccaattgtccgataaaaaaaagaagttaaaccgattatgtctaagatgtaaaatgattaatgtatgtttattaaacataattagttaattgatcaaaaggcttataaagccaaatatgccaaatcataagattagtcaataattaataatccaactcattttcatcaaattctttgttttcttctttttcttcacttttctgctgctgatcattcgaagccatcattttggcgattttatagtcatagtaagctgacattttgtcaaccaagggcatggcagaatgtttgaaaaagtctttttggagttcgagcacatcgcgctgcagatcgacaacagggtttacggttcgacgaaatgccttggcaaaaaagaaggagaagggcgtgccccgaactcggtcttcggcattttcgntggcacttgctacaa

SEQ ID NO: 28747 - DNA, 621 bp, Heterodera glycines
ctacgaaatacattcaagtactagacaattcaatttaaatcaaggaaaattattttagcccccagacgtgtgttggaacgcaccgtttaaaaacaaaatcaggcaaatttacgatgaatggatggtgaatggagagaaagaaacaacggcgtccggaaatatgaaggctctgccaatggagacgtatctgcaatggattgtcaccgcctggaactcactctcgaaggaactgatcgccaaatctttcctgtcatgtggaattacggaggaaattaatggaagtaaagatgagctgatcaatgttttcaaggtcgtctatttgcagttttttgtgtatttttcaagtgttttaaggcggacggagccataccgaatgggcttaagcttctgagccaacgtcgcaatgaagaaaatgttgtgaaagcacttgaacaaattgatttaggataagatgaaagcgatgtctctgtcgacgttgctaatgaataatattttgatcaaatttattttcttttttaataaaattgatcgccacatgaagtcttttttaggggcctttaattagaggggagggccttctaccagaggggggccttctattgttcaacccctccaaaaagg

SEQ ID NO: 28748 - DNA, 1342 bp, Heterodera glycines
tatatcatttcgccaaataaaaaaagcatatagaaccaaagcaaaagctacctacctaattcccatttaatttcgcagccaattttctataattttcaaaaaaatacaaaatttaaattttaaaagctaaatatttataaaaaatggcttattctcgttcaccaagtcccaatagagaacgttcccatcgctcaactcgaaaacgctcacgcgatcggagcaacgagaggcgacacaaagcgccacgctcatcacacaaagaaagacatcgagacaggtcattttatttaaggacggaaactaagatgagctactttttcattgtgcaaagagaaaatgggtcccctttttcaccattttctaaaaattaaatccagtttttcgttaactcaacaaaaaacatagaaattacagggaccggcgcggagatagggaccgagacagagaccgagaaagggagcgccattccagtggtggagataaaaatcgcgagcaccggagcaagaagaaagacaatgtagctcacgctacaaaggttgtttgtgaagcttgtacgaacatttcaattgtttttagtctaaccctattaatgaaattgtcgatgttgatgaggacatgatgcgaatgatgggtttttctaattttgacacaactaaaaataaacatgtcgagggaaatgcctctggtgagtcgaagatcaaccgggcgcgcaaatatcgtcaatatatgaacaggaggggaggctttaatcgtccattggattatgttgcctaactgtacacgttgttttatgtaattgtttcacctttatatttcttttttgtgatctctattgttcaataactctgcttttacatacttgtttatttacaaaaatatatatttgaaatactattcagtccttgtaatattgactttttttagttgtattataagtctttattgaaatattatcttcaaatggaatcaacttctgctgaagatgaaacgacggtatgaatgaaatggatacctattagaaaatgttttcacaattgggctcatggtttgtcccccataaattttctggaaacgatttttagagtcaggtaggacatcttttcttaggttttcggtgtctgaccatgcattaacaaggggttcgccagtcgagggcacctcgtttccggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagtgtcagtt

SEQ ID NO: 28749 - DNA, 739 bp, Heterodera glycines
agcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgattt

SEQ ID NO: 28750 - DNA, 800 bp, Heterodera glycines
tccgtctccctaccacgaacgcccgggccgatcggacgggtccaacgcgccgttctttccccaattttcgggacggtcgaagaactcggccagcgcgtacaccttcttcttgcggcgtacttccgcctcaacgtcatccttaatgggcattgagagagagaggatgcgaaaaggacagaaacaaaagcacaaaaatgggtcgaatggacaaattttgaacattttcgagtgggagaatgccaaaggaatggcaagttggcattgccaacttagcagagggcatcaatggacagagaactgggcaaaaattacaaaaaagccagcaactttttagctagtaattttacaccaaaattgtcaatttttagtttaaaaaaaaataaatacaatggaaaatagtgccacggcatggatgccaaaaacccggcaaatgctgagttttccagtcaatttcaggaaaggattaaaagtggcgccttaacacagattttgatatctttttgcacctttttcttcgtagacacattgtccttgcgcacatccatcggatcgacgacgtttttgaagttattcctcgtggcgaacgaacgccgccgggggacggcggacagagcgaagagggaaagggcggcagcggaggaggaggggggaacaacaacaacaaatctgagggggaggaaaaggatggcaaaaacggcattttataggggggggggggagtcagtgacaaaaaagtctttttgaaaaaagtgaaccctaatccagccgaatttgtgagctaacgcaatgtttattttgta

SEQ ID NO: 28751 - DNA, 991 bp, Heterodera glycines
  misc_feature (8)..(9): n is a, c, g, or t
  misc_feature (941)..(941): n is a, c, g, or t
tgaatgtnntggcggttattgggttctctacaattatctaccttctgataattcccaaaatttcatctccgatcactgctttgttttgccaagcaatttgttcaaatattggcgcagcgtcaaacggaccgatttatattttacaaggtaggtaatctattgagtgcttgctcagttttaagcacaaaaaatcaccgattcagcactgtaaacagcaccaaattttcccaaaataagcatcaaaaaagcacaaaaaggcaaaatcagcacaaaaaattggaaaaaaacataaaaattaagagattaaaggcaccaaaaattgaaaaaagttgtcaaaaaagcgtttacttgctccctgattataaaaaacctccaaaaaaaacataaaaattaagagattaaaggcaccaaaaattgaaaaaagttgtcaaaaaagcgtttacttgctccctgattataaaaaaccttcaaaaaaaacataaaaattaagagattaaaggcaccaaaaattgaaaaaagttgtcaaaaaagcgtttacttgctccctgattataaaaaacctccaaaataggtgctaaaatggtaatagatgcataatttttaaaaatcaaaatcttgtcaaaaaaataaatttaaaaaaatttaggagatgaattatttttgataaaattttcatttcttaagggtgtatttttctgaaatttttcgggtcgtttctcaggggtgtatttttcgtttttattgcatttttgttaataaattttttgaaaattgctgaaaatattttcgaaaattcctcaaaatgacgaaacagcacaaaaaaagcaccaaaatgccaaatcagcacaaaaaccaaaaaatcgagaaatcagcatgaaaaaagtggacatagaagccctcaacccagtagaaatgcgttttcatgcttatatcacgccccnagtagcaaaaaaacaaaaaacacagcatatgctgcaaaatgagcactcta

SEQ ID NO: 28752 - DNA, 1511 bp, Heterodera glycines
ttttaaaaattctttattttttggaattttttggccctcgtgattttggcctaatatttgaaaattcataactcggtgatggtttcatcgatttaactataataaagctttaaaaatagagaaaaataaggagaattttatgggatttatttgaaatttataccacaaaaacaaaaaaagttattccagaagttctggaaattttcgatttttcagaaaaaaatttatacctcggttctgaaaagtcattagggaagagtataatgctacaaaaatccgcaattttttgctctattatataaattttatttggcatttttatcacatttttaaaaaaagatacaaaaataaaagtgtttttggggttcgggcccaaaggggggtgaccaggatttttgggtggaaaaattttttcaccgaaaatcttccaaaaacatgtcattaggggttatttgggccgctgatcacgaatacgtgatcagattttacttttgacatcgataagacatcagaatccctgtgtgattggggtttctgaggcatcatttttttgggggggtgggagttcggatccgggcggtaacacattatttttatatttattttttgggttaattttcattacttttaataaatttaaatgtttggttttattaataataaatttttttagtttaattaaattattttttgatgaataatgattttcatttaaattatttagtatatttaattaaagaatttcagctattattttaaaatttaattgtaaaatttttttcatttcaatttaaataactattcaattattatacatttcataatttgtttttcattaataaaaagtgtattatattttaaaaaatgaaaaatataacacatcgattttttttatctattttgattaaaaacaattcattaattaccataaatgctctatttgaatgcccactttctaatcactgttgtacctcttctaatcactgttgtacctcttctaatctctgttgtacctcttctaatctctgttgtacctcttctacgcgaagcgtcccaatgtcctcaacaaaattaaaaaacgggcgcgaagcgcccgtcctgaagccgcgaagcggccgattgttctcaacaaaattaaaagacgggcgcgaagcgcccgtcttgaggccgcgaagcggccgaatgcttcccacaaaattaaaaacgggcgcgaagcgccccaatgtccaaaacaaaattaaaaaacgggtgcgaagcgccagtcctgaggccgcgaagcggccgaatgttccccacaaaattaaaaaacgggcgcgaagcgcccgtcctaaggccacgaagctgccgaaaattcccaacaatccacaatatttagaagcgcaaagcgcccgtctgaggccgcgaagcggcccaaatgagtccacaatatttagaagcgcaaagcgcccgtctgaggtcgcgaagcggccgaatgcacttgcctataacttatcaaacgcgcatgcactagc

SEQ ID NO: 28753 - DNA, 1016 bp, Heterodera glycines
ttctgagtaactttatttacttgacccccttgaaatccccccccccccccccccctccgctattcccgtcccctattttgtccccgatgctgatcactttcatttttcttgtcagaaaaccccatgccaccgcgtcgtcagtgcccgccgaatgcttccaaaggtattattcgccaccgcaccaccaccatccaacagcattggcggtgaccaaccacgaaggcgatttctcagtggacgagagtttttacgccgccaatggccaacggttggtcggacggcggtggtgccgtgccacggcttattcttaccaacaaatcgccaaaattccctctggcctttttgagtctttgagggctttggcaccactctaaaaagggcactttttgaacggaactcttggtatgcaaaattctttttaaagatggctaattctgaacaatgaacccaaaagtcgagaattgaagcgtttttcgactttttgagttccgctgattagtgattcgaaatttgtcaaaatggatgtcagactccgtgatcacaccgatcccgaaactctagcgaaaaagtttttctggcctttttacctacataaagtagcgccaaaattttttacattttgtccaaaattttaatcaagtttctttaaaatttaatttcattaaaattctttcggttttaattttttttccccgttttttttggttaattcattttgctttttttttatattttcgggctgttttctttaatttttcgccaattataacttttttttaaattccctttcagctgcgcctattgaaaacctaagctcacattgcccgtggaatgccatcactgaagaagaattaactttttttaatcaaaattgacaaattttttaaaataattttcttgactcagaaaatatggaacttttttttcatgtttttcattattttaaattaaagaaggttatttaagcttaactggagagtattattaaaatttctaattctttagaaatttcttaa

SEQ ID NO: 28754 - DNA, 978 bp, Heterodera glycines
  misc_feature (907)..(907): n is a, c, g, or t
  misc_feature (967)..(967): n is a, c, g, or t
cgtttttgttgggtcaaaggcaccgccggagcaaacgacaaaaatggcagggtcaattttgacctccaactccagcttcttgcgcacgtcaaccatgtgctgaaggactgtcgcagaacggcctaaaaagagcaataaaaaaaaatttgtttaaaataaattcaggttttcaactaactgtcatgaaaatggtcatttttatgcaaaactgctagcaaaaattctcatattttaaataaaattccaacgatttttctcggcgattcacacccgaaccccaataacttttttttcttaaaaacgctcaaatgcaccaaaattaaccgttttttgcgataattttttaaataatactctcaattcaaaattttcccgtcctccggttcccaaaacagttggtgaagacggactgattttggcggtctgaacacgtcgattgttcaccgccggggaatggcacgtaaacaccacctaaaattacagaagcagtattgttttagtttaaaaaaatcaggagcatgtttaggaaaacacgttgttcaaagtcgccctctagcggatttgtttcaaattttagtgacattctatttacaattaaaaaattcatcaaaatcgctactttaggaatttattcctgggtttgttagccataatttaccttcaccgattcgatgctgctcacactgacgccagtccagtgtcattgcgcaacaaatgggaggaagtgtcgggcaaatcactccgcggggtgctgatttgtttggaagcattttcaaatgcctaaaacagaaaaataaggaacaaataaacataaaggacatacttaagagttgggtaagctgttggaggaatgatttggtgatggtgatgacaatggttcggaggcctcaacgattatggccaattnttgggggtggcaatgcgattttggaatctccgctcgtctctttgtccttctggtgttggnaggtcgatgga

SEQ ID NO: 28755 - DNA, 1443 bp, Heterodera glycines
gttatgaatttttttctgaaaaatcgaaaattttcagaaattctggaataactttttttctttttaagatagaaatcccaaataaatcccataaaattctcctgatttttctctatttttataatataattgcatgaaaattgatccacacttcgatttgttatgaattttcgaaaattaacccaaaatcccgaaggccaaaaaattgacgaattttcaaaaatttttaaaaattccaaaaaaatctgaaacgaaaaacaaaggtcatattcgtgctcagcacctcaaaataccccagaaaaaaatttttcacccccattttggcccacaaaaaaaaaattgaaaatttctagggggcctagctcgaaaatttttgaaaatttgagaaaatgaagtacaccgttcgatagagcttaaaaagctctacaattttgctctaaggcattttttgtctaaaaccgacccctgacgagttatgggcccgggactcaaatgtcccgctcaggccaaaaattttttctatttccgggaaaaaatcgaaattttttcaaaaatatcaccaatcgatagagctagaaaaactatgttttggaagtggtcttcgtttttctgggaaaattcgttaaaaattcttaaaattcaaaaaccaaaaaaccgttttttaggcctagctcgaaaaattttcaaaattttcgaaattttaaaatttagaaaaatcgagctttcgaagctctacaatagtgccgctggcacccctgcgctcaggtcaaagcctaatgagttattcaacggggactgaactggacaaatttggtactgaatttttgtagaagcacacaggccatggggttagagatagaggcctggaattttttttaacatttagccaacacttcaacttagggccctcacagcgggaattttttgatccgagttttaaaaaaaaagttacgggccctaaactgcaagaaaaagtgagaaatcggtccccgggactcagtcgtccgcgcagaatttttctctatatttttcccggatgcgccgtgaaaagttgtaagaccaatgcacaactttcaaacccgtcccgttagccattcccgagaaattggttttaaggatgaaaccccttgtcaatataacgtatatataattaatttaattaatcgatgggtaaatgtccaaataaacatttatttatgccttccctcaatacccccccccccccaactatttacatggctgggccccctttagaaaatttcaatttgggtccccaaaaccccactttgtcagtcgtctcgcgtcctccatatttggagatcaatttggctcccgaaacgaccgcatttctggtggacgtgaagttggaatgggactcgggcaaaacagacgatgagtgaatgagcggggagaatgtcagttccgactgatcgacctgggaat

SEQ ID NO: 28756 - DNA, 1284 bp, Heterodera glycines
  misc_feature (17)..(17): n is a, c, g, or t
  misc_feature (78)..(78): n is a, c, g, or t
  misc_feature (1275)..(1275): n is a, c, g, or t
tcaatttcttttatttnttataaatcagcaatatggattaaacaattttgtctttttatctattaagagaaagttatntaaaaggtatttttaagttataaaaaatattatattttataaatttaaaaaggaaaattcatagaactaattaggtaaaatatttaaaaatatcagaaaattacaaaataattgatttaaacaaaaaaaattatttttaattttataataaaaaataattgaaaatttaaaatatctcttcgctaatgtacgaaagaaacaaattaaaaaataaataaattcttacacataaattatgcaaaaaaattacggattggatattacgggaaatcaacatgaaatggaaaaagattgttttaatacaaaataatatttaaaaacttttcgtaaaatatttaaaggttttaatttattattttaaatattttaataacgcatgctgagcagtcatcgattctaattcaattttaaaattattgacgtgaccataaatgttctttttctgatcaattggcttgtgttatgacattgtgtgccgtattttgcatagtaagcaaaagcccattttggcgatatcttcggaacataatgccagccccggcattttgccaattgccaaacgcttttccctcccccaccaatgtttctgtgtttttctcttcgatattccattttcaattttttttaattgtacaaattatttatgttaaatctcttatttggactattttacttcggcttaatcctggtattttttgtgcattgaaatatttgttaacaaatttctctccaataaaataaaatttcgaagggactggcagaagaaaaccacctaccggagtcaaaatcatttttgaatatgccgatcgttttaaaggcgactttcctacgtctccctatctattcctttttttgccatttcttctcttcctcgtcttctgccgcttctattcatgcccattttccaccatctctttccactaattcatattcaaattttttgctttgactattatctttatctaattttggcagttttaaacgaaaaacataaaaaattaaattttaattaattgaattagcttttgttctgaaaaatgcacagcaattcattcttgaaagagatgaaagagggtgaatatttggaaagacaaaagcaatggattggtaaaaatcttgagcaaatcgaacaaaagacttccgctaagaacagcgcaatcatcgtatgccgttttgcgccccatttgaattgtgaanatgatttta

SEQ ID NO: 28757 - DNA, 986 bp, Heterodera glycines
attaattattattatattatataaccgttgttattgtgtgtacttaactgatcaatctccgccactccttcacccaccctttggtgtttcattttgaccaccaaatggacacttttcgctttctctctccatctctctttcgattcacaaacgacacacactctctagtgcattaattgttcttttacatattaattgtgaatgacgcgacgccgcacatgatgtcatatttacagccgaataataacgggtcagactgctgctttattattaccatttttgtgaatgtttttctctttctttttgtttgcttgttttcatggacacaattatctacttattacaatactgtaattcaatgagagtttgactccgcatttaaattgatactccgatcgattaaaatgtgtgtaatgaaatgaaaatgcaaataaaataagttgccgaggatcattttgcttttgtcctattccattggttccgtgccaatttctctgccaatgaaagcaaatttccgtttcatttaccatatggtgtgctgttgaaatggaacttaaaaagacaaataatttatatctggcgaactgtttaaatttaaaaaaatcgcaaattttttttatcgaaggaaaaaaaacattaaagttaaacaaatttacctatgtatgtatgtgtgttcacgcaattaaaagctataactaacttaaccctttatgtgcactcgtatgataatttcttatttgagctttttgtattaaaataattttgctaaaaaatgggtaggaagaagaagaagccgcaaaagccatggtgttggtaagtcgaaatcaaattagttttgatgggcatcattccttttgtttaaggtattgcaaccgcgaatttgaggacgaaaaaatactcatccaacatcaaaaggtttgttttatttgtacggataacttaatttggaaatggaattgtcggatttcaatgacagagtttaattg

SEQ ID NO: 28758 - DNA, 1459 bp, Heterodera glycines
  misc_feature (1437)..(1437): n is a, c, g, or t
aaaattcatcgccactgccgccttatatgatgacggcaagcggtggcgtcgcaaaattgggaggacggtaattagcaaaattaaattaatttttaataaatatgcattaatttgtggccaggcgtcaccgacggaggccctattcgtattacgggggaatgggcggcggtggtgcgagtccatttttggtgggttttcttgatttattttattttaaaaaaatatattttaaattttttatctctaatgattccatttgctcttgattttatcctggattcccctgggggtgtaaatttttttgagggagggtcgccggcgaagggaaaaaaattaatttaaaattcaaaaaattttcccggcggcgcctttcggcacctccgaatctcctcccccccccccctagttcaccaaaatttttttgaaaaaagcgcgccgcaaaaaaaggtttaaaagcaaaaatcgtttacattgccggaccccttcgcaaattggccggccacttaccctcgcccttcaattagaggctttaattagtcattaattttgtccctgattttgtgcccttctctcccctccatttgaactacccccaccaatttttaggcttcgtccgccggtggaggccaccgcggttggctgtgccgcgcgttgcactgccggaggttgaagtccgtgtgcttttttttgcttccattaaaccaattaattaatttaatgagtggcttaattaaccgtcataaaataggaagcggcggatgccacttagccaaaaaagcttttcaaattaataaaattactttaatataatcgatagtttaaaagctgcaaatacaatagaatagaatgcttattagcttttcctaatatagcatagaaaaattgattttaaaaaaattaaaataatttaataaaattaattttttttaaccattcacttcaaagcttcctaagaaaaagccaaacaattaaaatttataaaaaaacataaatttttctttttgttcagcccgtccaaaatcgacaggctttcccgctcatgtttccccattttgttcatcattttcaatttggtctattggtaaaaataaatttttttttaaatttaattataattatttattatgtttatatttttaggtccgctatgacaataatgagtcagcgcgagttggagaaggtcgaatttgtgccgttcaccagctgaccaaaatgccaccatttctttttctcattttctccacaattgctcactcatttttttttacatttttgtacattttgaagaattttatgatcaataataaaaatatattttttaaaaatgcatttaattctaattatgattccctgatcccgacacaaactcacgaataccgacacaaattacgaaggggttcgggcataaattgatcaaaagaggaagaaatgaaaganaatagtaaatcgacatcattta

SEQ ID NO: 28759 - DNA, 1038 bp, Heterodera glycines
cctaaaaatcctatataataaagttgagtgtttgtatgtacggatttttgaatttgtgtggcgttttgttattattttgcgttaaaaaatgatttgaaaatgaaaatgtttttgttttgttttgcgttaaaaaagcatttgaaaaatgaaaatgtttggttttgatttttcaatttgttttgcaataaacattcttaaaattatacctatttatttgcttttttatgtatgttcatagtttaataagttatttgtcatataaatttgttttttgtaaacgaaaaaatttatcagtatattgtttgagtatgatttagtggttgttgtttgtttgtttgtttattttgtttttgtgttctttacgtgaaataattatgcttatgcttaatgttatttgaacttttaatgaaatagaaatgcatatctttggtttgttctgtgactttcgtgtgagacactaatgtgtgtcatgcttttgaaaaaacaaaaaaacattagtggtttgttctgtgactttagtgtgagacactaatgcgtgtcatgcttttgaaaaaacattagtggtttgttctgtgactttcgtgtgagacactaatgtgtgtcatgcttttgataaaacattagtggtttgttctgtgactttcgtgtgagacactaatgtgtgtcatgcttttgaaaaaacattagtggtttgttctgtgactttcgtgtgagacactaatgtgtgtcatgcttttgataaaacattagtggtttgttctgtgactttcgtgtgagacactaatgtgtgtcatgcttttgataaaacattagtggtttgttctgtgactttcgtgtgagacactaatgtgtgtcatgcttttgaaaaaacattagtggtttgttctgtgactttcgtgtgagacactaatgtgtgtcatgcttttgataaaacattagtggtttgttctgtgactaaggtgtgagacactaatgtgtgtcatgctttgaaacaaaaaagagtggtttgttctgtgactttcgtgtgagacactaatg

SEQ ID NO: 28760 - DNA, 1022 bp, Heterodera glycines
tgtcatttcctgcataaatgttttcatataaaggtccctctaggtgatcgggtttaggaacattcaacaaatgcatctataaattttttgaatattatacaattgtgcattttgctctctatcaatttattataaaaaaattcacttcccttcgaaattgaaggcagaatgctcatttgaagctacgcaaatataaattaatatttgctataagaaccgactatttagtcaacagaaaacaaataaatcataaaattagaacaaaaaatgattttattttagaatgcacactgaagatgcataataagctaatatattcgaatttattttgaaataactgttcaacagattattagttatttctaagaaataatgataggaagcttatctgaaatgtgtgcttacccaggttggaatttgtcatttcctgcaataaatgttttcatataaaggtttaaaaaatttgatcgggtttaggaacattcaacaaatgcatagataaattttttgaatattatacaattgtgcattttgctctctatcaatttattataaaaaaattcacttcccttcgaaattgaaggcagaatgctcatttgaagctacgcaaatataaattaatatttgctataagaaccgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatacaattgtgcattttgctctctatcaatttattataaaaaaaattcacttccccttcgaaaattgaaggcaggaatgctcattt

SEQ ID NO: 28761 - DNA, 1491 bp, Heterodera glycines
aaaaggccaagatgcaatggatcaacggccaaagggacaaaatacaatggaaacggccaatgggacaaaaggcccaaaatgaaatggatcaacggccaacgggacaaaaggccaaaatgcaatggatcaacgggcaatgggacaaaaggccaaaatgcaatggatcatcggccaatgggacaaaatacaatggaaacggccaatgggacaaaaggccaaaatgaaatggatcaacggccaataggacaaaaggccaaaatgcaatggatcaacggccaatgggacaaaaggccaaaatggaattggtcaacggccaatgggacaaaaggccaaaatgcaatggatcaacggcaaatgggacaaaaggccaaaaataacatggcaaaggccaatgtgacaaaaggccaaaaataacatggcaaaggccaatgtgacaaaaggccaaaatggaattggtcaacgggcaatgggacaaaaggccaaaatgcaatggatcaacggccaatgggacaaaatacaatggaaacggccaatgggacaaaaggccaaaatgaaatggatcaacggccaataggacaaaaggccaaaatgcaatggatcaacggccaatgggacaaaaggccaaaatgcaatggatcaacggccaatgggacaaaaggccaaaaagcaatggatcaacggccaatgggacaaaaggccgaaaagcaatggatcaacggccaacgggacaaaaggccaaaaagcaatggatcaacggccaatgggacaaaaggccaaaaagcaatggatcaacggccaatgggacaaaaggccaaaatgcaatggatcaacggccaatgggacaaaaggccaaaaagcaatggatcaacggccaatgggacaaaaggccaaaatgcaatggatcaaaggcaaataaagaataccaagaggattttgaaatttttattaattgagttaataaaaagaaaaactaaatgtctttttgtgtagaaaaaggaaaatgccctcaaaagtcgctttctgtttatgagcggggcaaattgcggactaaaaaatggatcaattgaaaaagaatgaataaaaagtcaataagaaaaagggggcaatcattgcgaaggcaatgggcaatcagaagaataagggcagcggatggaaagggatacaaaaataagtgaaatagtatatgaaaatgagagggaggaagagaaaggacaaggaaatagttaatggatgggtacatcagcagataaggtgatggatggcaaaatgaacgattaacgggaaaaagatgggaaaacaaataaatgggaatacagagagaatacagaaaaatgagagagtggaaaaaaaaagggaaaagatgcaaaggagtagagagaatacagaaaaatgagagactggaagaaaaagggaaaagatgcaaatgaccgtcgcggaggggtgggaaacggaatggaccgacggattgggccaagaaaatgtcattgaaaa

SEQ ID NO: 28762 - DNA, 1814 bp, Heterodera glycines
  misc_feature (1733)..(1733): n is a, c, g, or t
  misc_feature (1737)..(1737): n is a, c, g, or t
  misc_feature (1741)..(1741): n is a, c, g, or t
  misc_feature (1745)..(1745): n is a, c, g, or t
tgcaacctcatctacgcaaaaagccctgtcaaaccaatcaaagtggccgcacacgacggcacaattccaaagctggaacttcaagcactgactctcggagtcaaggcagtcaaattcatccaagcgcaaatcaaatttgccgatcatcaagtcatcatgtggacagacagtcaatgctcagtcgaacgacttcgagaaaacaagcgccaagatcgatttgtggtaaatcgattacaaaaaatccgagaagcgaacttccaagtccgacacgtcagaaccgactcaaatccagcggacatggcatcaagaggagcggatcttcaatgccttcgatcatcactgctttggcactttggccccgtttggctttcgaaagcagacaaatggccaaaatcaaacgtcatctaccggcccggagatgaattcaaagaagtggaagagccaccaatcatcgaactgacaacacctgttcatgtcgaagaacagttcaaaccatcaatccacttcgaacgatttttgaattggaacaggctgaaagccaccgcagcacacgctatgcgcttcatcaaaaagcttcgcacaatcgaaaacggcacaattagtgaaccgcatcaaaacaacaaaccactgaccatggcacaactgcaacaagccgaaaattggatcttgagagaagcacagcggcttcattcaccatccaacgaccaaatccgagaattgcaactcttccaacaagaaggaatttggagatgcggtggacgactcgaggaagcaccggatctgccatacgacagtaaacacccaatctttctgccgccacacgcatggataaccaagctcatcatccggcattatgacaaacagctcaaacattgcggtccgagaatactcctgtcaacattaagagagaagttctggataccacgcggacgcaaaacagttcagcaactgctcaactccccgcaacacggatgtcttgaatgtcgtcgagaacgagtcaagccgtacacatatcctgaggcatcggatttgccaaagggaagagtcagcgaagcacgaccattcgacaaaacgggagtggactacttcggtccactcaaagtcaaacaaagcaatgacgtggtaaaaatctacgtcgcactcttcacctgcttggccatccgcgcccttcatttggaagtagccgaagactactcggctgaagcattcctccgagcctttcggagattcacggccagaagaggcataccatcacttatcatgtccgaccaaggcacaaacttcgtggcaggagcaaaagtcatcaaagaaaactggaccgacacgttaatgccggaggacatgcaacaacaaatggcgcaaagcggaattcgttggatttttaacacagcccacgccccttggaaaggcggtatttgggaaagactcgtcggcatcaccaaaaacgcactgcgaaggacagtcggcagaaaccttctcacattggacgagttcggcacaatgctctgcgaaattgaagcgatcatcaacaatcgaccactcacgttcgaatcggatcaggaaccgatcaaagtgctgcgaccaatcaacttcctgataccatacagcaaagcagacaacaacttcccaatcattgatgacgacacaaacgatccaacatacgagccaaacccaacaaatcgcgacaaaatggtggcaacactgagccacgttaatgctcggctgaacaattnctgngaantttnggaaaagtgactaccttcttttcctgcgcgaacacgaccgatcaaatgcaacgacaggactacaaaccc

SEQ ID NO: 28763 - DNA, 933 bp, Heterodera glycines
catcaattagtaacaaatttaacccaaaaatgcgttaaaagggctctaattggttcaaaaattgcctttccattttcaattttcctcctacaccaaaaaaaagaaatgtttccatttgtccatttttgtgacactttgtcttctcattagctgcttaatccccttctcgtttgactatgatgacgacctgttcgaaattggcactgctcagtccgtagcagtcaccggaattttgacgtgcaatggacgaccaagtggcggcacaaaagtgaaactgtacgacgtggacagtaagccaaactcacagtttaatatggtaatggcaacattaaaatttgtaaagcttttgacccgacgatttgatggccgaaggctttacggacgaaaaggaacactttctgctggagggattcgaaacggaaataagcgacatcgactcgaagtgaacatttaccatgtgatataaagggacaataaaaataattagctaattagccaactaattcatttcaagaattgtaacgacgaacatatccctgtctgcagaagttctccattgaggtgaatgaaatttgaatttgaagacatttaattcaataaacttttagatccccgacaattacataaccgaagaaaaacgatcaccacaaaagatttttgacattgggaaattgaatttggaaggcaaattctcgggccaacatcgagattgtattaatcggacattttgttgaatttattaaatacaaattaaattttagaagtaaaataatcgataggatctgtccgtatgtggcttcattcaacttaaaaaaactcaattattttcaaaataaattaatttttcctcaagaaatgtggttgcccttacttacaagggaacattccgagctgtcagtcggaaaaggcatatatatgatatagcatgtggat

SEQ ID NO: 28764 - DNA, 1744 bp, Heterodera glycines
atttgtgtgatcagaaaggggggaaatgggaattttaattttaaagtgaattttaatttaaaatttgggggattcccccgctttcggccggccaaattggcacaaagtttcacatgccaaaacctcaaaatttttacataagaaatgaattttgtttgttacgactgaatggcaagttacgcttttagtgcctattaatcttttccaaaacccctagttattcatgtgatattcccgatttttttagttatttcagcaacaaaaatggtgctgggaaaagtcaaaaatggaaaagaaaaaaaaacattttgcgcagaataaaaaaagatgccaaaagcatcggccaaacttaatgaggtgtgttaaatggcaattatgtaataatgtgtgtgttttgaatacatattgagaaagcgaattcgtaatgataaaagcaattagcagcatggaatgcaaaaaataattaacataatgatgaaagctaagctaattaaaatgcaacaaacaaatggaaagtaacttttttaaaataaatttttttttagcttaaaaatgctaaaaaacccatcgccaaatccagtttaatgcttaattaacataataacttaaattgttttgattttggcattaaaattttgttttctgtgccgtcgtgattcagagactaatggccccaaataaaatatttgtttgccgtttattgacacacagtgccccccccccccattcattatagaaaagtgtctacctgtcctctaattagctttaccacacccaataaattttagtttgcttttgctttgctgtttcttcattattttattgaagatgcactacaaattaaaaacaaaattttaaagttcagcaaacaaggcaattaattaattaggctctaatgcattttaataatggacggagcagcaaacgtacggacggacggttggaacaaatttaattttctgaaatttacactcaaaatgagtgagtggaagtgggaaaagagattgagaaaaaaggaagaatgaagaacacggtagcaatatggtaatggaagagaagggaaggaagaggagtaagtagaaaaagtggggagagagaggatgaaaaagaaaaagtggagagaaagagaggaggaagaggatgaagaagaaaaagaaagaaaggatgaaaaagaaaaagtggggagaaagagaggaggaagaggatgaagaagaaaaagaggagagggagagaggaatggaagagaagagaggcgcagaaaatagttgcatgggaccatgaattccttccgttcatccggcacaaaaaatgccgggatatatgatgttactaattataatagggagaagctaaaaagagaacggcgcgaagggtttccctcctcggcccattgcttaacagttttggtgaaaaggggaagaaagtaattagggggaattggggaacaaatggaattaatccgagtgaagtcgccttaattatgctaaaatctgccgacagcgaaagaaattcgcggcaaatggtccttggacactttcgctttcacttacattttgtcgtttcgttatgttggttcattttaatggccactgaatgtgtgtggccgcgtgcctttaattgcataataataattcaatgctaattgtttttgggttaattaattataattaatttagaaatgtttcaatgctaaaaaacacggcaattaacacaaaataatgtgataagaaaaggattggttttt

SEQ ID NO: 28765 - DNA, 1243 bp, Heterodera glycines
  misc_feature (1171)..(1171): n is a, c, g, or t
aaaagacgtttttgtacaatttgcccagtgtcctcacctgctacattgggtttttctttggcgtttttgtcgccaatttggtcgagacttctctcactcccgtatttgccggcggaatgtgagcaaagcattggcggccatttcctttttaaaagtttccctttattttcaggttcctgtacatttcctttgtgagtctgcatttttttaaaataaattccatcgccgcaaattttttttttatttttcataaattttggtctttaattgaaatttttgaaaaaattttgtacaaaattccattgtactaactaccatgccatcacaaagcccatttgaaaaaaacttgttaagaaaattcagggaataaaaaaaaattgaaaacatttttcttgaaattttgagcattttatttttgctcttcgagactcgttttttcgccgtgttattttcaaaaaatgcattttcgtggcacagccggtgacagtttttgtggaatttgtttagattttgctccttaaaaagcaatttgcggtttttggcaaatgggttccccactttttgccttttatgtgcttaatgatcctttcaactttcccgataacatttaatcgcttatgagactgttaattgatcagtttttccctcctcttcgctccccaggttttcatgataccgaagatgaaaagggccatggaggaggcgctcaccgtgtccctttcgcagggactcaaagtgcttgccctgcaggcattcggagtgctcactggtgagagaaaaaatggctaaaaaacgcaaatttttcaattcgttctccccccccccccacatttttcaggtctgagcgtgatgtttttcatggcattttatggcgaaagcattaaaaatgttgttgaattttagtcggtcgattttgcatttttgtggaggatttgttttgtttttctttgtgcataaatttatcagaaatttcttgttataaattgttatattttatttaatattaagcatttcgtggtaaaaataaaatatttaatcatttacaatttaatgaaaatttcttcaataaaacaatttttttatgactgtgaaaccaattttcaaaatgattttaatttttaatcgaatggacaattgtttaccatactttatttcgttcgccattttttanataacataatgatacacgagaatgggaaagtctcgaagcatcattaaccgctaatctgcagttccggcgcca

SEQ ID NO: 28766 - DNA, 934 bp, Heterodera glycines
  misc_feature (19)..(19): n is a, c, g, or t
cggaaaatggcgtcatttntgggatgagaaatgacctgctgttcagctgcctgaatataagtactcacaaaacgttatgtgttcgttgtaaaagccgagaaaaacaatgcttaaacatttcgccaattggcaatttcccattttggcactcgccgacgccccataaattaattgagcaaggctaattgaaatcaacccctaattagcaggacatattaaaatagcttttgtaatggtaaatatttggtgaaattgttattttaaattgataaaattcctggcacttttttaaaatgtatttttctgccaaaaacagctgaaaaaataagcattggatttaattggcatttaccaaaatttaaaatttaaatgaccgtccattaaatgcaacgaaacgtccgccgatggaaacccttaaaaaaccctaatttgattaaatcaaaaatattttacagttattcaaatatgaaaaagttcatttttattgggatttttcatcttttttcttgtttctacagttcatttttatgccttttcagacgcattaattgtttaattgtgcgcttttgtgccaatcccttcactttttggcgtaaattcaaaaagtttggcgtcttatcatggccaggttatcatcattttgctccgcgttctctccccgcttccccgtcttctccgcccttctgctgctcctcgcgctgtgctttcttctcggggcggaggcggcgacgtgagaaatttaaaatatattttaaaaatattttaaattacaaaatttttagccttttaatacaaattgaaatatatattaatttacaaaactttttaaacgtttttttaatattccgtttttgttcatttcagctggcgaatgcggacggacaaaaggcgatgcgaaatgcactcgtacgcttcggcaagcgcaacgcctacc

SEQ ID NO: 28767 - DNA, 1679 bp, Heterodera glycines
  misc_feature (1552)..(1552): n is a, c, g, or t
agcagatgtataaaatggcaaaaataagtgcaaaatcaaaaagtttttgagaatttggataaaataatctaaaatttaaaatgctgaattattttttgagtagaagcaaaaataagaagcacataaagaatcagaaagggtagctgaaaaatttaatttttgcgcaaattataagtaatattcaaaaactcataaaactttctttatctgtgcacttgttcaaaatatctgaaaaaaattactgttagtacataccagcgatggcatggaattccgatttccaacatttttgataaaaagtcggaaattttaggaattttttttttcaaaaattaacaattagcattttatttatttgtcattggcacctctggagtgccatttgccgttgccatccacaaatagcagttggacttttggacaatgcttcagatggcggcaagttgcccgacggatgggccccgcttcgcgcacagccaaatattcggtgatgtaatgggccggttggcccaacaaaaccacctcatccgcaacataaagcacctaaaagttcgcaagaattcaaaattgaaaaaaaaacaatttttatttgttcaaatcattattgccttaagcccggggaatgtttgcaccaccaaagagacgacggaaaactgaggctgactactggctaacaatgtattggggatttgccaaatttaatctttgaatttagtaaggttttaattttaaaaataaccaaactaataaaattcaacgaaaaataaaagtttcagattcaaaaataaataaactgacaataaatattctcgtgcctgttttaataaatttttaaaaatcacttctttgcggcgacaacgaaatttgaaaaaatggatttgaacagattccgcaaaaacaatgagaatgaaatggaaataagcaaaaaagacgaaaagagcacaggcaacagaagggaccatcatcggcaaaaacgcaaaatttgagccaaaaatcagctgaaaagacacaaaaaatgacttttaattgaaaaaacgattacccgatgacaaaaatcggcataaaattgagccgaaaccatttgaaaaagtgcaaatttagcgacggtaaactgcgcaaattcggccaatcgaatgcaccacacaaaattggccaaaaattggcaaaaagcaaaatgccaaagtgtgaacgcccatttcaaaaagcattcaaacggcgtaaagaagagagggaactgcgcgaaaattgaggccacgtaaagcaaagcgaatggctgcataaatgttgggtcctatgagaaataaaattttaaaaacattatgaaaatagcaataaatcgtttagtgaggctgtttaattatatatttttttaaattcttaataatttttctcattaactaagaaaatttcatcaaatactataatatgaatttatggctaaaaaactcgaaactttatatgccaaaatggaatgatgccaataattgttaatttgttgcataatattaggtcatttcataaaaatattgtccaacctaaacatcattttcanagaaaaatgtgagaattcaaaattatgccaataataatcgaattaggcggacaatatttatgaaataacccctcataaatcataaagaacacttagatctatcgaataataacacggattaaaaatt

SEQ ID NO: 28768 - DNA, 1010 bp, Heterodera glycines
cgatttgttaacagattttgtccaaaaatgaccaaattttgccacaaatcacatattttcttgataaaataatgacattctgccacaaaatttaaaaattgcgagtatgtttaagaaatcaggacaaaattgggccactccctccaaatcaggacaaatctgacaaatcaggacattttaattttatcagatttggacccttcaaatcaggacaaatctgataaataaggacagatcacacccctgctgtacatgggcgtggggatactgtatggggcgcagcacctcgggttcccccctcccagccatttgcccccgttttagaattatttattttattttttgaaaattcccccccccccggttcagttccccccgcatcgtttaccccctggtaaataaaaatttttttttttagtaacttatgaaaattttcaagaaaaaaagcttagttttttataaaaattttttaaaaatcttagtaattcaaaaaaattttggaaattttttttttcttaaaattttcatataaaaaacacaggttttttttcttgaaaaatttctcaagttagtaaattttaaaagaaatttctcgggggggggaacgtagtgcaccctactgcatgacaacttgggcaaatttttcataatttttccaaaaaaactaagaaaatttcaataaaaaaaagaaaattttcaaacgctttttaccaattacatcttatggtgattggactaacgcccattttgatggtttttcaaatatcaccatgaaggggagtgatctgatcaaattggtataaaatactcttttggccagggaccaaaaacttggtttaacagaaaattttccagaatttttttctttgcatatattgagtgttttcattgatttaataaatctttttgttccgtgtaagtgtccactaattataggtcgaaagctctaaaaaaagcaaagatgaagcaaaaacgactaaaattaatgaaatgaagaagcagtttgatga

SEQ ID NO: 28769 - DNA, 1026 bp, Heterodera glycines
  misc_feature (25)..(25): n is a, c, g, or t
  misc_feature (948)..(948): n is a, c, g, or t
  misc_feature (968)..(969): n is a, c, g, or t
ttcggagataatttcggtacgtttntctgtcctaataatgtttattaaaatgattttattgcttttttaaacaatgctttacccctttaaagcgcgctttcataacattttctccaatgtagaaactcgctaccatctttttggcttcatcttaacaaaattcaacttgtttatatttaacctgtatgttcatgttatacagtaccgagcagtatcaccgtaatgtttgataagttagcatcggtcagtgccgtaaaggaaaagttgaaaagcgaaatgcggccggttagggcaaatgtttgatccgttgacaagggtgggcatgcttctgacccaaatgttggcactttgggatcaattggcttattcgagtccatcggttggataaactaaaattgtcaataattaaatggccgtatttatccatagataagtatggggatttaattgactccttctcaagtaatacgtaaagcagttaaaaaaagaaagaaaattttcttttctaaaacaaaaaattgaaaatccattttaaaaattacaaattaaatgaaaagtggcccctgataatttttctattaggcaatttaactccctccttctcacttacccatgcatccatggcgcagttacagcttcggttgacgtgcagatgaaccgtttgttggcccgtcattggcaccatgtccaagccgagcagccaaaggccggaaaattcgcccaaaaatgcactgtttttcaaatttgccaaataatcggtttgggactcggaatttttggccaaaaatgaagcatctgaaaattatttataattaaattaaattaattgaaacgaattaaaacaaaccactaatttgtggtgaaataaatgtgaaggaatccttcagatttccatcaaaacgtagcaaaaaatgacttcgattcactactcccaaatcgatgctttanatatttaatcattatcattnntgaaattgatttattataaagctattctttatttctataattgatatgtcatttttc

SEQ ID NO: 28770 - DNA, 1199 bp, Heterodera glycines
  misc_feature (33)..(33): n is a, c, g, or t
  misc_feature (1152)..(1152): n is a, c, g, or t
  misc_feature (1163)..(1163): n is a, c, g, or t
  misc_feature (1172)..(1172): n is a, c, g, or t
  misc_feature (1175)..(1175): n is a, c, g, or t
  misc_feature (1185)..(1185): n is a, c, g, or t
  misc_feature (1187)..(1187): n is a, c, g, or t
  misc_feature (1191)..(1191): n is a, c, g, or t
ttttttagaataaaaataaataaaaatattaantttggtatataaattaaaataaaactaaaaatatatatgtttaaaacaaggttataataataattgatttaaaatatgttttcatttaccaaaaaatcttcacaaaattacagaaaaaattcaccaatcaataaaaatcaaaatatatttcacgtgtgaaaaaactatttctttacaatgtattaaataattgaaacgtttggctagtatatgaacaaaaatggaaaacaattaattttcaaaaagataattaaaaggatatacgcagcgaggggataaaattattgccgaggaaaggaacggagaccctaacctaaaaaacatataagcaatcaaatatttatgacaaagatttttccagttaaaaataaatgtccatcaataattgaacagaataattatattaaaacaaaactacaaaaaaatgctatataactagcaagattaaatattgtccgaggcctagggacagtgcgcgaaattttcccggattttttttaagttactgtattttttgaaaaaaattttaaatgcggggaaagttttccaaattttccagtgggacagtaaaaaaaaaccccaaaggtttagggctatttttattttttaattctcgataagcagggaaatggcgtcccattgcgtgatgcgcagggagaggacggcgtccctcccttctaagcgttctgctgctgctgtgccgttcgcactgtgagcaaggcagacgtttgtctctgacccttttccttaactctctctctttcttttcctctattattctcacgcaccaaaaaaaatgctgtggtcagcgaccaatatttgaccgcatcatttttaaattgcctttacgcatcattttcaaattgttctttttcttcccagtaaaagaaaagggatttatcaaacggcaaaaataataattttattatttaaaataaattcgtatagtaccccacgcaccacctttaaatttaaatttaaattgaattatatccccccgtttttgttcttatttttaacgcgattttcacccccccccctttctctctctgcacttttctctgtctctcttttccacgttcttttctttttaattttaattggtcatttagaggaatncaaaaaatatncacgaaaantgnccaaaatatncncatntatatgca

SEQ ID NO: 28771 - DNA, 612 bp, Heterodera glycines
cagtgattgaaatgttggtgggttgagtcccactgtttgaaatgttggtggattgagtcccagtgattgaaatgctggtggattgagtcccagtgattgaatgctggtggattgagtcccgttgattgaaatgctggtgggttgagtcccagtgattggaatgttggtgggttgagtcccagtgattgaaatgttggtgggttgagtcccagtgattgaaatgttggtggattgagtcccagtaattgaaatgcagaagaattgagtcccagtgattgaatgctggtggattgagtcccgttgattgaaatgctggtgggttgagtcccagtgattggaatgttggtgggttgagtcccagtgattgaaatgtcggagaattgagtcccagtaattgaaatgcagaagaattgagtcccagtgattgaatgctggtggattgagtcccgttgattgaaatgctggtgggttgagtcccagtgattgaaatgttggtgggttgagtcccagtgattgaaatgttggtggattgagtcccagtgattgaaatgctggtggattgagtcccgttgattggaatgttggtgggttgagccccagtgattgaaatgc

SEQ ID NO: 28772 - DNA, 813 bp, Heterodera glycines
  misc_feature (729)..(729): n is a, c, g, or t
cagggatgacacggaattccgatttccgtcatttttggggtcggaattccgatttccgacgtttttgggcctcggaatgccatccctgatagtgatgttcttgagtgggagaggaagcggttctctgctgcactttatgagtagtctaaatgcattttttgagtccaatcaattaaccatacctggttttttatacaataatttttgttcatgttcgaataaaccctttttttgttaacaattcgaaaagcataaagcctaaagaagctaaaataccgtatataaaatttcagcgtatgataattgccaaaaaagatatgattaaattaattgtttgtaacttttttttaaacatagatattctcttatttttcatatttctcatatgatttccttattcatactttgtgctttcgaatgacaccaaaaaacataggattttgttcaaacatgaacaaaacttattgcataaacccagctaatgaatggtacggtaaaaaattctctgtcaaattcttccattaaatttcgttttttactcctcctaatcttaaagtgtcatttgctcgtttgaccattttcatgccaattgcagaaatatgttccattggtccagctgtaagtgatggcgacgatgagcttactgccgactcgcatccggcactcctgcagcaggcaaaagcagctcttatcacggatgcataaaaccaccaaaaataggggatgggnggggggggggggaataaacgagcgaggaaatttctgtaatttttggctaacttttttttctccaccaacgcatatacccactgc

SEQ ID NO: 28773 - DNA, 1145 bp, Heterodera glycines
  misc_feature (16)..(16): n is a, c, g, or t
cgtccgtatagccacngtatgggttgaaaaaccacgacaaaataacaccactgaacagaattggcttagtgaacatggcaactgcaaagccataacaaattggcacagcaaataaacatcgcaatttattgccttgaaaatatttgaaaaatttttttcatataacccgaaagattaagcggaatttgaacaaattaaatgatttattaaataaataattgtatttaaatataattattatcaatgaaatgctgtatatgataaaactttaccactgaaaatggcatgtgtcggaactctgggattccgactgccgatcaattgatcagcagaattgaagaaaggaagtggcgacccttccccctccctttcacatgcgtcacaccccgttccactcctctgcccccatttccctccaaattgttaattgtttttctgcgttccttccatgctccgcgcacaattaatgaccaatttgtcaaaaccgcaacttttctgccgccgtccccaattcggcgaatgagactccaaagaacgatgaacccccaaatttcccgttttccgcccattttgttcatctgttcattttgtcccccgtttttcatttcgtgcccaattttcggcccattttcgttctgctcacatttgccactttttatttaaatttattgttatttaagcggccaaaaatgtcccccaatttcacaaccaaatttcatttggcaattttgccgtttctctccccgcccctccatttgcctttaactgtgatggcccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatccttaatcccccggtgatggcattttatctgtgatcaattttgtgatattttgttcaccatttttaaattttcgtttaattacccaagtttgaggtcatttcccggaataaattttttattaattctgtgtctcgtccctgcctgcccctgaaccccgcaccgtggaattcatttggcccga

SEQ ID NO: 28774 - DNA, 1109 bp, Heterodera glycines
gaccctatactactactaatatatttaatttcctcttctcaatcacaaattaaataacaaaaaataaataaaatcttagaaatattcacctgccaaaaacctacgaatttaactcaacggggaaacacagcatgaaatagaaaaataacaatttaaaacataaaaggaataaaattaaaaatcaaaattaattaaattgcgcaaacattaattcattcatatacattataaacacttagtcaaattaactttaaaaaaatgaaatcattatggaataaacaaactactaaaaattaatataaattatattacatatctaaatgaattaacttaaaaagagttgaaatattatctactaaagcactaaaatttaactttgccaattccaagtgaaattttatttagatgttccttcctcagcttgctcgtggacctttcctaaaataatttagatattttattttataaattgtttcgccttttttatcataaaactcattccgtttattggtttccaatctgcggaggggtgtggtccatatcacttgcatcataaatgatggttttttcgctgccagtgtgattcagcctcatcctttcgtcagtttaatagattggcagttcgcatatttatgattatatagctagctaccaaataaagcaaaattcatatcattattttttccagaatcaaactttagagtggcagttcgcagcttccaatattaattttttcccagaatcagcctgaccggttattatgaagtgtgggataatacttctgtaagtatgtaacatcatacgatgaaagggtttatgtttagagttttatatttataaattttgaaactccacaaactccaccacttcattccctctctttcagcacgttcatacttttatgcatagaggagggagcattatggcgaggtttgcctaaaatcaagctcccgagacagcgaccttttggtcagagtcggccgcgaccccacccattgaaattgcgtcctcggcctcggcctccgccaccgcctccgcctccgccaccgcctccgcctgcgcctccgcctccgcctccgcctccgcctccacctccgcctccgcctccg

SEQ ID NO: 28775 - DNA, 1224 bp, Heterodera glycines
tcaattcctcaattgtcgcccctggcccagccgaaactcccatttttcctccaacgactgcattagcacagtgtccgtccacaaatggcccgcacttttcgacgcaaatgggggaagttcactgccatcagactaaatgacaatcatttaaacagttagtttcagtccttttaccatttccgcttcgtctgtcttttgtccattgccattccccgtggacgtcgacgcgcctccattgcttaacggtcctttgcgtttgggcacgacttttaatcgcgcatttaaaactctgtcgaatgtctgttcctcgtcgtcactgacatcgctgccattccgtccattgccgacagtttgcttttctcggaaatcactcatttttgaagtcaggacatttttaaacgttgcaagttaaaaagaaaaaaggtttaaaatatcaaatggcaagccatcaacaatgtaaaagtatttaaattaaaaaaacgttataattttatttaaaaataaatgaaatgcacggtaaacatatttgaacaggatgcttgctcttttgagctaaataaagttgcaattacttacccaacaattctgtttttcggttgtcatttttaaatcattgtccgttttcggttgctttgccaattcgttcatcctttgttgtacgtattcccacacccccttctgttcacgtccttccactcatctctctgtatttgcgcctgtcttttcctctcttcctcctcttctccctcttccgtctcgtcgtattcttgcgttttgcgttggtcaattttaaacgacgatggcattggccctttgccaaaagtgccgcttttttgcatctcattgtaccattcgtcgactgtcactgtgggcacactcggataaccaaggccgaaaacgcgtttttgcgcctcggaacgcgcgataatcagaggttttaaacgggtagctgaaaaacaacccgaaagattgaaaaatggtaattgcactaacgttcagcaaatcgaacatcttttgaagtgctggccgaatcggaatgtgacgacggatgcgaattccgggtttcgaattgttcgaccattttcaattcttctgaaaaaaagatttacccaatttaacgatgggaaagaaagagaaaagcctttgaccttcaatcatttccagttccttcacagatcgaacgtgaggaaacgcaaaagtgcgaaaatcagttcacgctaatca

SEQ ID NO: 28776 - DNA, 2409 bp, Heterodera glycines
  misc_feature (2386)..(2386): n is a, c, g, or t
ttgaaaaaacgtctatctctttttctgctcaacactcctttgaattccaaccacattttcggaatagtagcgacgaccctaatttttctggattttctttctgggcgagtttggctctgaaaattttgaaaaaacgtctatctctttttctgctcaacactcacatgaattccaaccacattttcggaataatagcgacgaccctaatttttctggattttctttctgggcgagtttggctctgaaaattttgaaaaaacgtctatctctttttctgctcaacactcacatgaattccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctccgaaaattttgaaaaaacgtctatctcttttctgctcaacactcaaatgaactccaaccacattttcggaataatagcgacgaccctaatttttctggattttctttctgggcgagtttggctctgaaaattttgaaaaaacgtctatctctttttctgctcaacactcacatgaattccaaccacattttcggaataatagcgacgaccctaatttttctggattttctttctgggcgagtttggctctgaaaattttgaaaaaacgtctatctctttttctgctcaacactcaaatgaattccaaccacattttcggaataaaagcgacgaccctaatttttctggattttcttctgggcgagtttggctctgaaaattttgaaaaacgtctatctctttttctgctcaacactcaaatgaactccaaccctcattttggaaaaaaagagcacgaccctaattttttttggttttttttttttggggggagggtttgttttcaaaaaatttttaaaaaaaaaaaatatttttttttttttggccccccccacaaaaaaatccccccccttttttttgaaaaaaaaagagccccccccttttttttttttttttttttttttgggggggggggtggtctaaaaaaaatataaaaaaaaaaatttttttttctttttcttttctcccccacaaaaaaaaaaaccccccccccttttttttaagaaggaggggcgccccccccccccttttttttttgtttttttttctttttttgggggggagggtgggggtcgtaataataaaaaaaaaaaaaaaaaaaatttttttttttttttttgtttccccccaaaagaaagacacccccaccccccctttttagaaaagaaaaacacccaccccccctttttttttttttttttttttgtttgggggggggggggggggggaaaaaaaaaaaaaaaaaaaaaaaaaattttttttttttttttttatatttatttttttttttttaaaaaaaaaaaaaaatattttttttttttttgggtgggggggggggggggggggggcacccccaccacttttttttatttttttttttttaaaaaaaaaaaaaaaagggggggggggggggcccacaaccccccccccctctttttttaataataaaaaaaaaaaaactttttttttttttctccccccccactattattttttttttttttttttttgaagaaaaaagaaaaaaaatatttatattattatttttttttgttggcggggcgggggaagagagattttttttaaaaaaaaaaaaaatttttttataaaaaaaaaaaacaaaaaaccatttttttataagagagggggagggggccccccccctttttttcgcggagaaaaccccaaataatattttttttttttttttattccccccccttaaaaaccaaaaaaaaaaatttttttttaaaaaacaaaaatttttacgggggcaaagaaaattttgcggcttttacccaaaaacaatttttttgtggaaaaatttaaaaaaaatttttttaaaaaatttgggagactcctccccccccaattttcaaattgctttcattcaacccattccttttcccttgaaccattttatcaatttgcagtgaaaatttgtttgccaaaggcacacaaattttcgggtgaataaaaattaaaattttcaaaaaataaattattaaatttaagacacttccaccgttgccatggcagggcgaaagggtccaagagttggtccaaaaagatggctttttttcgactgaaaaaccaatgtatcgcattttggaccaagtttgtctgccggattgttcaaatcaattcctggcatagaagcaatatgtccagatgnataaggtttattattaataaacg

SEQ ID NO: 28777 - DNA, 1443 bp, Heterodera glycines
gttttttatgttaataaattttattttttagttaagtaaatttaagtaagattttttgctgttttttgaatggattaaattaaaatatatgtttttttctatatctttaatttttgcagcaaattaatgtaaaattttttagctgttttgaattgattgaaaaaatttttatttttttctcgcatatgttccatttttgatttttgcaatttaaaaaaaatgatttttttctagaaaatttgtcatttttgacctaaatgctggcaaaaagatattaaacacatttttctccgtcgttaaaaattagaaaagtaaaagttgtatttactgcataatcactagggctgggaatttaaatcaaatgacttttttgttgcttctattatatggccttaaaatgaattaaaaagatatatatactggctcccggacatttggatatgtggcgtcgaagctgtacattttttggacttttttctacatactttgttttttctttattttgataatattttttatttatattataatgaattttctagctgcatctgaaacatttgatgtttccgccaatgcttggcagttcccaaccaatccgtgttgttggtttatcttgatctggtttttattttgcttgattccctagaatttttccatccttaagtcgcttgatcgcatacctttaagtcactgtattctccatttgctttgtcttgccgaggcaataatttaattttatttctttgctttatttatttatttttcttttgtttttgttttgcccattttataaatgtattattattaatcttgtgcaagacgtgttcttcctcgcgatgtgtgtgaagcgaatgcatatgctaaatttttggtattctattgttaattaccaattcttttatttttaaataatttttcgcttttatgttaattttataattattggtcaaacacctgaaatttttatatgcaattaattatataataattattttctgcatccatctgttgtattcaattaagattttataatttttgcatttttgtttttgatatttttgtttcagacttttttatttaggcttctaaaatgaattaatttttaacataacaataaattctttattaatatttgttaataatagtcaaaggtttaaaagattgaatcaaagaaaaaaattatgtgttttttgtttgtatattttacttttttgctgatagttttttatactaaagtgttttggttgattttgatttactttcttttaatttcttgttctagggatcagacttagagggtctcggttgtttcatgtactgcttattattgggataaattatttgagtgtactaatttgttaatttatataacgatggcaacttttatcaagaacgaacgacgaaaggtatgaatacaaccacaaacccataaaagaaaagtgg

SEQ ID NO: 28778 - DNA, 1003 bp, Heterodera glycines
  misc_feature (72)..(72): n is a, c, g, or t
  misc_feature (79)..(79): n is a, c, g, or t
  misc_feature (115)..(115): n is a, c, g, or t
  misc_feature (121)..(121): n is a, c, g, or t
  misc_feature (135)..(135): n is a, c, g, or t
  misc_feature (171)..(171): n is a, c, g, or t
  misc_feature (197)..(197): n is a, c, g, or t
  misc_feature (208)..(208): n is a, c, g, or t
tatgattttgatcgctcactttccggcaattcatggcgtaaatgcgttgaatttcacacttttggcatcacntgcactntgtgtttttattttcaacggcgtgtgggcgtgtganaataantcagatactgtatncattgcaaattaggacacccttttctatacaaaaanctgggtttacggtcatacagcgacgnccatcgccttnatagaaagtgcccataaaatcagttcgttaaaagagagaactgcactttattctcatattagccgtcagatgcccgacttagcttcaaaacagttaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccttttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaaattttgat

SEQ ID NO: 28779 - DNA, 401 bp, Heterodera glycines
ttaaaaacgggcgcaaagcgcccgtcttgaggccgcgaagcggccgaatgtccccaaaaaaattaaaaaacgggcgcgaagcgcccgttatgaggccgcgaagcggccgaatgttcttaaaaaacgggcgcaaagcgcccgtcatgaggccgcgaagcggccgaatgtccccaaaaaaattaaaaaacgggcgcgaagcgcccgtcctgaggcttaacagccggccgcgaagcggccgaatgatcccataaaattatgaaatgggcgcgaagcgctcgtcctgaggccgcgaagcggccgaatgttcttaaaaaacgggcgcgaagcgatcgtcatgaggccgcgaagcggccgaatgtccccaaaaatattaaaatacggatgcggagcgcccggcctga

SEQ ID NO: 28780 - DNA, 1359 bp, Heterodera glycines
ttcgatagagcttaaaaagctctacaattttgctctacggtcatttttggctaaaaccaacccctgacgagttatgggcccgggactcaaatgtcccgctcaggccaaaaattttttctatttctggaaaaaaatcgaaaattttccaaaaaaattaccaatcgatagagctcgaaaaactatgttttggaagtggtcttcgtttttctgggaaaattcgttaaaaaatcataaaattaaaaaacccgaaaaccgttttttaggcctaactcgaaaaattttgaaaattttcgaattttttaaatttggaaaaatcgggctttcaaaactctacaataagtctgctggtaactccccgcccagatcaaaccctaatgagttattcgcctggtactgaagtgggaaaaaaaaattaactgagtctccgtgtctgtacaggtcagggatttggtctgatcaaaaaataaaaaatactggattatagaggacacttctgcggagtgccctcacagcgggaattttttgatccgagtttcagaaaaaaagttatgggccgtcaaacgcacgaaaaaatgagaaatccgtccctgggactcagtcgtccgcgctgaatttttttctatagttttcccagatgcgcctcaaaaagttgtaagacccttccactcctttcagggcgctcccggccttcggccgggagattttgttttttgaaacgaaactccttgtcaatataacatatatagtaaaattcaattcccttcgaaattgaagccagaatgcttatttgaagctacgcaaatataaattaatatttgctataagaactgactatttagtcaacagaaaataaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccagattggaatttgtcatttcctgcaataaatgttttcatataaaggtttaaaaaattcgatcgggtttagaaacgttcaacaaatgcatagataaattttttgaatattatacaatcgtgctttttgctctctatcaatttattataaaaaaattcaattcccttcgaaattgaagccagaatgcttatttgaagctacgcaaatataaattaatatttgctataagaactgactatttagtcaacagaaaataaataaatcataaaattagaacaaaaaatgattttattttagaatgcacgctgaagatgcataataagctaatatattcgaatttatt

SEQ ID NO: 28781 - DNA, 1301 bp, Heterodera glycines
ttttgatcggcaatcaaatcactgacacagcaattgattctggcacattcttcacacatctcgagtccaatcgccactcgcccatcttccagccgacgtgccttgtctatagtgtagaaaagttgaacagaaatttgaaattgttatactattattaatattcaattaaaaaatattgctttaaataattatgtatgaaatttgctctgtgatgccataggaacggagtgtgggagaaagtgggataaaggacctgacaaaagaaggggcggcaaatgacagtggaatttccaaatgaaacttggtgagtagattaagcatccatgggttctattgaaaaatttaaccattgaaatgggcatgcgtgccaaggaatgactagctaaagttttttaaggaacaaacaaattaaacaataagttatgttagtggtgtagaggtaatgcgttagtcatcgttctttaagccacaggttcgaacccactatatgcaaattcatttttcaattttttatttttgcttttttatgcaaagtcaataatcaaaaaattgtttataaaacaaaattttattttcattcttatacataagatacttaataaaatattattcaaaaatattttgaaaaaatcgacaggaattattgcatcattatgcttaatataatgtatttgtgattaataaaattaaaaataaataatttgtttttttaaatatatttcttagataagactttgtataacttaaaaaagatttgacgaacgcactacctctacaccaatggcttcttataaaaacagaaatattatattttctctaattataaaatgctaaaaaacttggcacttcatatctcggcatagaagcaaatttggcaacaatgattaaaatttaataatagaacttgtgatgatctatctaaaaccaagtttcatttgaaaattccacagtcacttgccgaccagggatgtgcctaggtttcgcttttcgcctttcgcattattctcatttttggcgtttctcatttcgctttttggcgcgaaaagtgacttttacacccctaagaattggattaaattcccataaaatttttcaaaattttacctataaattggctaattctcagtgaaaacctgtttataaatgatcaaaatttccaattttttccccggcggctcctatcggcaccgccgcgcccccaaaactcctattttttcttagaaaatggcccaaaatcgcaaaatttggtaatttgatgaaaaactgttctcagcggcgccccaaaactcttatttctcatt

SEQ ID NO: 28782 - DNA, 1947 bp, Heterodera glycines
ttccaaacgattaagggaaaggaagcggaaagtgagaaatggaaaagaaagggcggatttaacaaatcttggcccaatcaaagcattgcttttccaaatatttcaatttcttcccaattccccccccccctttcggtccctcccttttctttccctttccttgcctttttcagccgcccctttcctcatttgccctcgtcgatcacttcgccccccgggggagggattaaaatttaatgggtgaatggaaagacaaaggaagagaaatgaaaatttaataaaataataaataatcaattgggaaagggcccggagatggaatattcaattggacaacggaagttaggaatatccgccggagacttttagggcggctgaactgtgtgtaattcgaggtgagaaaggcaaaagaggggagaaaaggaggggaaaggggagggagtcgagactctcgacgcagggagtgccaatgaattattaggggaaaagcggtcgacggaaaacagcagtggaatattgtatgcggtggctcagccaatgtgtgcccggggaaggccccgcccatggagccaacccggcgaatacggcacatccgtcggttgtcgtcggaaaccggcaaaaccgacgaaggaaggcagaataatgaatgagcccagccgatgggatggcgcagatgatggaggtgggagggaaagagtggagggaaggacgggggaggcaaatgtaaaattcataaggggggggggacggcacaggggccggccgaatcaccaaacaaaacccaagggacgggagaggtaaagccaacggcgagaaaggcattggttctccggaagaaggccaagggcgactaaaagctttgatttttcgtaatcatttattttcttcccatcttttcccttctcttttcgccgtttccttttcatccccattttccgtcttaatgtcctttttctgcccattttcgtcaatttgcacgcaattggaagtcggaaaggatggcactcatttcttgtcaaatgccgcaagggttgattcaacatacagagatttcttgagggggcggcgggggcggagggtctttcgcccgatcatttttcccgtttttcttcccctgatcacttttttacaattttttttgtccttgatcattttttccatttccattttattttcccttccttctcccaatttccgttgtcatggacatttttgggatttttctttcatgaaaagcttccactgagtgacaaaggaaattggactcaattgggcgcgggtcattcggtggccttttgtttcgggcgactattgtttgtcccttcgggggatttaccgccacgcaaaggcaaacggacggactaatttaatgcaaatattggcaatctgttgaaagagtggacagcagaagaagaacagatcgaagacagacaatggaagaaagggatttactcaaacattcaaatccaaaataatatttaaatggactcgaaatgagtttggcataataatcccttgtcgccacaatgtttcccaattccctctcccccccccccttttctctccatccaattttgcttatcgccgaccattgccataattctcatcactttcgacggcattggctgaatgaactcattgtggcggaagattcgtcgtcctgcaactcatccgattgtggcacgacgcgaaaacaattcattcatcggagagagtggcacagaatgggcgcaaagggaaaaagggacggacggaaaaagggacggacggcacgggaaaagggccgggggcgaagttggcaaaaaaaagggggcgggggggagggaatatgaggaaaatgagagaaaatggaaattccaatggaaatccattgattaaaatggcataaattgactttataaacaattcaagtaagctttaattccacttaagagatggttgcgtttc

SEQ ID NO: 28783 - DNA, 2054 bp, Heterodera glycines
ccttgcgcgttggttaattgagttacagaattacaatattaaaataattcatgtagcggggaagcagaaccaagaatggttcatgagcattttcttttaaccatcactgctcgtgatatagaaggaaaaacattcgccattgatgttcggaaagaacaaaatgacgattctgagattaggaaattaattgaatttgtaaattttggttcattccctgaggggaccacagaagttgaaaaggaagatattgcatcaagagcggaaaatttgagtctttcctcaggcatattataccaacacttaccagatcaaaatgctcgaatgtacattccgctttctcttcgtccactaatttttgaagcttttcatacttcacaaataaatggtggtcatatgaacatcaaaaagacattagggaaatgtagaaaattttattggccaatgatgcaccgcgacatcacaaattggacaagacaatgcatcacatgtcaactaagacattcacccaatccttcatatcgtgcagaaatgcaaatgccaccaaaaaatactctcttcgctcaaattgcacttgatttggcaggtcctcttcccctcacgcagaaaggtaacaaacacatccttaacataatttgcacatttaccaaatatgtaatctctgtacctatccctgatgctaaatcccaaacaatagcactagctagcattctttaaacactgttatttaaagtttggaggctgtacgagtcttctaactgataatgccacggcattcacctctgatttctttaagtccttctgttcgcttctctatattaataaatgttatgctattccccattggagccaaggcaatgcagtagttgagcgatcttttaggacatttcacaatatacttgcgaaatatatttcaagtgaagaaccagattttgatgaatttcttgaatgtgccaatttctgctacaacacatcaattcactcttccacaaaggagacccccttctttttggtctttgggcgagacccgatattttgcattgagcaaattctgaatcccaacaccgaacccgaaaacaccagtgaagttgacaatgtcaagcagaaattagttaagtctcttagaaaagcttgggaatccgctgcggcggtcattaaagaagctcagttacggtcaaaagtacaatatgacaagttagtacgaaatcaaactgttcaaataggagatagggtcctattacgcaattacgcaggaaaagtcaaaacatccaagaaatttcaattaccctggaagggactttatcgagtcattgagattaatgatgtccttatcacaatcgtcagctgcacatctcctcaaaggcgcaaaagcgcccccccagagccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttgga

SEQ ID NO: 28784 - DNA, 1684 bp, Heterodera glycines
ccctgaaaagctcatctgttgagaccgctgaatgtacctagagtggtgattcccacaggcaagccggccattccatttaatttcgcctaagtataatgcgaatttaatcttttaattatctttaaagttttttgaatgccattaattttattgaatgtactaattatacgtttgtcatattagttcatcgtattgaaattaatgaaatattcaaattatcgaattattaaataaattacgtttttagccttatcaaaagaatcaatgaaataaagatacggagccctgtttcgtaatcagcatccttaaaaaccaccagcacacagccctgaagtgatggcttgtttggcccataataataacaatttcttaatattttcgaatttttctcactgctttataattattttggtgtgtttaaatattaaatcaatcagcataattatatttaaataattaaaatacaaaataacaaaatataaaatgctagtattacaaagaaatccttttttttaaataacaacaaattttgaaaataaagataattattgtaaaaggctaaatttaatatgaaaaaatatatatttaaagtctttcaacaatattttgatttttccgaactggtaagatgacaggtaataaattgaaaaataacccagtttagcaatatacacaaaaaaattaattattattaaaacattgtaataaaaaattagaaaaataaattttgaattaaaaaaaaaaaaatttttataaatacattatatatttaaaatatttgtacagggtgacaaatatgtaatgtcccacttatttatttgaataacttttttcaaatgcaaccaaaaatgacaaaaatatattcaaaatgtgcacaacaaattagggaatatagctacataatagttttatcgtatctttagagagtcctgagatagagacaaaaacgtgccaaaatttttttacagttggcacgcaactcctttggtcattttccggagaaaggtttaacgaaaagaaactatttttgcatgagaattaatgaaggccctggccacttttcgcgccgcaggcgccgctttttcgccttttttaaattgctggtgtaatagcttatgtgcgtgctccttattagcgttcattttttttgctataaaaaatttgcaaattgagatatgaacaaaatcaatatactattttgtagacaacaattagcttaacaaaacggtatataaaacattttattatgttaacaacaaaattttttataagccattataaaaaagcgcccttttttatgcaacgacctagtatatatatatagaaacaaacaaaaaatttcgataaaaatcaaagcaaaaatgtttatcaaataattttgtaataaaatacaaagatgatgcttttaacaactgttgtgtccccacgagtttcaggcaaatgcacttttctcagttctgacaacttttcctaatttgacccaattcaatctctttttttcgaccttttttctttttttttttgaggttttattaaagcaaagcaaaatcgtttaagagtaagaataagcaaaattggttatagcaaaattggttaagagtaaggaaagggagagtaagtaggaagggagaatggcagtattaaaaggtgttttccaaagcagaaagagagcttaaatacggca

SEQ ID NO: 28785 - DNA, 1568 bp, Heterodera glycines
cccgtaaccctaatttaatatacaattttgaatgaagtaaacaataagaggctactgaaaaattgaaaaactctcgcctctcgtcctctcgctaactctcgtgttttttgggtctctcgccttcgtcttttctgagacaagtcacacccctgccacagacttaattataaccaaattatttgttcacattaattttaggcttttcttttttcttactttatttcttaaacaacaaatcaatcaatggaattctccacaaaaatttaaaatcagggtactaattttaattgccgaatatcaatcatcaagaaaagattcgctggcgttgaaattataagcaaatctcggcccaaagttcgcctcgattatgtctcctggaagatacaggaagacaacagggagcagatcagtgtcagttacgaacaaatttgaagtatctataaaaatgaaaaatcaaaaaaaaacaatactgtttaaaataaaaaatagaaaatttaaaaatcttgcagcgctactaagtctctgatttaaaacactttagaagtcatgtaataaatatattttatgagtttaaaatagagaccggtaaaatcaaattagcggatcttaaaaatgaaaaaataaataaatttaatgaataaaaagtgcctaaaaaataattattatgtaatggtgtgtttctatcttttaaattaactcaaaaaattaaacttggaaatcaaataaataagatttaatgtgacaattgtgttttaaatagcttgatttcttttaaaacgaaattaatgaatagagtcatcatttttctttccaatttttcacgatattctctgaattttttcactaagtttattttatttttactcactcaatttctgcccatttttggtgtaaatgatttccatcgatgttaaattggccccacatccgattgtgtcgccctcttcaaacgagggatatccccagaagccattcacattgtgcccaaaaatgaagccattgtccccatacatgtaaaggctttttccaaaaagtccaattccgatcgatcttaaaagtttttataaatcatgaaaattttaaatttattttaaaacgattaaaattaaataaaattgttatttgattccttcgattacttacgagcttccttcaatatttagttgctttcttataattttcgtctcataaaacacaacttcaaaatatgggagaagcacagattccgcaattaattcccggcgccgcccttaaaatatgccgcttaaaaatgccaaatcaaaaggcataaaaggtcgaatgaatttgttaaaaagtgtttaatgaaatttaaaaaaagtttaaggcaaaatgacttaattaattgaaaaggcaacaaattatgcaaaaattttcaaaaaactttctcaatgttaaagtatcaaagaatcttctatttttagttttattatacaaagaatttgtgcaattttagcctaagcaatgaaagagttacattattagcattagtatatttttatactctgaaacgtagtaataaaaaataaataaataattaatttctttta

SEQ ID NO: 28786 - DNA, 1051 bp, Heterodera glycines
catatttttagaagattttcattaaaaaattattaattttgtgattttttggaaaaaaatgggttcttttctggtttttataaaaaaattagcaaaatttttggaaattttgggtgagattttcgtattgatgctctacatattaaaaacccaaattattaaatatttgtaaaacattttgccaatttattaaaattttaaaagattctgaggcccaaaagcctcaaaaatcctcaaaatttctcaaaaagccacaaaaatcctcattttccaaaaaaatcctcattgacctatcaaaaagccacaaattgtttcagttgtgacacaaaatccacggggtccatcagacctctgccgccgcttcgccgtttattgccccaggggttggagccctggcatatgaaaaggccttctattgtattcaaactcgtacattaataaactcctccatttctgttcttctgaagttaaacataagtttaatttttcaaagacttggatttaaattttcaaaaatttaaagataattacagtttccgaagtaaatttgctcgctgctggcaaaaacattagaatttggatggtgaatcaaattttttgcagtgtagaaattggacataaatgataaattggacatcgatttaatttcttttttaattatgtcgctgttcaacatttaccagtggcaattagcaatgtttattttgaattatatgaataaatttgctaaaagtttttatacggcattttaaatatttttttaatcaccatttttctttggtgggttttaaatttcatattatgtccactatttggtatgtctaaacgctcaaatggaccccctaaataattcgattttttgcaaaaattcgataaatcatcataactatttttggaaccgaaaaatttttatgattgatatcattcaatagccctaataattcttaatcaaaatggataattttaaaaaaattggcaacgccggagccttaaaattccctttattttgtaaattgaaaaaccgcgaaagtactaagaactgacaaattta

SEQ ID NO: 28787 - DNA, 1432 bp, Heterodera glycines
aaactttgagaattgctaacgggtagcggctatcttccggacatttccattcgacttcttcgttcaacacatgcacagttgggtgaccaatcgggtagcgtgtagtaaaattaacgaaggggtagagagaagtgaagtcgaagtaagaaatttgttcattcggtcccgctttatggagtagtttcagtggtcccgtccttcctcccataaatgatgtgcgtattgtcagcggaccatcatccatgtagtcttcaaatttctctctcatttctttgtccttcgttaacattttctcgatctcgcactcccaatacacttccagctggccaacttgacttcgtatgaattctaatcgtttggcattcctctcccgcactttaccagctgtctttccatttggcatcatcatattatcgtctggataacactcactgcatgcatgccaaacacatccgttaacttctattgcctttctctctgcttccacccatccatccacagaatattgaccaaactttttctctcctccgggtgaattagccatcctcacttccacattatgttcttccgtgtaccactgtaagaaacggcgggccagtctactttgattttgtgcattgtcatagcctcgttccgggacaattgccaagtgttcagctggaaggtggttgatccggaaatgcttcatacaggcgccggcgatcgtcatacactccctcaatacatcaattccttcgtgtgccctttccgctacaatgccttcttccctccgagacacatcaaagaattccatccgaaacgctaccagcgctgccgttaaaatttcaacgtcgtttgtgcagtagctggccaatgcttcgtcaaggaggaagggtttatgctgatgttgttcataccagacgttgaatttttgtcgtttatccggcatcatcccatcggccaagtagtcttcaggcgtggggtatatctgctttccgtagttatccggttggtttgccatgtgcgggaagaatggtttgtcttcgacgtccaagccgaaggatgtgacgagttcagccaaagagcagggcatcaaattatacgagtctcggaacaccacgtttggattgcgtttcttctgcttgcccactttcatttcatacagcttattgcccttcctcaacatgctcggattgaatcctcgccggaaaagttcacggaaaaccaacaccatatcgaagcggccaccaaagtgcgaataaacataagtgtcgtacttcagcgggagttggaagactacccaatcgacaaattcctccacaggattgtctgcgaccacttgcttgtcgactgttgtttctgtgaagcggcgttgccaaaaggcgaccgttctgtttggcccgcacacctcacaccctcccgatgcctctcgccagctctcattctcgatgca

SEQ ID NO: 28788 - DNA, 831 bp, Heterodera glycines
atttttggatgtttttgagagcaaaaagcatacattcttgaggaaaaaaatctataaaaatagtcaaaaattaattaaaacgcatttattaattattgcctcaccaggcccacggctggtcaccacgtttttgtgcacgcacactttgtgctggtcagagtacgcgtagccggcgtcagtgattgtcttctgcaaaaggaaaatgatttattttactgaaattttaaaaattttagattttaaaaatattaaaaaaatcccctgtttttgatatccggcgatggcgagcaaaaatgattgtctatgtgccaaaagttgcaaattttaaaagtctgtctccacaaaagcacttcgtgtattacacaataaatccatgcaaatgggtccaaaatttgaaaacgctcgttggcgcgcgcctgtctggggtaacactgcagaattgtggtcccgccggaaaataaagttaaaaattttattttgcttttctctggggtgaatatatgtgttgatttacatatccaaagtatatattaaactagatctattatacttgtgttagattctttattaagcttcctattctattatattttttctagattactattgctgaatctctgaactatacaaagtttatttaatcattttgatttaggattgtttatattatataaaaatgctatacaaaatcatttattgtatttttttattccttataaattttaagactttgggttgagttcggtggtattggaaaggaacagctgatcagctgattgcacatgactcgaagtagtttagtttacattgatgttgataggaaataaattc

SEQ ID NO: 28789 - DNA, 1038 bp, Heterodera glycines
ccccccccccccccctttatatatgtaaagtgggggggggggtggggaaaggcgcataaggggcggaaactgcaggaataaagcatataaatagctgaaccgctgaagatgggacggctatgaatgacggagaaatggccaagagaaagagagggggagagggaaataaaagagggaggagagacaatgccagatggtggagagacaaaagtgggagagagagaaagagggggaaagagttgacattttatgggaaagcaatgagaaaagcgaaatagttttcgagaaagagagagagagagcgaagtgcgggtggaagagaaatttaaaaattattggccatcggcggagggatcaatgaaatatttagcggaaaacggggacgacacatggggacactttttttgttaacaacttagccaatgggctgcttcaaatcggatatgagaaatatgattagaagacggagggaaattgaaaatgattgaggcgcttttcggattcaaaggatcaatcaatgggccaaaagataaaaaattataacgggggaaaagcggctaatattaaaaaggcaataagtgtaattatttaaaatctttaaaaaaatctatttaataaaattggtggtttgtaataatttccaaatgtccgaataaatttgcccaccattttgagcaaaagcagcggaaagtcacagatttttctgatcagtgaaactcaaatgaaaagatttggacgaaagagaagtaaaaaaaaaaagaagaaaagaattatatttttaaagcaaataaatcctaaccgccggcgccaattgatcaatctgatcagaaaaagaaaggacaaaaaacaaaacaaaaaactgttgcaaaaagcagcaaagaaaattaatgattagcgggagagggacagaaggccaaaaaacaaatcattaataaataaaatggaaaagtaaaaaaaaaagaaatgggaaaagaccaattttatataaaaatggtcaaaatgacataaaattcaaaaaatgatcacaaaaatgaaaaa

SEQ ID NO: 28790 - DNA, 1063 bp, Heterodera glycines
gttcggggttcggaattgatcgaaatgcttgccggattcgtgatgagcgaccccgaaaaccccccgaaacatgttttcatgatttttgaaattaaaaaagaaaattcgaaaaatgttcgaattcgggttcgggattggaaataggacgaaatggaggtcggattcgtgctcagcgcctcaaaacacccctagaaacattttataagaattttcagaaaaaatttaaaaaaaaaattttcgggaccaatgatcgacatgattgccggcttggtctaggcctatgcttcagcttaggcttaatattttgaattttgtccgtgttcgggattttgaattcccaccctgctttttagacttagctcaacaagagctttaaaatgataccaaatttgtctgaattatccgttttaaatggttaggagaccccttttttacctcaattttaaatttccacataacgaatttttaggaataaaatgatttttaaatataaaaatattttttattccatattatttttcagaaaatagaaattcagtattcacttcatagtttgatccgaatttttaataaatttccacataaagaatttttaggaattgagtcggaaatgacattgatatgtatgtatgaacaaaaaacaaaggatttgaaggggccaatactattgaaaaggaggaagtggaatgcaatgatgagacgaaagagggtgaatattctcggtttttatttgatcatcataatcttcgcccatcagcttcttcccttcgtttagccttgacactgatacacctaaaagtaaagttgagcgggaccgggggcctgacacggacaactgagtaccgaaatcccggtcacggtttacattttcaaattacttattgttttcctaaaaaaaatttgccatttttttgggaaaatttggctaaaaaacagaacaaaatttgaagaatttccccgggggggcccatcgggattctcggccccctcccctattcttaaactttttttaaaaaagcaaaggtacttttcccattttgccccccccttgaaaattaatttt

SEQ ID NO: 28791 - DNA, 973 bp, Heterodera glycines
tccggcggtgccgataggcgtcgccgaaagtttttcggaattttaggaattttaaattaattttattaagaaaattgtacaaattaaaaaattttcaagagtccccaattccccgagttagtgtcggggggtcgggggataaaaagtcggaggtagggggctcggggtcggggagcaaccctattataaacccccaaaataggtgctaaaaatggaaatgagataaatattttaaaaatcaaaaatgtagtcaagcaaataaataaataaattttgaatatgaatttttgataaaattttccatttctcaggggtgtatttttcgtttttcttgcatttttgttaataatttttttcaaaatagcagaaaatattttacaaaaaattcttcaaaatgaaaaagagcacaaaaaagcaataaatttattattattaacaggttatatcgccccaatttgattcggtttttttttccgtttttcataaaagtcggtcggttgtttcggttttttgattatttcagtcggtccgtttcggttaaaaaaccaaaaaaaccgaaccgaaaaaaaccgaaaagtcaaaaatttctcggtcggttttttcggtcaaaaaatattttagcacatattttgccatattttttgatttttttagcacatgttttattagatatttcaggatttttagcacataaaaatcccagctttatccattaaaaaggcccagatatcaggaagctgatgagcgagtactgagaaaagttcagaaatgagtcagcattggagtatttttgtgttgcttacaaattagtgcataaattttacgagttccatttttttgattttcatttcatttttgactagcaatttctattttttattattttcatattccttcttttggcctttttcataagctttttaaatcaagaaattataatttttctctttttttttgtatgatttatcggcga

SEQ ID NO: 28792 - DNA, 1371 bp, Heterodera glycines
tcaaaagtaaaatctgatcacgtattcgtgatcagcgttataaaatacccctaaagacatgtgtttggaatattttcggtgaaaaaatttttccacccaaaaatcctggtcacccccctatggtcccgaaaccaaaaatcacttttatttttataacaattcgcaaaaaagagataaaaatgtaaaataaaatttatattatagagaaaaaaattgcgaatttttgtagtattttacttttacagaatgacttttcagaagggagttctgaatttttttctgaaaaatctaaaatttccagaatttctggaataactttttttctttagaagatagaaatcccaaataaatcccataaaattctcccgattttttgctatttttaaagctttaattcacttaaattgaccggtcctccattgagttatgaattttcaaattttagcccaaaatcctgagggtcaaaaaattgccaaatatttttgaatttttaaaaaattctaaaatttcctaaactgaaaattaacatcagattcgtgctcagcatatcaaaataccccagaaaaatatttttgacccccattttcaacccaaaaaaaattttcgaaaatttctagggggcctagctcgaaaatttttgaaaatttccggcaatatggcacatcattcgatagagcttaaaaaactctacaattttgctctaaggagttttttcgataaaaccaacccctaacgagttatggacccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaacttggtttgatagcctttcaaatactacacatttttgctcagaaacaatttttcggtcaaagcaacccctggcgagttattcgcctggtactgaagtgtactttttgagcacacttcagttagccaagcgtgcaggccagggggtggctctaataaaaaaataaaaaataccagcatgtagaggacagttgtggggagtgccctcacagcgggcactttttgattcgggttttagaaaaaaagttaggggccctaaactgcaagaaaaagtgaaaaatcggtccccgggactcagtcgtccgcgctgaatttttctctatagttttcccggatgctcctcaaaaagttgtaagacccttcaacgactttcatggcgctcccggccttcggccgggagaaaa

SEQ ID NO: 28793 - DNA, 925 bp, Heterodera glycines
  misc_feature (867)..(867): n is a, c, g, or t
tgcttattgatcgcttctaaacatggagagcattcgaataatatcaagtttgaagaatttggttgattttcaaaatttatcacataaaaagttttacttttttagcttattggcttcgtaaaaattcttaataaaaaagcagttaaaaaaatttataatttgatagattctttatcttcacaaaattttgctaactgttatcatttcatttaatggctatcatttataagtttttatttattttgcaaagttcctaaaaacggttttaaattgatgggcaagagtattaagtactgaattaagattcatcctattattttggcattagattaaaaattgacaaagccttaaacctcatttttaaattatatgattttatttagcatttatttagacgaacaaatttgtaatagatttatttaaatttgtatcgaaatttgataattttaattattttattgggctggagttcgatcgatcacacaaacagtttccaatgaaaaaaatcgagtgatcaccgccaccaggataaaaaatgcatttatctttctgcttttatattctttacttaggttatgcattatttttactcgcgttcgataattttttctgaatggtcaacgattttaatttttcaatctccccaattacaattccaatttttgtgttttaattatttcatttatatttatgaaacaaaaataatagaatctttgttataaatcttttattttttcttcttcttcttctctttcatatttaataaagtaaatgaaatttattttattatttatatcataacgtagttgtaaatataatttacttctcatgtttaccaacttcgtaagttatgttatgtctctattntgtgatgcagtttcctggatcatgagtaggggtggtaattatatgcacatgcatattt

SEQ ID NO: 28794 - DNA, 698 bp, Heterodera glycines
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataaatgtttgagtaccccaacggacacttgaaaaatcgatttttttgtttcataatattttttcagaagtgctctaagcgcaccaattt

SEQ ID NO: 28795 - DNA, 833 bp, Heterodera glycines
  misc_feature (823)..(823): n is a, c, g, or t
gggaaaacggaaaaagaacggggcggggatctgtcgtaattatagaatgacctcattttatttttgattttatgatattttggcgttttgttttaatgttttgtgatttcgttttttgtttgcttttgtttctcggactttaatttggaattgcctgacataaaaataataaggctttatttttgtgtgcttttaaattgtgtaagcgctgaactgttgacgtgctgctgtgtatttttgattgtttgtacgtggcgctcctgtaaaaaggtgtggtcgacgcgggttttatttgtaagctcggtaaagtaattccgtctacaaagctgattcgacagaaagggtaaagtaattcccatcgacatttcatcgtctacagaacggaaattttgtgaaattcatcagttttcttctcacagaattcgacaagtgaaattttgtgaaaaagggcgaagtaatgcctaatcttcgatcgccaccgcttacttgtcaaagagcactcaacctcggcattcgtctaaacgaaaacgcaaaaaaatggaaatcggagagaaaatcttgagagggacgttcttcaaccggtggtcagagacccgggcttagttcgtcaccaagagagagttttgaatggttttacacaaaatttcgctgaaaacccaaacgacaatcaacgacaaagagccgaacagcgtttcactgatgaaaacgaacgacaatcggctctggttagacaacgccaagcaaatctgacccattatgcgaacaacgaccgagataacaaattccgcaacaaaatacaggatttgtgggaaatcaccaaatnttttcgtccc

SEQ ID NO: 28796 - DNA, 1118 bp, Heterodera glycines
cattcaaggttggttattaaattaatttcttcgcttttcttttttcagcagaagcaactcaaatgagtggggtctggtcatttttaaccattccagtcgccaatggacaagtcctaggttcggctggatcattggaccaataccctttcctttgttcaacaaattactttcaaacaataacgaaacaccgtccgataagctaatttccatggtgactattattcttagaggtgtaaacatatgcattttaagctttgtgatgttcttaaatcgaccgttcattcgctgtacactcaaagtgcccctcttttggataccattttggattttgtggacgtcatcgtttctgcacatcctcggcccgcctgtgaacttgccaaatctctctttttggcatgtcccaaattaaacttaattaaagcgaggttttcagactttccacaaaaatcgagacgaaacgacaacaaaattaattgcccatttggctaaatggttcgctgacgaatttgcttttctccaacaactgtccactttcgacgccattgatgcggaggaaagggacgaacaattattaactcttggctattacgtgctgaagaagttttgggacaatttgttgttcgtctcctccacgctgacgacgaccaaccaattggaagctggaactttgtgctgtgccttcgtccgccacttttgtcttatcatagcaacggcaattaaattttcttactaaactcatttttttcgccaataaattgacacttttcaggtgcttcaacacagcaaaaacccttcattagtacagcttggtctccgttcgcttttccatctgttgacaaagtgtaattctgttgacgattgtccgcctctgtcagacacaattggctcagttgctggtcatttgaccagtgcggtgttcgtaatcattcgcagtgagctggtcactggcaatatcaacgttgtggcggacattttacacgcattggccagcaaatatccgaatgtgacgaggtggacgaaaaatttaagaaagggaggggaggtgggattttgaggcacaagacaaatggacatcagtaaaatggactttaatgcatttttattggatttacacccta

SEQ ID NO: 28797 - DNA, 1180 bp, Heterodera glycines
tgagcaaaaatgtataagttaatgagaaatattttcgtagtgattggcgaagcgttcagtttggatgactgtggacaaaaagaggaaagtgctgaacaagttggagatgagaagttgaggaaggaggccaaaagcaaacagcaggacgatgatgatgatgatgatgatgggattttggtaaaaaataaataaaaacaaaaatatttaaaatggaaataatcgaaattaatttaattctggaagaagtcagagaaactggaaatggaattgagggtggccaaacaaatgtgcgcgttcatcaaaatggaacttgaagaggcagggattccagaaaaagctaaaaatcaaataccataaatatttaaaaaataaaataaaattacaaaactttgaaaaataaatttcgtaaattttaatttttcacagaaggcacttcaagcagaattaaaacagcaaagactgattgaagaaaacattgagttgaaagtcaaaatttacagaatggagaaggaaaaggagcaaatggaaaaagacggtgaaaaagaaaataaattgtaacaatttttgtagtttaaaaagcataattaagctaatgccaatcaatccaaagaactcttggagcggatcattgaattggagaagcgacagaaacaacaaaaggaggagaatgagagaaaaggtcggaacttgggagacaacatcggtatttaatggcaaagatttacactaagaagtcccgcgggattccctctcccactaatctctaattttagatcattcatttttgtagtcattttttaaatttcatttttaacttctcggtctctgttctccagcagaaggtcatttctgctgatggtccggttcagaaacagcagcagaagaaggacgaaaattcggatgccaatttgaacaaagtgttcttccacctttacgatgacattgggtgagcagaaaggaggcctttttttgtataaaacacggatagggaaacggtatcccatgtacagtactttcccagaatcttggcagggccatgggttctgttaagacagaacttcagtccttgttttgtcttttttgctcttgtccatcccgaaaacccttctggtccgggtttttccaataattacgggctgtacttgcgaaaaagttatccgattcaaattgcgcttaattt

SEQ ID NO: 28798 - DNA, 1175 bp, Heterodera glycines
  misc_feature (129)..(129): n is a, c, g, or t
  misc_feature (1126)..(1126): n is a, c, g, or t
cttttttggcgtttttttcgaaaaattccataaaaaatgcaaataaaatcagggaaaatacacccctaaagaagtgacctgaaaaattttcagaaaatacacccctaaattgtaagtattgaaaaattntcagaaaatacacccctaaaaaaattgaaaattttctcaaaaatttatcgccaaaatttcatttttttcttgataaaaaattttaggtttaaaattttccttatcctaggtttaccaagttctcgaattgaatttacagagaattgttttgttttgcgtcgattttttcacgaaaaatgatctgatcagcttcggttgcctggcgaggattaggtccaggtaaattctcatgattttgcccttttcggaagacattgacaaactcaggggagggggctggaaccgaatgattcgagaacagaggacggaatgacatgcaaaatggagaatatcccccaccccatatgctaaatcttcgcttacaaattagtttattgctcaatatgctaactaaaaaacaaaaacaaaagtcaccctgttttttgagtgctctcatatgctgaccattagcattacaatttattttaaaaaactcaatatttttggtcaaaaaagcaaattaaatgtattcaaacgaaagaagaaacaacaaatgtgaggagcaattatcagcagatcaatttccattcataatgaatgatcaatcacttgtcatttcccaataattcattcactttttcttctttttatttcgctgtccgctgggcccgagtttcattttccgatgactttttgacttcatttggcccgcctttggtggagacaatggcctgatgaatgaagtgaaatttgaaacaaaagaaaatggtgttgcccaattcacccaaattcataaagatgaaagttgacattgttcaaattgtccaggttttcgtccacccaatgaaccgtcgccgtcaccccaatttgaaatcgcttcaacagacaagcaacattattagtattttgatggtcgtcttctttctcgaatgtaagcatttcgttggtccgttcgttcaccaattcaaatggctcaatttccgttggttcaaaatcctcaagtcgaattatgtagctnggcgaagaagtggtggcatggagaatgcctaacacaatggaatgaaaaa

SEQ ID NO: 28799 - DNA, 940 bp, Heterodera glycines
atcgggggaatatggcaaaagcataaatcgcaaattctccaatatcacataagcatcatcatcagctcgcaagacccaatcgaattcattctaaaaaatattattgaatcagcttcaatttttcgtgtaaatatgggtatatttttttcgcaaaaaaagaacatatttctgagaagggattcaatcgaatgaaattaccgtaaccgttttccccataaaataacctccccctaggcaaccagtcagtgggcaaaccgtcagtattggctaatccggtagtaattttttttttgtacaatatcaaattaatttaaaaagaaattggaaagatctttacaagattcctagctattttataatttaattaaattgaatattttttagaatcttttgtttttaaaaaaagaataattttcattcattttatataaaacataattattgtttaaatgtttatcgatttaaattcattttctaaatatttgcataaaatcttactttttcaaataaattttgctgacagattgtccactgatggattgtccttcattgataaatcaaataaaattgggtaaaatgttaggcctcggaatatacaatgtgttttttttgaattattttcttacaaatttttccacaattataaattttttggctattataaaccataattcgaacaaatttttttatataaattatataaaaatgaaagccatataaaacacatttcagttagttcattacattgttaatttctagagggtattattattatttactaattaccataaagtgttcgtaaatgtaattgataatccatcgtgttctggcccaaagatacttccttccgagtggtaatccccccacatcaattgctggcaaagatgagtcattttttgaagagaaaacagatatttggtgcaatgttgagcccatgttg

SEQ ID NO: 28800 - DNA, 1357 bp, Heterodera glycines
cctggcggtcgccgttgcacatccatcccaactctccggcgagcggcccgccgcccgcgcgcgtaggggcgagcttccatcgagtgaaacccctccaccagcaacgagacgaaccgtgccgaatttgtgcgttggttggcacaagcgacgggagggggcggggaaaacggttgtcattagagactgtacaggccctgagggcatttaccgagccgcccgtccctgtcccgttttttggacaaaccacctaggccaggccgccccattgggaaagtctcggatttttgggcgtttgtctcggatattgggaaagtctcggctttttggacgtttgtctcggatttcgtctaccgggctgcccgtccctgtcccgtttttgggcaaaatcaccgggaccaggctgccctgtaaaacgggattttttaccggacagcctagccacgatcaattttctaagccgggcccggtactttcaaattccggtatttatttgtgatgcatgctcgagagtcccgacgttgggaaagtgtcggctttttggggcgtttgtctcgaatttcgtcttggctaggcaaacttttggcctcaaaaccaaccaaaccaattgtcaatgtaattttgcatgaatttttgaatgcatgaataagaaagcttttttggaaaaagtttagctcttgagaagattctcgccttttcagtggtctcaatgttcaagaccattcttaacacagtattggcaattttttaagtcatccaaaagttcataaatataattttacatgaatttttagaatgtaagaaattttttgaaaaaaacgtcgtgaatttaataaattttatacattttttaaagatctgtcttctatagattagtctcggtcaagagtatcggcaatgttttttcccttttttcctccacgcgatgggaatttgtgaaagttgtttagactgtgctgaagcccatgcagaaatattgtccacgcattcacatcgtccgctctgacaacatttattcacagatggccaattggaaaacgacgagctttgccgaaacggaattcatcgcggtgacctcctatcagaacaacttggcaagtgacggagggaaaggagagaaaagagataaaaagagtagggaaagagaaaatgagaaggaaaagaaaagtaaaatgggggaggagcaaaagggaaagaaaaagagggaaaaagagtaagggaagaagggagggggggggggggggactgggtcgttttggcgcccacgttttggcgccgacgatttggcgcccacgttttggcgccgacgatttggcgcccacgttttggcgcccacgttttggcgccagggtcgttttgg

SEQ ID NO: 28801 - DNA, 1405 bp, Heterodera glycines
taaaatttgattttttttaattttttaattttttgaattttttgaatttttaaaattcccggttggtcccggttcccggtcccgaagaaaaatcgaggtcccggtcccggtcccggcttctcaggtcccggcaagtcccggtcccggttttgcccaaaattcccggtcccgctctactctagtgaaaattggtgacaaacaggtggggaagatcatatacatatagccacaatgttggatcactttttgcaaagagattatgaccatttcactgattacatttaatcagatcgattaaaatttgatcagtatgataaatttaatcagatcactgaaattgttcgggtcacttagaaatcttgtttaaatcactaataaatcttggtcagatcactgataatctatcccgatcagatggccgtgtccgcccattggctgatgtccgtttccccggtgatcagtcgcatgctcagcgtgagatgaaggagaagcagcagcgaatgatcactttggacgaattgggcgtggacatggaccaattcaagcagtttttggaggccatcacttatctgaacggaccttttctgcccaaccgtaattcatgatactgatctattatactatatcccctgaggggttgaaaatttaattttttaaaaatattgattctcaatttttagccaaaaatgtgctggtgctgctcaaattgtccgactactttcaggtgggtgcccttacagatggaatattagacattacataaaattttattccgttttcaaaaaaatgatacttaaatttgaatatcctttatcaaagagagtttacccataattttcaataaaaaattaatttttactatttttaaattcattaggctaattattaggggcactaattgctccgttttgaggtggccgcgttgaagtcgcgttgcgaattgcatctgatcaattgcgtggaaattccactgatcgaccgtttccttctgattgaacgcttcggactcgacaatttgaaagtgatttaattttcaaatattttaaattattttttaaattaatttttagaattactttttgcatttgaatgttgacaaatttcgtgcctttttcaatgccaaccatgaacagttttttcctgttatcagcaaagaatttttgtgcgctttgtctgtccgaggaatggccgggctttgatcaaattgattttggcattttcatagaaattgatcaaactgattttggcattttcataagccgggctttgatcaaattgattttggcattttcataaaatgttttttagaaatttcctcattctcgatcagagagaaaattgttaattttttttgaactgtattaaaaaactttgttataatgagtttatcaagtaagaccaagga

SEQ ID NO: 28802 - DNA, 1604 bp, Heterodera glycines
  misc_feature (99)..(99): n is a, c, g, or t
ccatggctgaagaaattcgggtagttgtcactgggagtgatcgatttcggttttcgaaacagaaattaatgtagcaatccgtatcggcacagatgttgnctatcaggatgtcctcctctggacgcgaataatttgcgatcagccgagacaaaacgtcggcttggccaaatgacgttgtgttgacgtagcgaatttcaaaatcataattcgctaagatcatggaccaacgttggaggcggctcgcggcatagatcggaatgccctttttggagccaaaaattgccaataaaggcttgtggtccgtttgcaaaataaattttctgccgtacaccatgcggtgaaatttctgaacggcgaacacaatggccaatgcttctttttcaatttggctgtaattttgctgcgctgctgttagagtgcaggctgcgtgttccaccactttttcctttttgtcggggaatgtgtggcttaatgtggcaccgattccatctttggacgcgtctgctgatacgacgattgggcgtgccgggtcgtagtgggtcagcaataaatcggacgtcattatttgttttgctttttcaaaagcattttgctgttcggacgtccattcccaagctacgtccttttggagaagtttgtcgagcggtgcacgcagttcacgcatgcattttacaaatcttccataataattcaaagctcccaagaacgatcggagggtgcttttgtcaatcggagcgggcattttccgaattgcgtctgaacgcgacgggtcaggacgaatgccgtttgctgacacaatatgcccaaggaacaaaagttcgggctgcaaaaatttgcatttgtcgagttggattcggagaccgtactcttttatgcgcccaaaaagagtgtaaaatgccgtgatgtgttgctccagggttttcgttgcgatcaatccatcgtcaagatacgcgaaaacaccagggatgccagcacaaatttggtccatcaaatgctgaaatattgccggtgccgatttgactccgaacggcaggcgttggcattggaaaagtccgcgatgtgtgttgatggcgcacaattgcttggattcttcatccatttccatttgcaaatacgcatcgcgtaaatccaaatttgagaaaaatttcgcgccattcagtgaggcgtaaatgtcgtctggccttggcagtgggtggcggttcaattccaatgcattgttgaggccggtcgagaagtcgatgcagactctcgtcttgccgtttttcttttttacggccaagatcggtgcggcccaatgactgaaatcaatcggcttaattgcgccaatttgaagaagacgatccaattcggcattcacagcttccatggcgccgtgtggaatggggcgagctcggcaaaatacaggctttgcatcagaccgcaaaatgagatgcgcctttgcctttgagcagtgtcctagtccttcttcaaaaacttccgggaaatcgttttggagtgccgctttaagcgttgacacatcattgatcgatttgtttggcggcttcactgccgaaaaattgtcgatcatttttgtcgcctaatccgatttgttggtcggaaataaa

SEQ ID NO: 28803 - DNA, 1235 bp, Heterodera glycines
taaaaatctgatttttgatcccgacacgcactgaaatttatgatttaaagaaatttagcaaaatgttcttatttttgaccccaaaatcttattttttggccttgatattcttattttgaaaattttgagatcgaaaccctggattaactataaaaggtatttatcccattcacagctattacatttgacatgggtttcatccgttcggataaaatagtaccaccaactgcaagcatcatcaaaaattttttgggacattgagctaaaaatagtttattttagagtgaagcgggaccgggaattttgggcaaaaccgggaccgggacttgccgggaccgggacctcgattttcgtccgggacagggaaccgggaccaaccgggaatttttgaaaattcaaaaaaaaatttaaaatttaaaaaaattcaaattttaatttatttcaagtgtaaataatacaaaattaatttttatattgctatttattttataaatccaaaagttaaagctaaattaaattactgaaaattttcaaatcgaatttacttcagttatttcaaacaattaatcattttatgactcaaatgatcgaatattattagcaattcagatttgcttttcacatcacttttttcggcgcgctttttccaaaaaacttttgggaaagaaagggggtccggcggtgccgataggcgccgtcggggaaattttgaaaatttgagtgtgatttgtttacagattttcaacaaaaaaggttggtttttgggattactatgctcaatttgtacggattttctttaaaaaatgataaaatatgtctcaataaaaaaaactatgagcaatcatatttataggaaacatatattaattctttttttaaattttttcctttgacttcaattttcatcagtaatttttcactcagacccccattcttaccagtgcttgtttttcccggttcccctatcgggaccgggacctgagcttttcaatatccgggaccgggacctcggatgaccgggaattcccggcccggtcccggtccggcttcactctagtttatttcatttgaaaacaaaataaaatagaaaatgtatatcaaaaatttcggaaatcggaattccgacgtccaaaattttttcggaagtcggaattccgacttcatgcaactaaagcaatacaaatgcacgaaaagacgcataaagaaaataagacagactattcgcatgggtaaaa

SEQ ID NO: 28804 - DNA, 1828 bp, Heterodera glycines
  misc_feature (38)..(38): n is a, c, g, or t
  misc_feature (159)..(159): n is a, c, g, or t
aaaatttgaaataggctggcattagtttgacttcaaanaataaaaaaattttttagtttcttaaaatttttgggcaaaaattgctatttttccaaaaaaaaaaaattcatttttgagtattggggttgaattattatttttttctgaggggactgtccncaaaggccaacaccaaaatgaatttcgagatttattctcggcctgaaagtccgcagtctcgagaaataagttaaaattccggaacaaaaactggtcggtcttggagcctcgagaattgttgagtttccagcggcataaaaaatggtgaaattttatttattttgaaacgcatataaaaatggaagacttcgctaattttgcaaaaatcattggtacttttccgcttgggggccccacatttatttattttgactattcagcgcgctttttgttaacgttgcttaatttaaataaagatggggccccaaaagtgccaaatcctttttttaacagcagcaccattattaatttgccacctcttttttgtgctcaaaaagtgtgttgtaaatgtgaaagaattgctgggtgaaaatttgctttgaaattggtcgtccattgatgcgaatgcgttcacggacatggaccaaatggggagaactgtaaaaaatgaaaatgaaatttaaaattgacatctacaaaaaattcaaaattgaccaaaatttccttaaaataaaaaattttcatgtcttagagtgagccaattatagataaaaaaacatttacagaaaagtaagattcttatacagatttcatgaaaaatatttaaatcttttttactttttgtcaatcgaaattattcagcaattctaaattaaaaattaatttttcaaaattttgtaattgggtgccacccacccacacctgtaaaagccagttttgtagccaagggaacgcaaaatggactccagaaaagcggcggttgaacctgtaaaaagaaaataaatttggattttaattgattttttaaacaaaaaaaaacaccttttccttttgtgccggtgatgtgtacaacattcagacggtcaatgtcgtccagctgaaaaaatcttattttttttacaaaaataattttttgcgaaaaataaaatatcaagtggcgtattcgagtgaaagagagaaactgagagacaataggaatagaagaggaacagattgttagagaacgatttaagaaatgcaaaaaaaaagaaaagaaaaattttagcaattttttgtaaccaaaagttacgaatctgtgaaaagcaattttgataaattttcatacaaaaaatgcttacttttaattgaaaattaattaaagcagtaaaaagggatctattaagagcagttatcgcaaagattgggggagcggagatggggattattaaaataaatagcctccctccttaaaatgtcaattattgaaaccaaattaaataataaaatgggaccgaaattccgagaatgtccatgaattccttggtctcctccagcctccattctggccgcgtttcctgttgagttcgtgccaatactaacgtttgtgcgttgctttgcaaggcgttcagctggatgacggctttctggaaaattaaaaaagattttcatttttttttaaatttcggcaatgtgtgcctcgtaaagttgctgctcctcgtcgctctcccgccgttgggtcatttccgaagaagatttttgttggtgatttgtactatcaaatgtggaagcacttcgaagaaaaagcgctagaaaaaatatattttttaattagagaaatttaaaatttgaaaataaaaatggtattaattgg

SEQ ID NO: 28805 - DNA, 1228 bp, Heterodera glycines
ccacggcccaccggcttgggaacaacggcttccgctccggcgatacccgaccaccggtctcggaacggcgtgacccgccgattgggtggccccagaatttgccagtgcaatcgtatgcgtaagtgccattgaaggggccgaggctttccataatctcgttcattggcaaagtccgattccgaggccgacactaacagagagccaaaaaataaacatgcaaaatgccattttcatttttcacttaccaatggccatctttcgcatcgctaaaaaagggactcatttaaaaaaagaaaaataatgacaaatcgacagagaatgaaatggtaaaaatgttacgttaatgtggactacgatttttgtaattattccatgtaaaagttattcattgtcttacttcgttgtttcgtatgctgtgccttaagcaagccaagataaaaaaatcaaaattaataaatttatttttttttctaaaaatgaaaaatcccctagtaagcttacttgccaaatcaatttgatggatccaagacttgttcaaattttcgttatgtgatttgtttttttttgatagggatggaattttttatagtattcttttttagtttatatattaatcgtataattaaatttattataaatttttcggttagtctcggcacgattgtaattagtcattagaattaagttgcaaaagattgtctcataatctataatttttttaaatgacctccaactaagtctgatttatgaagagtaagaataagccgaatagtcatgtaaatggctagcggaatccgtaccctaaaactttcaacttttgatgctgatcaaaagtaaaataatggacttttcgacagtaaatataaaaaaaataactcttttaaaataagttatattgcttgtcagttttactaatttcttttgaattaacacaactaattcgtattgctaaatcattattactagggatacggtttttacgtcttttacttaaaaaatttcagaaaaatacatccttaagaatcggcctctaaaattttcaaaaacacacccctaagaaagatgaaaatttctccaaaacttcatctgtaaaatttatttatttattttcttcgtaagaatttttgattttaaaaattattttatcttaatactgatttggcttaattttgttgctttttggataacacccggggtggatacacccttaaattgaaacttaattact

SEQ ID NO: 28806 - DNA, 1588 bp, Heterodera glycines
ttcatacatcgattttgtcccgccttctcggtgcttcttcctcctcccacattgattccatcgaccgccccggcggggagcgcggtggccgaaagcggcaacgacggtaggaaaagcgagcagaatcgatgcattgatcccatcgaatcccaatcggattttgcatccaaaggatgagtgagtgggtgagaagcgattgattaagcatagatttttggatgggaattgaaggaagaggacgaacaaacggaggaaagaagggaaagtgggacagaaagaaagaagcggaggagaagggggaggaggaaaacaattagtgcgaaaaatgatgtcttttaattatcatatgctaattgcatttgtttgataaacggtgggcagaaaattaaagaaaaaaacagtgacaaaagaaaagagcaatggataaggaaaaggacaaaaagcattaaggaataattaggatttaaaatatatggcatttgcgtataaatcgcaaatgttatgcatcaatttgcaaaatgagaaccattaaatgcccatatccgacaagttttattaaattctaaattaaattgtatttaaatgtattttcaatccgtggtgagtcgaagtgtcaaaagtattgatgtggcttgtaaaaaaaagttgggttgaattaaatttgtcaaattatttgatggtctcgttttttgaagggtcgtgtatactaaaatagagccaaatatatttattattaaaagattgttattcaattataaatgaattaattaatttaattatttaaattaattttctgtactgaaatgacccgtctctttcgatcacccatcatcgattcttttgacacttcgacacagcacctttaaaaacaactcattagtagaaaaaatatcatttttatatattcgctcccttaagaggtcacttgtgtatacgaaatgttcttcaaccccaattttgatggtcaaaatgcgatggaaatggccaatttggcaattaatttaacaatattcttttttctattctttctgaatgattgcaaattaaaattgggtcattgaatttgaaatgtttttccattaaattgcattataaatatacaaaattatctttggtacaatttcttttggtagaagtaagtctttataattagagaatgaatttccaactcaaattaatctattaagtgctaattgaatttgcatttttaaatttcaaattgttgtcattgttccgtagtttttcccgagccttttttacttaaacaccgaatcccaatccgaaggaaatcgctttgtctttgacagccgcctgaacaaaagtgggaattaagcagagtcatttgctatttacaactttgaaccaaaccaggacttttctctaatttcgcccaggggtaattacttttcttaattagtccgcaaatttctaaaacttctgttatgaagagttaaacaaataattttggttttaaatatttttttcaaattttaaaaatgaaaacttctcgcgattttctcgcttgatttttgcaagccattcccttgccttataataagaaattctttttaaatattttaataattga

SEQ ID NO: 28807 - DNA, 1292 bp, Heterodera glycines
ctgcatttgtctgtcctcatgttttgcaaaattgaataaagcggtacgccctttgatcattatttatcactaaaaaagcttatcaatggacaaattgggcacttttatttatttggtgataaaaatgccctccttcctcacattaataaccaaatattacttttttttaatttttaaaatgaaactaattaaacgaaaatatttgccacccgaattactttttgagttaattcattttttgcctttcaaattggtgcttaaaatattttaaaaaataattattaatgaaattaatttaggtcgaagcgttggatgacaaattgggcactcttttggcgaaggtggcacatgaacgtagaaatactttgtactgtgccattatacgtaagtttccgacatttcgatcacatcataattttcttatcgtatattctctaattatcgccccgtcttccggggacaaattttcctcagcctgtgccatattttaatagcatttagtgctctcaagcaaatttcgtgttcccaccaaatttggcttgtgcttggagaagcccaaccttactgaagcggcttccgaaaactataacattggcaaattccgtgcgcacctcgcagaaatccgtgctcatattgttacgagtggggacactcaattgatccaaaaagcgtcagtgtgtaagtttttattgcaaatttggcaatgtgtaattaaaaaatggcaaatttcaatcaacattttcaggtttgcagaagcttattgtttttttggatgaacaggattagctaagaaggataaagccggacggacaactgaattagcaacggaaattccaacaaaaaaggcaaaaagtttcttttatttgaatgatggcacaaaattacactaataattcctaagtgccatacatttaattttaattttacgtctgttactacaatttttgagaaaattttataataatttttgttaattcttaattatgctaaattttgaatgaactgatgcgaattaaactaatatgtattgtcaaacaattaccaaaataatgccattttttgcgcaaattattgccttttgacatttattagtgccgtttttgcattaattcgtgacattaaccgagttaattaatcgttaataaacatgaaaagatcagaaaatgtgctgatcaattaatctcaattagtgttggagtatttcagtggtgtgatgcggtggtagttagcagggatggcattccgaggccccaaaaatgttcggaaatcggaattccgggggtccaaaattt

SEQ ID NO: 28808 - DNA, 1503 bp, Heterodera glycines
  misc_feature (69)..(69): n is a, c, g, or t
tgactacaacgaattggtggacgcacatcatctgcccctcaggtgcagcaacagctccaaacacgcggnctttctgcactcggaagcggatcggagcagggcagcagcgcatccgcggaccaaattccgtccacgcacttccaagtggaccaacactgctcaatcccggcggacggacagcagcacaaagtgagggggaagcaaaaaaacgaatggggaggggaagggaagagaaagggaatgaaaggagggggggggggaagggaggggtgagaagcgggccaactgatgagtttcaactgttgtttaaatcggcttcttctttcttccttccatttttgtcccatttgtctgtccctgttaagctgttccgtttgtctgcttctgatgttgccatttgtcctttcaggtggacattgcgcacatcgaattgacccccaccctttggcatgagtgtgtgccctcccgtctttgcagtgccttcgtttcgtgcgttcgtttgttggcattccgtcccatttctcctctttagtgcccaactcgtcaactcttcccaacttccgcttttgcccggccctctctccgttttcttcaacaacactttcacttcgacggtccccccttatccatttttaatatttaatattattctctctcagactcatctcaacttggtgttacccggtgaagagtttcggtgtcttttgggggtcgatccggcattgaaagttgagtacaaacgggcacaactgtctaatcagcaagtaaagcagccaaatttggcactctttgcacgcaattgaccccaaggtcggcttcatgtcccgctcgtgcctttgcacccatgagcaggtcatttcgcttcgaaatgcaaaagcgtcccaaagctgtcgcgttacggtgcgcgagcccatcccaaaggcggcggatgagaaaatcaaagtgagtgaaacgaattaagaaatttaattgcttttaatttcagatttctctgctgcatcccgacttaaaggcgcagagagcggaggcgcgacttttggccaaggaaagccaattggaatggaccgtcaaattggggccgggcgaacagagagaattgagcgtgaaatggacagcggaatatccggcacaagaggtaaagcgaaggcagaagcaaagtgcgagtgccattctcagagtgtgctcctcagcagctcttccgccccttcggcttttgttcagccgctcgcatcgacgcaattattggcaggacgaacccactgaacaaaagacgcacattccgtgctattactaataaattaattgcttttaattgatatttatttatgccaactttcactttcaattttagtcattcgtttttttttttgcttattttgcaatttcttgacaatgaataaataaaaattaatgaaagaatgaatggaaaaatgaatgaatgaaaacgcaattggacgggaggggcaactgttgacgggagcgacggacgacgaattaattctc

SEQ ID NO: 28809 - DNA, 943 bp, Heterodera glycines
aatattctatcccagtggggaattgaacccacacgaaagataatgaacggcaaaaggtatagccactagaccacgcaaccataaagaagaatcctttaaaaaaattaataataactagggctgccaaaagtatgcaaatgcatattttttttcctggcttctccatgctctaaatagtacgaaaaacactttcttttttgtgtttgcgtataaaaatcgggacttttatttgcatatttttgcatattttgggcctttatgcatattttggcttgttttacattttcatgcatattttgccattttttgtgcatattttccgattttttgcatattttgccatttttcttcaaatattttccgattttttgcatattttgccatttttcataaaatattttccgttttgaatatcccttaagtaaattttggcagacaataggatgagctttagtgccgaaaatcttgagaaattattgattttcaattgcaaaaaaaaccgataaaatttatgaggaataaaaattttttattggatttgcacccctaattttcaagtttttttgtgcatatttggtgcatattttgcgatttttgtgcatatttatgcgcatattttggccacttttcgtgcatatttttggcagccctagttattaattgaatatggaccagagaattattgtcagtattttttttgacaaacaaaaattctgaaatgggttgcctgtgagaatgttctgctgtccttaccattttaatatggtatggaagagaaatcgcaactgactgataacaagtactatggataatgtcaatcaaatgaatgttgtaaatacatgccaatcaaaagataatttgttgatttgaccattttataaataattacatcgaaaagcagtaaattaaaaaaatatatgaaattagtcggtagggtacgatt

SEQ ID NO: 28810 - DNA, 1126 bp, Heterodera glycines
  misc_feature (48)..(48): n is a, c, g, or t
  misc_feature (979)..(979): n is a, c, g, or t
  misc_feature (1083)..(1083): n is a, c, g, or t
catttttatcaagaaggccataatataaaaaacgatcaaatgaaaatntaatagccctaagagttctctaatagcctgaaaatttcaaggaaacgctaattttcaaaatagttatgacaaaaatatttgaaaacctggttccatgtgtactttttgctataactttgttcaagcataacgaaattttttgaaattttgcatactattagagaactcttaaggctattgaatgatatcaagattcaaaaattagttgcttttaagcaatgttatgggtaattatttgttgaaaattttcatttggtggttttttatataaacgccctttttgagtgttcatttaacgatatttcacccccaggggaaggccacgatgggaagagggggaggaaggatcgataaatgaccaccgaagagagaaggtcaacaacaaatgtcaaacttttaacaaattgcttcaaaaacaaaaattttcccggcggcgcctgtggacaccgccggacaaaaatccccgaaattattttaaaaaattggcttcaatatgcaaaatgtgaacttttttttctcacacatgtgagtgaaccagggctgggcgcaactggattttcaattacggaaatccgcaatccgcaattgcggagattttctcagttacggaaatccgcaattacgggggtccaaaaaccccgcaatttcccgcaatccgtaatccgcaagccgaatttttgtcagaatttttgaaaatttttttttcaatagtgtattaatgaaaatcaaaaaacagattttcgggatgtatcttcttatttttgatttcaattttacaaagaaattataatttttgtctctgaaaaaattcattctttttgaatttttgggttcatttttgaaaattttttgaaagtctgatcattataattggatttatgtatataaatatttcaatattgataagaatcaatagccaaaaaaaaaaatnttcggggggggaacccgaagaactgaactttttggccaaaatttttttagtgttacttaaaaaatttcagcgccggagagcaaaaacaggaattgtagacgttnttagccaaattgggactaactttttgcattttggagtcaaaat

SEQ ID NO: 28811 - DNA, 764 bp, Heterodera glycines
cgcctattggcaccaccggaccaccccccgctctcgaaaagttttttggaaaaagcgcaccccaaaaaaagtggtttaaataacaattaaataattgggcaattaataaagcgtttatttgtaaaacattatattttccatgctttttaaaaagtataagcttttattttcataaaaaatatggatatgaactttattttgcaaaattcataatcccgaacctgaattcgaacaaaaattctaggttcacaaattgcagggaaatttagcgtttatttctttggtactgaagtgtccattttcagtgggactcagttgtcccagtgcttagatggcatcggctcgacttaattccctgaagtttagatttagttcatcaagagctttcgaatgataccaaatttgtttgaaaatttttttattttaaatgggtttttggctgatttttggtgccatttttcgtgatttaaaccggttcaaaaaccggttttttgatttttccgcacctcgggaatagaggattagaggtcattagagattgattggaacccgttttgggcggtttttttgcgggcccaattctatagttttccccagaaattgttgatattttgtgcaaatctaaaaatttttctttttgtacattttttattattgtaaattagatatttttaggttcgtaagcaattaattgattttttcaaacattgttttgctttttaaaacaattttcaaaaaatccaggtccaggcctggatccaggt

SEQ ID NO: 28812 - DNA, 1159 bp, Heterodera glycines
  misc_feature (6)..(6): n is a, c, g, or t
caaccngggagatttcccatttcatgttgcaacaaccgcatttttcacgtttcatgttgtcacaaccggaagactttcatttgatgttgccatgattttccgtttaatgttgccaacaaccggaaaaacaaccgcaatatttcacgtttcatgttgccaactactgaaaaaaacaaccagagatgattaaagtttcatgttgccaagaaccggaagatttcacgtttcatgttgccaacaaccggcagatttcccatttcatgttgcaacaaccggaatatttcatgttgccacaaccgggagattttcatttgatgttgccatgattttccgtttaatgttgccaactaccgaaaaaacaacctgaagatttcacgtttcatgttgccaacaaccgggagatttcccatttcatgttgcaacaaccgggagatttcccatttcatgttgcaacaaccggaatatttcacgtttcatgttgccaactactgaaaaaaacaaccagagaagattaaagtttcatgttgccaagaaccggaagatttcacgtttcatgtttcatgttgcaacaaccggaatatttcatgttgccacaaccgggagattttcatttgatgttgccatgattttccgtttaatgttgccaactaccgaaaaaacaacctgaagatttcacgtttcatgttgccaacaaccgggagatttcccatttcatgttgcaacaaccggaatatttcacgtttcatgttgtcacaaccggaagactttcatttgatgttgccatgattttccgtttaatgttgccaacaaccggaaaaacaaccggaatatttcacgtttcatgttgccaactactgaaaaaaacaaccagagaagattaaagtttcatgttgccaagaaccggaagattaaacgtttcatgttgccaacaaccggcagatttcccatttcatgttgcaacaaccggaatatttcacgtttcatgttgcaacaaccgggagattttcatttgatgttgccatgattttccgtttaatgttgccaactaccgaaaaaacaaccttaagatttcacgtttcatgttgccaacaaccgggagatttcccatttcatgttgcaacaaccggaatatttcacgtttcatgttgccacaaccgga

SEQ ID NO: 28813 - DNA, 1355 bp, Heterodera glycines
tatccgtgaagtggatgtctatccactgctcatccaatgtcccaattgttgaccacgagtatgggtagctaatgctgtgcagcccacacacccaagacccgttgaaattcaaaggttttggaagccggacccggaatttgtttggctgattgtccggataatccgtcacattgctaggcaaaaacacaaagaaactatttgacattatggatttattcaactgatgagaaatacacaaaaattcaaacgcttttatacaatctgagactcatcaatccattctcgttcgggatacccaatgaactttacgagcatctctgtggttccatccggttttcttcgctttctgtacactttttcaattctgtaactggtgtcggcatcttttctcacgcgggccaactcctgctcataaaaggtgccccggaatttttcaccacgatcatcccggagcttgtatctgttggggcgcaccgccttcagcacctcgtcaatttccaagatttcgtctccatagtttggcaaataccccttctcgaactgtcccttctctctgctcatgcgtacaaattcatctttacggaaacgtggcttcttgcgtttttgcggtgattcataaattcgcttccacaccttctgagcattttcaaaattgacatcaattggtcgcattccgtgaacccgtgacggagtgctgttaattccatccactatttgttgtacaacatcaacccaattcagcgtctccctttcggcaaagtatctgtacagtcgctgcttcacatttcggattgcccgctcagcaactgaagctttcactgacgaatgcacgggctcatgtttctcaatctcctgctcctcaaagaattccttcagcaatttgtttttgaattcggtgcctttgtcggagaaaatgcggtgtgggaccattggcatttgcttgacaagctctttgaatgcatccagcatctcctcggccttcttatttttgagtggaacgacaaacaggcgttttgagagaacatcaaccgcaaccagcaggtatcggtgactgcgattgtgacgagaaagcgcttgaaagtcagccaaatccacttggacgtcggtcatgaaccctgctgcaacagtttttgctctcggaaatcgtacccgcctggggcgcatcagggtgtacgtgcggtgtccctccaaatagtgttgtacatcctttttgcgtaaattctttagctttttccgcgcctccttccacagtgcactaacaccggcaaacgcagcaggagaggatggatcgttgtacagcttgtcaagagtggtgttgatcatttccattttttcggctgaaattccttctttat

SEQ ID NO: 28814 - DNA, 1651 bp, Heterodera glycines
  misc_feature (96)..(96): n is a, c, g, or t
  misc_feature (141)..(141): n is a, c, g, or t
  misc_feature (181)..(181): n is a, c, g, or t
  misc_feature (193)..(193): n is a, c, g, or t
  misc_feature (213)..(213): n is a, c, g, or t
  misc_feature (223)..(223): n is a, c, g, or t
  misc_feature (239)..(239): n is a, c, g, or t
  misc_feature (1622)..(1623): n is a, c, g, or t
ttaatttaaacatagaaaataaattaacttttaaaacttacatagtaatctattatatgtaaaataatctaatatatcttatttcaggaaaaaagncatcaattaaaagtgattttaaaaaataaatggtatatgtaaatnaaatcaaaatatgttaaatatatacttaaataattataanttttttttattntaaaaagagataaaatatantaaaataaantctttttttattttanaattaattaaataaaagaaataataattacaaagacacatttttataaaaataagattttaaaacaaatcataattttatcgaatttcgcaagtaattatttttaactattaattatataaaatttgaaataattgctataaaccaaaaaatatatacaataaattacaaaaagtatataataaattgataaatgataaatgaaagatactaatgtaatcagatttaaaagtaaatcaattaatcttcagtactgtccttcgacggatagacgggtcgtgagattaacgagcaaaaagaaacaaaaaatattaaaataaactaattttacaattataaaagaaaagaaaaaataattacaaaggtacatttttataaaaacaaaagtttaaagtaaattataatcttatcgtatttcgcataaaatttttttaaaatttttaattactacaatggattaaaaaaattgctataaacaaaaaatagtgatgaaaaatttgcaataaaactcttattttattaattttgtaatgacaaaaattagaatatatgaactgacaaaataaaaattatgataaaaagtgcaaagattagcaaactttaattatttttataatttgaatacgatcaatataatcgtttactaatcagcaaatttttgttaatattgaaattctaatgtatagtgaatataaaaaacaatttacgttatgcgctttggctcttgattggtcttcaagaaaaaataaattatgaaatttataaaataaatctgttcgcagaagagaacaacaatattaaaattaattataaaaacgcattaaaattctgatgaatattatataatattcgtcctaaatacagttgtacgtagaataaataaaaaaacgtataaaatatttataataaagctaaaattattaattaaatatgtagcttcaacatttactaaagttgatgtaatttagaaaatttgtcgtgaacattagaaaaataaaaaattttaatttcaaattttgattaatttgattttttaaatattggtactatttctaatgtttgctttaaatcttatttattattaaaattctgaaaaatatggtttaattatatttttttattttggacaagaaaacatattttgattggttgttttaaatgacgaagaatcaaaaaatatattacgggcaaaaaaaatgaaaattaataagatagcaaaaataataaatttattttaaaaaatatatgaaaaggattggaaattttagagaaataaaaaaaattaattgttactcagaatttttttttttgataaattaattttaatatgaaatatggaacttatttaattttccggagagaaataattattaaatcatttccnnaaaagtaaatttcaaattcaaaattatt

SEQ ID NO: 28815 - DNA, 1520 bp, Heterodera glycines
ctgagctcgaaggagaagcgtttgttgggtcggaccttgctccgttttccgttcctccgtccgttgctcctccgccgtttcctcccccttcccatgcgtcgttttctcctcttcttcctccgtcccttctttttctggccttctcctttccactgaattgttttcttcgtccgtaaaaatgcagcagctgagcaactgtttggattgcgattgtccattcaaagtcaattgtgaagaatgctgctgctgcaattggtgctgtttctccttttgagcattgtgcttatttctggctgcagcaggtgccgaagtgttcgctgctgttacattaagccaaattgcatcccataaaagtttgacgaattggtgggcacttgactcactgaaaggtgaaaagataccgaaaagacaaaataaaaataaataaatacaaaccgcgaaagtaaataagcaaaagcattcgtaagcgaaacaaaaacagagaaaccgacagagctcacgaaattatcttcaggagaaaagagctgaacaattgtgaggacacccagcaaaacagtaactgaaaggacacttcggcaaatggaaaaaatcgaagaaagaagcgaaagagacgcagtggcacctaatggggaactcatttaaaacaacaaaacgataaagctggccaataattctttaccaaaacactgcgtgtcaaattgttccaacaaatgcatacacaaagtattgacctaaaagcattaattggctaaaaagggaatgaaagaaaacctgaggaagaagtccaaaggtaaaaaccaatggaagaaagagcagaaaaccagcacaaaaatcatgcaaagacagacgtaaagggagatcggaatacagacgaagccaagaaggatgccaatccagcgaagttcggacggaaaaattggtccaatcgagaaaaaggacaagcgaagagagaatgaggaagtaaattggacgagaataagagaccttttcaaaaattagaaatattaattgtaagcatttaaaagggtataaaatacaagccaattgaagccatggacgggtgaagccgagtcaggttgaacacttttaagtagagaaaactgcggaaggaattcaatttaaaattgccaaaatgaatgggcaaaatcacttgtgctcctgcgacagtaaatgaaaaaaagagcagtgagacttcggtgtatactctgcgataaagcatcagaatggccaaaagaccaacagaaagtgccaaaagaatgtcaaaaattgaagaaacaacagaggaatttctgtcaaaaattgtaatgagggagaggcggtccaactaaaataagaatttgtggaaaattaagcaatttgtagttttcttccaactttggcttactttcaaagtaaaagcccgccgtaaggacgcattgcaattgggcactctcttttctcaaacgaaaggccaccaattcaaccaattgggtaaaattagtagggaacaatatttctggcggggccgactgtgaagcgca

SEQ ID NO: 28816 - DNA, 1503 bp, Heterodera glycines
  misc_feature (1406)..(1406): n is a, c, g, or t
ccaccagtaccgctgtgcccggacttcactgaagaagcttgacttcgctcttgaaaacattaattcagaatgtcgagaataaagtttcgcttgtctccccctaactcacgatgatggtctttgtctttaagtagagaactgaaaaagttggcgagcattgtgttgtcgccgtggcctttgccgacgtctccgcccggccgccgtggcgattgttgcccaccgccggttgaggactgaccgctgacacttccgtccaatgcgattgtataaagccgggcgagaaaagactgctcgtcctccgccttaacttccttttcgccagtcgccctacatttttagagaaaaagttactactaaacccaaatcaggaagccccaaaaattgtcaaaaatgactaccgataattggagaagggtgacgcatcgctggactgctgggccaacatcggcacatccaaaagatcagaaccgaccaacgcttccttgatgatggacagcttctgctcagagtcccatcccttaacatttatgaacttattcgttaggatttttactgtctttttgctaacagtcggaacgaaaatgcggtctctttccacaatataagcgggagcagtgaatggtagtgagaaaatgcggtgagcaatgtatttgtgcaaaagttgtgtgttcaggtcgtcgttagccgaagtgtaaatataaaatggaataattaatttggggtttcttccattttcctaccaatgcggcgccatgttgaagacaaaacttgcgcacatggtattggagccggtcgagctgttctgcgcttaggtccgtgtgcatgtcgctcttgttgattgctgcgatgagaatgacaccgcaattctcctctaaaatccctttctccggcggcaacaaaagtggcgacgaatccaagtcattggcagtgccattcatcccaccaccccctccagcgacaatagtggcattggactcagccaaagtagctgaaaggaatgtattaatactgattggttgatgtctaacaataaactaaaaggaatcccagctattagattttcaatttcaaaaaaaaactcatcttcacccgtccttttttgtatgatatattaaagtaaaaacaattattcttttgtgccaataggcgccatcgaacatagtttgggcattttaataatttgttaaatatattaaatttcaaaaaaaatcctcttcactcccccctttttggtatgatatattatactaaatcaattatttttgaaatccaataaattaccagtggaatgatgcattgattcaatgggctccatgtattcttgccagaaacggatttctacaaaattgaaaacaaaaaacaatgattacgtcacaataattaaggacggcaaaaaataatagtgnaactgaacaatggtaaccaaacgaagatttagctatttttcagtggagctttccaccccgcccaaatcgaatattcgctcccctttcttacgtgctt

SEQ ID NO: 28817 - DNA, 1405 bp, Heterodera glycines
  misc_feature (1373)..(1373): n is a, c, g, or t
gtttcctccatcgcttttcgtaattacgcggcttctctgctgcccgctcctcacgcggtttgggacactcagccccaattcaccaaagtgaggagcacattttatggcagaatttcaatttagtttttagattttcattaacaatgaatggcacaattctctcagtggcaaaacatttcccacttttgaccccacgacgagcaaaaaaattgctgacgttcaagagggagacaagtcggacattgatgctgccgtagaagtgagtgttccgttgagacattggcggaagagggcatttgaacattggtgtatcagaaagacccttttctgaatttaggcggcgtcgggtgcgtttcgacttggctctgagtggcgcagaatggacgccgcggcacgggggcgactgctgcacaaattggccgatttgatggaaagggacgccgtccatttggctgttcgtttcatttggtcattctccacaaacctattttaagagtttggaaactttggataacggaaagccctacaaagatgcgtttctggccgatgttccgctgtcaatcgctgtctatcgttattacgccggatgggcggacaaatgccatgggaaaaccattccaattgccggtgattatttctgctacacgcgacatgagccggtcggagttgtcgggcaaattgtaaggaggagacaaaccattattattatgaacatggcccaaatgttgcaatttgtcagtgggcactttaacggctaatttaccccaaattcgacaattaatgtgtattttcttgccttcgaccttcagatcccttggaactttcctcttctaatgcaagcgtggaaattggcccctgcccttgccttgggcaacacatgcgttcttaaacctgctgagcagaccccgttgacggcgctgtacgtagccgaactcatcagagaggttggggtttgtttgtgtgggtggtgtctcgctggggggaagtgtttttgatggggcctttcgctcttacttttattaaacagtttgaagtttgtgcccttcgcggggtcactctttcgtgactacccccccccccattttttctctaattccctcctttttccttttccagatcatttggtgcgctatatggaaagttaccatttttgaaaatttttctcacttttttttggtaaaatttttttttgtttatttacacataatgatgtatattaagcattaccatcacaattatggtgaatagaaagtatattcacaattttttatctcaaaaaaattttgcaaaacaaaagggtccccccttttgtttttgataaaattaaaaatctgtcactataactatcgccaaatttcttaatatgcccaaantaattgtcatatttatgatcagcgatctctaa

SEQ ID NO: 28818 - DNA, 1402 bp, Heterodera glycines
aatgcacggctggtgggtcagttaacggcaaaactaaattaaaaatcgccaaaaatatggcaccctaactaaattagtcaatcaaaataaaaggatccatgaatgaatgaatgaatgaatgaatgctccgctaatgaatcgctccacgaataacgcaattatgtattaactcttgcaaagggtcgacacgtaacaaaatatttgcgaacgaatggaggataaaagggcgttggctctgctctctgctgctgttgctctctccccctttccccccttttctccccttgcgtaatcacttgcgtctgtttgggttgggttggcttaggcgggggggggcggtgaccgactcggccgggtcggcccacgcgaccgcagccgatcgttgtttcttgcgggaaaaaatggcggggtggacagagaacataggaatatgtacaaatgatatgaatacagagaaaagtgtgccatcggggaaatttggagaaatggaaaaagggggggggagagggggaggggagggaagagggcggtgacccattggcatttggtgccctcctcctccttcttcttctcctcctttcccttctgttgctgtcggttcagttactcgccgatatcgatgaataaataaactttgctgacacagctcaaagggttaatcatttatataataatggatggataagagaataaagaagcagacgagaaaaaagaagtttatttccaaaacatatttaatgaaaataaatttaatggaaaaacgaaaaggaaggcaaagggtgaggaggggagaaagagcgagggacagtaacaccaagggcgtagccagacccttggctttgggggggggggggggctgaagtcaaaaattcgatttttagcggtgtattttggttttttgaaattccgaattatggggtgtatttacaaaatttttcgccgtttttcgccaaaaaattaatattttttgccattttggtctccatttttcaaatatgataaaatgggggtccggcggtgccgataggaaccgccgggaaaatttttgagaattttaatgcaattttgtaagaaattttgcggaaaatttttacttttgggtttcgggggggggggaggctttagccactttagccccccctggctacgcccttgccccttcctattatgagcgtaactggaaaagcgggatccccccgacgggttgaaccgactaaaatgaatttaaatttttacaaaaaatttactaaatcaaggaaatccatgccaagacggcactcacaactgtcacacttatgcgcgctgtcgtcccaccggaacgctctcttacacatgcgaatgtttggctggctacgaggacaaatcgccaccagtttggcattcgtctgcttaaatataaaca

SEQ ID NO: 28819 - DNA, 1162 bp, Heterodera glycines
  misc_feature (17)..(17): n is a, c, g, or t
ctttttgattttgattnaattggcagtgaattcggcaaccatttttcctttcagcaacattcggatgggtcgacgaatgcaatgggtcatttcaagtgccaatttggcgatgaaaggcagaatttcactaaaaaaaccggcttgaaattccgattttgacccccaaaattcagttcattaccaaaattgttcccacaattttatataaacaaataaataaataagaataaaaataccacctcagcaatcggttgccgtaccatcccgtgtcaatcagtgctcggagagcggaaaaatccgttttcttccaaccaccgttttctgtcatcgcataggaaaggacgtgactctgaaaatgagttgtaagcttttgcttgcttttccctgaacaactaactcactgtgaagtcgtggaaagtcaacgagggaccagcagagacaatgccattgagagcaactgaataatcaaatatttattaaatttcaaacgaaataaaagtctgggaaatgggtagtttcctgttctgaaggcacacctcatttttttttaaattgcaacataatagacctatttttgaggcataaaagcaacaatttacgccaaaatttcctcaaatgcatcgacgttacgtcgcttacagtcctcgcaccaaagaaactctcataaatacgagtccaatatgttgccatctttaaaaaaaaagtggggtgtgccttcaaaacaggaaagtaccaaatgaaattgtaacatttgtaagttccttcgagtcagaatttaaaataaaatgaacccaaaaaaataaatttatttttttggcttcgcacttgcaattgcactccatcgcttctcgtcatagcagggcaatgtcacgtgaatggacgggttgaaaagctcggaaatgttagcgttggcggaagcgaatgcttttggcaccggaaactgttgttgtcgctgatcggcaccaaaaaaaggccaacggcagaggaagaaatcggaggaagtggcgcaatcgcgcaacggtggaggaccagcagaaacagacgaatgagaagaggctaatgactgatcatcagcggaaagggggataaaaggcagcatttggtgttgactgactagagcctaagaaatggcaaagaaatggacaaaattgggtactttacg

SEQ ID NO: 28820 - DNA, 1607 bp, Heterodera glycines
  misc_feature (1529)..(1529): n is a, c, g, or t
atttccctcattcatcgcggtggtcatcaaaaaagcctaccacccggtaaacaaaaatgattggcatgatgaacaacgcctgcatggacggacccgcggagtttttcgcgggccgtcgcgatttgtgcgaattgcttgtgccggcctcgtcgttagcagcggtggacggccaagcgcagccccacgcgccaccgccgaaggtttttgagccgacgcagcagaaaaaactgagctacacgggcagtggccgacggttggtggacggaaagccagaagtgaacgaaacgccagaggaaatgtggcggaaagcgatgctcagggcaacctgcacaagagcagtgaaaggtggaggagaatagggggaaaagccaaaattagggggggggaatagggaaaaaaagccaaaagatgaaaattcagaaatgcttggtgagaaacgccgcaaaagctccaaactgagacaattgatcagcagccaaagcggatcaattcgaaacttttttggcacagccaaaaaccttcgccatcggaccaccggcgccaatcaaccgcagcaacaggttgaggccggtggcaaagtgatcagcagcagaacggaggggccgggaaagcccgatcggatgatcatctgatcagagtaaggagaggaggagaaagacagcgcaactgaaagccaatcagtgatcagtggagaaccaatcgccttcaccgaacaaccaaataacctcacatttctttcgcctttccctcaataataaactgaatacattctcattagatgggtgctgaatcactattttgacaaaatttattcaaaatttcgctcaaaattaaccaaattattaatccttgatattatttgaagccctaagtgttcactaaattgccttcaaaatttcataaacttttagaaaagttataaatcccaaaattatttgtgcttttgcaaaagttcttaatcaaaatattcatccgaaggccaaaaaggcaatgaaaaaaatcgcattttgaaaataatttaattattattaacagggcttccatttttatgtaagaaaaatcgcgaaatatgtaaataaaatatgtataaaaaatgctaaaatatgtatgaaatatgtataaaaatccagaaatatgtactaaaatatgtaaataaaattctttctaaagggtgaaataggcacgaattgtcataaaaatgacctaaatagacttagaatcaaatcatcttttagtatttaaaaaattaatttttgatatcccatttcaaaaaaaaaaatattttttttggagcacattttcacaaaaaattctataaattctcaaaatttttgaaaaaattgcgaaattttggatatttttgggggcatttaataaaaaattccttaaaaattctcaaaaaatgcaaaatatgtacgaaaaaatgcgaaaaagtccaaaatatgtataaaaatatgtacaaatgtaatatgtagaaaaatcccaaaatatgtaaataaaagtcccaacttttgttcgccaacacaaanaaagaaagtgtttttcccactatttagagcatggagaagcaggaaaaaaatatatatttacataaaaatgaaagccct

SEQ ID NO: 28821 - DNA, 1335 bp, Heterodera glycines
  misc_feature (1226)..(1226): n is a, c, g, or t
ttcgcgattttatatccatattttgacagccctagttatggccattatttttggccagcagaccattttaatcttccttttcgcatccctttcaaatatataatgaggtcaaaaagactttttcattcataatacatatcgcaaaaatgaacagacggtgaggaattcttttgaaaaattaaattttcgtttacccaattttttcccatgtttcagttggatttgtgcggatgtttggatggacattctgccatcttttgaccatgcccaactcggcctcaaaatggcattgctttccgaccgtttcgatgttttggtggacacgcattttgatggcaaaagcgaattcacaatttggagagcaatcgaaattgaaaaggaggaagggccaaaaccgaaaatgtttatacgaatcgatggcagttttgtggattttccgttgtctgttcgtcagatgcccaacaaaatttgctttaagaacctttggattgagtcagtcttaacttttgtgtacgctaaagcatttttatctttcttcagctacattgaccattccgtgatcaaatttctccgctccaagaagcgattctttgacaaaagtggcaccaaattggaagtgtttgtggatgcatttgatacggatgtccaaccgatttgggatatttttttccgtgaaatttggcccatttttgcgacaaacattcggcatttggcctttcacggtgccgatgctttggacaatttgcgtcgtcgcacatcgccgacacttctcactgatcttgttcaattgtattcaattacttcctatgaactgtgccccgatggaatttctgacgatgggccaaaagcaactgctggccaagcgttgtccaaatggttgcacacaaagagcaaaaatggaaaagcgaatgaattgtattgctgtgcttatttttgtgaaataacatggatcaacactttcaacgaggtgatcgagactacttaattgttcattaaacgattgactaattattgattgattgcatttgattcgtgaccggaaaatcggtcagtggaaaatgcgtcagtgatacaaatattttaaaataaatttctatggcattagtattgtaatataggactaaacttctataagaaaatcgttctcaatttccaaccccggacccgaactcgaacaaaaaatcgaaaagtcaaaatttcgaaattagattttttcttaaaaatcngtttaatacacgaaaacaaactataaagcatcaatactgcataagagatcatttatgctgtttttgaccaaaaatgctaattaaaaaaatttgtactttcaagtttttt

SEQ ID NO: 28822 - DNA, 964 bp, Heterodera glycines
  misc_feature (155)..(155): n is a, c, g, or t
atcgatcacaatcatcatttatcttcttcatatattatcagggcatcatcttcaaacatcattaattaggcacacttccgacactttattcggctgttcgttcattcattttcgctccctcttccccccccccccccgcccatataaaccttttntagcacaaaaaattcctcctcccaccgatctgaaaccaacttttgatcattcattccccttccccacgttccatcgccacataaaattgtaaacgcccataaaaccgttcttcttccatttcctccctcccccttttttctgtccatctcttcaaacatcagccgagtcgacaggacagcagcagagcagtccgtcattgactgatcactatcaatgctgctggcgactgatctccgtgccccatgcaccgatcagatcactcacaaactctcagccgtctctctctctctctctccccccttaactgtcctatcagtcagtctgtcggcagcagtcgtcgtcgtcgtgtcattgcaagtgttgtggtgtcatgtcataatcaccataatgatcatattatcactatcgtcttgcccccccccggcgcacatccgccgccgtaggcattctttagagcagtcagcagccgaacgctttccgttcgttcgtccatccatcacccgtgtggctgtgctgcggcgccggcagagcaccaacaaccagcggcgcaagcagtaaaaacgcagtcagcgccatcgccgattcccccccccccttttagcgttttcaattaacgcgtcgttttcgtttcgtcgtccgccgtcgtttgttgttctcctcctccattcactccttctctaattcccaaaatgttgtggtggtggtgttcgtcgtcgtcgttcttatccgccgcccgttcatttggctttttgtcacccataagcggataagagaggggggggggagaggataagaggggggggggggg

SEQ ID NO: 28823 - DNA, 1372 bp, Heterodera glycines
gaattttttttataattaaattaatagagagcaaaaaagcacgatgtataattattcaaaaaaatttatctatgcatttgttgaacgtttctaaacccgatggaatttttttaaacctttataggaaaacatttattgcaggaaatgacaaattccaccctgggggagcacacatttcagataagcttcctatcattatttcttagaaacaactaataatctgttgaccggttatttcaaaataaatcgaaatatattagcttattatgcatcttcagtgtgcattctaaaataaaatcatttttttgttctaattttatgatttatttgttttctgttgactaaatagtcagttcttatagcaaatattaatttatatttgcgtagcttcaaatgagcattctgccttcaatttcgaagggaagtgaatttttttataataaattgatagagagcaaaaagcacgattgtataatattcaaaaaatttatctatgcatttgttgaacgtttctaaacccgatcgaattttttaaacctttatatgaaaacatttattgcaggaaatgacaaattaacctgggtgagcacacatttcagataagcttcctatcattatttcttagaaacaactaataatctgttgaacagttatttcaaaataaattcgaatatattagcttattatgcatcttcagtttgcattctaaaataaaatcattttttgttctaattttatgatttatttgttttctgttgactaaatagtcagttcttatagcaaatattaatttatatttgcgtagcttcaaatgagcattctgccttcaatttcgaagggaagtgaatttttttataataaattgatagagagcaaaaagcacaattgtataatattcaaaaaatttatctatgcatttgttgaacgtttctaaacccgatcaaattttttaaacctttatatggaaacatttattgcaggaaatgacaaattccaacctgggtgagcacacatttcagataagcttcctatcattatttcttagaaacaactaataatctgttgaacagttatttcaaaataaattcgaatatattagcttattatgcatcttcagtttgcattctaaaataaaatcattttttgttctaattttatgatttatttgttttctgttgactaaatagtcagttcttatagcaaatattaatttatgtttgcgtagcttcaatgagcattctgcctttcatttcgaagggaagtgaattttgtttatataaattgatagagagcaaaatgcacaattgtataatattcaaaaaaattatctatgcattttgttgaatggtcctaaaccccgatccaatttttt

SEQ ID NO: 28824 - DNA, 1159 bp, Heterodera glycines
  misc_feature (51)..(51): n is a, c, g, or t
  misc_feature (70)..(70): n is a, c, g, or t
  misc_feature (75)..(75): n is a, c, g, or t
ggttttatccctatattttgaataaaacaaattcattcctcctaggtgtanttattttttgagtttattnttagngccttcttagagttatttgtataaaattaaaattttttatttataaggtaagaattgttttatgcaattgattttatctataaagattatgtcatattgtgtatttttatatttatatttaatatatatttaataatgtttttagtatctgactacatttcaacaatactctaaatcgaatttttcctgtaataatatttggtggatagctatataatattattttcatttattttattatttaatttttattgattatgtattcaatccaaaatataatttacaaaaattttcatgcaaagaaatataattaacttttattatatttattttctttattaccttatatattttttaatttatattattaaataaatttcttttttattcttataaactttgaataaaaaatgaagttgttttcagggcacttctggaaactgagttttcacaatttataatcttttaaaagattatattttaacatattatctattttttataacagattttcattaggttttctcatcaaaaatttattctgctattttaaaatttaagttttttcgaattatttttatatttttaaattatttttctttatttaaaatgccttttttatttattactcatttaatattgtaattataattttttttatataaatatttttacattatataataatattattgtatggctgtgttggcgtcaaagtgataagtttattaaaaatttggaaaagaattttttatctgtaaaataatgaagataaaataattacacttaataaaaattttatgcaaaagttctgttttaataattaattttgtttttcaaagcttaatttttcctcgtcatataggcggtatatttcattatattcaggggataaaaaatgcaaatttggcgaccgacgaaaagtgataaatttgctaaatttttgaataattcaactcataacttttcgcagacgcaaccaaattgcacaatcttgctatcataagatagcccttgaattgctatattaatttgctaaatttcaaaattttattaagtttttcaaaagttatcataaatgaaa

SEQ ID NO: 28825 - DNA, 967 bp, Heterodera glycines
caccgatcaaactattactagaaatcgtacataatcggtacaatttgatcaattagtctaatgatctcagatcgtaaaagcgatacattggaagattaaattgtcatcttgcgttagatagatcagcaagattgggcaataatcagcgaaattgttgatgattggtgtctttccctaatattagacaaattaactaacaaataaatgttttaaatgagaatcgtcaaatgaatccttttagtgatcatcaagcagttgatcttttgggttcctcaagcaaatcagttcattattttatgaagctaatcacttcgaattcattcggtcccaaattctgcagaaatgccagccggcctccctccgccttgttgacaaccaacagttccaaatgggccaagcaatgcgcgtcgaatctgcttccctttggtacacttttgagcgtcagttggcccgtctgtacgtgacacggtggaagggctttcgagtcagtcgttccgaaaaatgccattttttattacgcaataaataaaattcattggtgccgaaatgcccgagggggtgcgatcttagctttctctatcctggtcaaatcgtttctttctttgtattttttttgctgtcagattgaccaaatggtggccgtcacttgtgtgttcgagggcaccgccgaggaagtggaaaggcagcagaaggcactgataaaattggctgatctgttcggcggaatggacgccggcgaggaaaatggactctatgtacggacgccattctttccacttgctaacaagatcttttaatccaaccgaaccgaattggcaaaaaatcaagacgctcacaatcagtttggttcgctgcggcgctcgagattctcgagtcccggctttaatccacgttttgtttccctgaatccgctttgtctgttcccctccggaagttgccctgcttttagggatatcgactcactttt

SEQ ID NO: 28826 - DNA, 1563 bp, Heterodera glycines
ggggccgaaacaacaagcagtaccacctcctcaaccgccaccgtcgaccgccaccgtttccgtttatcagacagtggtcgaattacttgccgccatgccacggtgtcccataggcactttggcatttgccatttccacccaacaactgtttttgcgtgttcactccggatggcaacaagtgctggtgagtttctgtcggattgaaagcaccggttattgattgatcgggtaagggctttttgattggtcggaccgatcggctgaataactgatcaatgcacttcatcaaatatatgatcaatttaattgctttgtcttggtcaagttggacccaaatgtgctgactgatcatcgtccggtggtgccgtcgccccctcggctccttccgcccgcttcgtccctttcccatcgtccgtcttcggtaattgtcgtcccatcattttccatttgcttcatttgtcccatttccgttaacatttccttcgttttgcttttccttttcctcttaatgctttccgtccttttccgcttttccccattcgttcgcttaagcatcattccgttccgctgatgccttccgccgactccgagctcagtcggctggcttattgggtgggttatggcacttcgcactgcaaattccctttcccccaccgcttttcccccattaaccctttgatccttcccccaaaagttggcgttggatgagccgagcggtgcgcgagacgatgaagagagtgtggcgggagaggaggacgaggaacaaaaagaggagggagagagtgtgggagagagagggggagagggcgtaagtgacgggagagaagggccgtgtaggaagcggagctcagttagcgcttcttttcttctttttttttgctagtgatactcgggaacggactctcgacaaaagcggagggattctcgagactcgggactgaaattgccccccccccccgagacgaccctttttcgagaatgagttccttcccgagtatcactattttccttttcgtttgcgcttttcttttcttttttaaattaatttttggaccaaatttaattcaaaaattaattaattaacaaattcaatgctttttaactgcaaaatgcttttcaaaatgcccattaaaatttgctctcagttcgccccaattggccgtcctccgccgcccaccgcccctccggcgccgcacagccgaagcattgcgcagcagcaggcacagccgtggcgcattgcgccagaacatttgtcgcccaaggaatggaaagtgccgcgcgaggaagagacggaaaagacatcgatcagacacaaagacaaagtggtgagtcattggggggatggtgggtgagaggtgagagaggagaagggagagagagagagaaagagtgggtgattaggagagagagaaagggggagaggagaggatacagacaggaggagagagagagagagaaagagtgtgtaaagagagtgattaagagaggaagagagagagtcagaagtcagagagatagagggaggggggagggagagaatttttgggacattttggcaatatt

SEQ ID NO: 28827 - DNA, 882 bp, Heterodera glycines
  misc_feature (747)..(747): n is a, c, g, or t
  misc_feature (765)..(765): n is a, c, g, or t
  misc_feature (812)..(812): n is a, c, g, or t
  misc_feature (819)..(819): n is a, c, g, or t
  misc_feature (875)..(875): n is a, c, g, or t
ctcttttacaaattttaatatccgtcccaatgatgccttcttgaaagccaattccaatgacccagggcattgttcggagtgaccgacactcactcgcgattttccatttccttttcttgcatttccactcaatttacgagcagccattttttgtgtcaatatgtgatggaaacgcaacaaagtaaaattataatgttactttttcagttattagcgcctgttttctagatttttattttgaagcctaaaaactttaaaaaaaattttgaaaactatattttggcgtttttaaagtttatttaaaaatgcaataaaaataattcacccttgaaaatcgaccccaaaaaattcttctgcaaaattaagtgaaaaatcctcaaaaattattttttagatttaattcttaaatatgagtagtcagcaacaacagttggatgtgcttattgtcatagatggtaccaacattgataagccttgtgtattttttgatcttttcaaatttcaacatttaacttatttaatttaaaggttgatattttttcgagttctggctttgttgcttcttgtctcaattgggtttcaaagcttcattctcctaatgtaattgttgcgttatccaatcaaccgaatgatgtagcagccgaacttttaaagtcggtttatataaatgaaataaaaaatgtttcaataacttacagaaaatgggcttctaaattcaagcagcttcaggtactacttttattttanatttattaaatgttctanatgaacttaattttgcaggcatttggtgtttcaattgccaatctttnaacgatngtcttcgtgaaagtgattttcgacaaatcttagaaatgatttcatgctcatacaanatttagc

SEQ ID NO: 28828 - DNA, 1117 bp, Heterodera glycines
ggccgcttcgcgaccgttttttaaatttgtttgggccagacgggcgcttcgcgcccgttttttaagttagggctagacgggcgcttcgcgcccgttttttaatttggtgatttttaggccgctcgcggcctcgtacgggcgcttcgtgcccgttttttaaatttagttggggccagacaggcgcttcgcgcccgtttttcaaatttttttgggctcggacggacgcttcgcgatcgttttttaaatttgtttgggccagacgggcgcttcgcgcccgttttttaggggtacaacagtgattagaagaggtgcaacagtgattagtaaattcattaaattaaaatgaaaatttttttaacaaattgaattaagaaaatacatgaaatactatcaattaaaaaaataattaatttaaacttttaaaatttattcatcaaaaaaaaattaatttgaatataattttttatttattaactcaacaaaatattttaatttaattaaaatcattgaaaataacgtaaaaatgcacagaaaaataatatacaccgtccggattcgaacctgccgccccccccccgtcagaacatgtcccagaatccccaatcacacagggattctgaggtcttgacgatgtcaaaagtaaaatctgatcacgtattcgtgatcagcggcccaaataacgactaaagacatgtttttggaagattttgggtgaaaaaatttttacactcaaaaatcctgtccaccccctttggtcccgaagcacaaaatcacttttatttttatatcttttttgaaagaagtgataaaaataccaaataaaatttatataatagagcaaaaaattgcggatttttgtagtattttacttttcccgaatagcttttcagaaggcagctacgaatttttttctgaaaaatcgaaaatttccagaaattctggaataacttttttcttttttgtgataacaaactcatataaatcccataaaattctctttatttttctctatttttacagctttattatagttaaatcgatgaaaccatcaccgagctatgaatattccaatattaggtcaaaatcccgaggaccaaaaaaattaaaaatattttca

SEQ ID NO: 28829 - DNA, 1208 bp, Heterodera glycines
aattataatgaatgaaaatgactctttagcaattcaaaccgattttgcgggatgattttttcggtagcagcaaaaaagagaaaactaatggaaattccattgatggaaaaagagataaaaaaattcgatgacaagatattttgaatgaaaaattgaaagtataaaagaacagtaatgtgttaatggactaactttatttaattttgtattccgtacataatttctttacaatattcaaaaagactttcctgcgcgcattttcaaaattatcttcaaaaaatcaaaaatcaatttgttcagataaaatttcaacgaattttcccattttctccgtcacggcatcggcagattcattcttttttataagggtaatggagtcaattttcaaattattttttagcatcagtcgtgaaaacttgtattttaaattcatctaagccaaacaaattaatgaaaaaaatgtaataaccaaaaaaaaaagaatgattgcccctgatcagaaatttgttttttaatttaattatgaatgtttaaattatggccatgacggcacaatgtcctacatatttgttcatagattaaaattttttgacttaattataaattttttcacagtttctttttatatttataaacaaaatttttaaataaatttaaatttcaaaagaaaaaagaattgatcaaacggtgccgccgagaatggcctgataattttttctaattaatgaaattttaccatttcaataaaaaattccgtctttgtgaacagagttgacccattattcgtgaaaactctactgtttgtttaaatttgaaattaatttttctgacttttttaaacaattattttttacaaaactacgtcttcttaaacaacgaaaattctaatttatttagcttctaagttgaaaaaatttctgagttcacttgaaccatttaatttgggtaacaagccgatattcaccaagcatattcctttttatttaatagttggagtcaatcttattcgtcctgctgctgtccgacattttcacttggatttgttcaaatggatgatgaataataattgaaatcagtcattcgttaaatgcaaattcaatcattttagcaaaatgaatagtctagaattatataactgattaaaaaaatttttaatttcaaaaattaaacatttaaattattcccatctttatttaaaacattcatat

SEQ ID NO: 28830 - DNA, 1712 bp, Heterodera glycines
tttgaaggccataaatccggatttgaaggattcgtaaaaattctcaagcaatatcacttgtcaaaagctatgaaaaaaaaggaaataaagacacatctacatgaacaacttatgcataaaggcatacagatttctatatgcactttgaaacgctacctgcataagataaaaattgtttttgcgcccacaaaagataatgttgattcatcacctaagcttgaagtggaaaaatgcttctccaaaaagctgactaacactatttatataattggaaatggatcaaattggagaaaatccgcgctcttttcgcgattttttgctgctttccgttgaagaattttccccaaaaaattttaaaaatgttaaaattattcactgtaattttaaattattaaaaaataatttaaatttaatctattttaattgaataataattattttaattaattattatcattgatacttttttaggatcgccccattgatacttttttaggatcgccccattgatacttttttaggatcgccccattgatacttttttaggatcgcccacattgttaatttaaaatatcgtttaaatataaatgatagttataaaaaatattttttaaatgccttttataattttaattatttggtgctgaaatatttgtcgccgagacggactacaaatcaaaactaatacaaataatcaacaaaaccatgtgtgctttacttaattgaatcgtagatattattattaaaacattaatttttatatcaactgaaatatataataaaaatttatgtgatttttcttttcacaacaacgaaaaaaaatgcaaaaaagaataattttataattaaaatataattatataattgtttatgaatgattaaatctaaataaataaaggttgttttcaaaaatctgttctatcctaatgatattgcatatttattgataagctgcgcgccgcaagcaagctcatggaccatttgaacatgagacgaaaatagactcaaataaaaacaaatttaatttattcagatttatattcgaattactttaactaaatattttaaaaaaattttctttacaattttattttgtaaatttcgaatttgaaatagcttagttcattaatttgattacaaatattcaaaaaaatggaaaaattaaaaaaaatcgcaaattaaaaaaaaattattaaatttgtttaatttttctaatataatagagatttaatgcaattatgcatttgctcttggtctgactctgcttgtaggatagccttttattattgattttgatatatgatttaatttttattaatcatttgatttttttatgattgtttgtgtcaatcaaagaactatttaaagaaattaaaatatgtaattagtttattaatcatttatattttaattatttttctcaataaataaatttactgacttaatttataatttttttttattgcaaatataaatatattttttaaactcttgacgaaaaacatcttttctgccatttttccaccgagagcaattcgttaccgtcccattagatatataaattaaattactgatttaatactttattttttattataaatattaatatttttaattcttttctacattcatgttatttaagtggtgaaatgatttgtggaatttaataatttagaaaattacatttatgtaagtgaagaaatattgaccta

SEQ ID NO: 28831 - DNA, 970 bp, Heterodera glycines
  misc_feature (924)..(924): n is a, c, g, or t
  misc_feature (932)..(932): n is a, c, g, or t
  misc_feature (934)..(935): n is a, c, g, or t
acaaaaacaaaaaaaatgtgaattggaaatgaaatgccgagatttttcggacaaatttaaattgggcaatttaatgtttgactgttcgaagatgagacttcgaaattttcagtccaaactgaacttgattgccttttttgggaggaggtggggacagaaattcaagaactgattaattctggatgagaccagattaatcagacctccccttggaaaaaaaattgaacccgcctgtgcacaataggtcgccagttgtccggagcacgtcttggtaaatggggttggccggcgcgctgagacgtgcaccaagacagtgcactcaattggtcctcgatgcgtcaattgtccgatgcgtccaatgtccaattcgatgcgtccaatgtccgaattcgatgcgtccaatgtccaaattgttcggctcgtccaatttgcaatttgttcggctcgtccaatttccaatttgttcggctcgtccaatttgcaatttgttcggctcgtccaatttccaatttgttcggctcgtccaatttgcaatttgttctgcgcgtccaattcccaatttgtccaatgcgttcaatttgcaatttggtctgtgcgtccaatttccaatttgccaatgcgtccaatttgcaatttggtctgcgcgtccaattcccaatttgtccaatgcgttcaatttgcaatttggtctgtgcgtccaatttccaatttgccaatgcgtccaatttgcaatttggtctgcgcgtccaatgtccgatttgcgcgatttgtctttgtccaattgtcggcgtcaatttgtccaatgtttcccgattgtccggcgcaatggttgtccgtgtcaattggtcgcagtggtcgaattgagtcaaattcccttggtgaggtgagaatgtgatttgacgaaatgagtgaaaatcaaatgcncataattngnntaatgggtttccgctcttttcaaaagtttgtgatt

SEQ ID NO: 28832 - DNA, 1245 bp, Heterodera glycines
tgctgtttgcatatggtaacaaagcaaatattaaatacgctctcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaagatatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctatcgcgctggcctgatcaaatgaggtggctcttcatgagcatcctcgtttatggccggcccagtaatgccgtcgaattatggaacaagtacaaagaccaaatgtactttcctcaaggcattaccacaccggcacaacgccaagcagcagagcttgaagccctagctgacattgattggcggctgcacagctgctttaacttaagctgtgcattttagcctgccagacccgccaaactcaattgccaaaaatacaaatgcggcaattgatgaatttttctttggcgatgatgatttgaatttgccgcctggccaaccaaatcctcggcctcagcaaatcactcctccgccactcaacagcgaccaacaaacggtctttgatgctgttgttaaggctattcagtcggacccaagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatggg

SEQ ID NO: 28833 - DNA, 1459 bp, Heterodera glycines
  misc_feature (113)..(113): n is a, c, g, or t
  misc_feature (1392)..(1392): n is a, c, g, or t
aaagaggccaaacggacgcacagcgacctcaaatcaaaaaggcgaaaccgccccaaaaaaaaaacgtgtccctaagatgggcgttcctcttttaataacccttctcaatcatntagcagatgtttctgtaattagtaacagttaattgcctttgtctaatccttttgccattcatttggctttgaatgctttccttttgtcccccctttttttgctcgtcggttgttcagcgttatttctaagaataaaggtgaaaattaagtcctttcttaggcttcacttcgttaagctgggcagaaatccataatttgctatttaatgttttttttcgttggcgaaatgttttatttattgttttcagcgattggcccttttctcacgcaaacgttcgatgctttttgttggtcctggggaactttgtccgattcccggccccgcctcaacgaaaagcggacacatggccaaaggaaggaaagcgaagtcggcccagaaccaaccatcgaattgagctaatagaataaccaaattctgatgcaattttgatttgtgcctaatgaatgtttttacccttttcataaaataggttaacgataaatgagcttaattatctaaaggattttattattaagattaattaattaattattgtacaatgacaatgtccttcttccattgtcaaattgcctttagtttatcaataataattgacaaatgtttcattccccgtgatttttttcatcccatgacccatccaaaagcaaataaaattgaaagtgtgacgttatttggacgggggatgaaatttcaaattaaaattaatcaactgatgactgaaaaaagtaaggagagaaaaagaacgtccaattgggagttaattaccattgtattgaattaactaattattggcaattaatagttggtcctttccccaaaatgaggatgattcttctaactaaaaattcggacatcttaaggactgtactgatatgaagttcaattgcaatcgaaaaactcaccaaacttttgcatttgaccatgaggtgaataaatattcaggcaaatctctcggaaagtgagtcgcgcacacgaagagcagcgcaaagtgcaggtcgtttcggcacaagtgcacacaccgttctgaaggcacacagtctcaatgacctaattgggatggggatgatcagctgatcatgatgagaatatgatcacatcggccgaaggctgtctgcttcggtccaacaccatcatttgcatgaaagaattccgcgaattcggagagccctgaagggatttgggaagaaagaactttgtgtttcattacactcaaaattggcaaaatgttagaccggcgaatgcgcagaatcgagtcgcgtcagaaatgacttcgcgtgnggtccagatgaagcaaattgtccattttggtcggcttcccctccgaaccatccccccgttgatgctg

SEQ ID NO: 28834 - DNA, 956 bp, Heterodera glycines
tactacacatctacataattgtacacaaaatgccaaaaaaggatggcattttcgttgtacgttataggatagaaagagagagagagagagagagcttttgcaaactttaaaatcactgtatttggcattctgtatacagtatgtattttatagtgtttacgatctttgtgggtcttcaaaatcgctgctcccattcccttttttggcattctgttcagtatgtttttgtgtgtgtgtgtgtgttgtgggcttttgccattttaatcaaatccaaaaagaagacactttctctctacatattaaaattttttgtatatttttgagaaattaaagaaaaatttgaaaatttagctcttttgaaaaccatttaaaccagaaacgtaattcttcacaaaaaaacgaacaaacaaataatgtctgacaacaaagaagaactcgtccaacgggctaagctggctgaacaagctgagcgctacgatgacatggctcagtcgatgaaaaaagtcggaaaaaaacgaaaatttcgatgaatttttctccgttgaaggttacggaattgggcgccgagttgagcaatgaggagcgcaacctgttgtccgttgcgtacaaaaatgtggtcggcgcgcgccgctcctcgtggcgcgtcatctcgtccattgaacagaagacggagggctcggagaagaagcagcagatggccaaggagtacagggagaaggtggagcaggagttgcgcgagatctgtcacgacgtgctggtgtgttgaacaataaatcgaattttttggaaattttggacctaacttccgccaatttttttcaggatttgctcgacaaattcctgatcccaaaggctggcaacccggaatccaaggtgttctacctgaagatgaagggtgactactaccgctacctggccgaggtggccaccggtgacgaccgcaacggtgcgtgtgt

SEQ ID NO: 28835 - DNA, 1657 bp, Heterodera glycines
ttttcctttcagtatccctgcaaagtttggggcgcttctgataagtttctgaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttttaaatgagaattcatgcgagattttctggaaataagcttaatagggccttgttaagctgtaaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctgaagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagatttccggaaataagcttaataggtcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaaataaaatagtgaagttttaaaaattaataaaaatttttaaattaagagttactggcgttagcatcatagcggtgcttttccttgtctttttgatgcccttgcaaaatctggtgcgcttctgatcagtttaattaaaaaaagttaagcctaaactttttggcatgtttaaaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaat

SEQ ID NO: 28836 - DNA, 1993 bp, Heterodera glycines
  misc_feature (692)..(692): n is a, c, g, or t
agaatttatgtaaaaaataataattatcttttaataaacaatttcatattttttttaattgaatttataaaaattaatttcatattaatttaaatattcaattattgtacatttcaaaattctctttttaattaataaaaggaataattaatttattttttaaaatttataataaattgcattcaatttttgtacctcttctaatcaatcacagttgtacctcttctaatcacttttgtacctcttctaacaattttgtacctcttctaatgactgttgtacctcttctaatcactgttgtacctcttctaatcacttttgtacctcttctaacaattttgtacctcttctaatgactgttgttcctcttctaatcactgttgtacctcttctaacaattttgtacctcttctaatgactgttgtaccacttctaatcactgttgtacctcttctaatcactttgctaatcgctgttgtacctcaaaatttaaaaaacgggcgcgaaacacccgtatgagttcaacgaatttaaaaaacgggcgcgaagcgcccgttcaaggctaacaaaaattgaaaaaccgggcgaagcgcccgactgaggccgcgaagcggcctaacaagctaaaaaacgggcgcgaagctcccgtctgaggccgcgaagcggccttaatagcccaacaattttataanacgggcgcgaagcgcccgtataagcccaacaaatttaaaaaaacgggcgcgaagcgcccgttcgaggccgcgaagcggcctaaaagtcccagataattttttaaaaattcaaaatctccacaaccatagcttatctaggtagcgaagctcccaaagcgcgaagcgctttttcccagctaaatagccgacggttcacgcacccgctagttactatatatgttatattgacaaggagtttcgttgctaaaaccattttctcccggccgaaggccgggagcgccctgaaagtagtggaagggtcttacaactttttgaggcgcatccgggaaaactatagaaaaaaattcagcgcggacgactgagtcccagggacggatttctcactttttcttgcagtttttcttctacgaaattttttctttggaccgggatcgcttagctcttgctggtaggattttaagtcagactatccccgacaactttgccagcaaaacctaagccctacgttgggcgcccaaggctgtagccttggctaattttttttacccaaaagtgtacacttcagtatcaggcgaataactcgccaggggttgctttgaacgaaaaattgtttctgagcaaaaatgtatagtatttgaaaggctatccaaccaagttttaaaatttcgaaaattttcaaaatttttcgagctaggcctaaaaaacggttttcgggtttttgaattttaagattttttaacgatttttcccgggaaaacggagaccacttccaaaacatcgtttttcgagctctatcgactggtattttttccggaaaaatttcgattttttccaggaaatagaaaaaatttttggcctgagcgggacatttgagtcccgggtccataactcgttaggagttggttttatcgaaaaaactccttagggcaaaattgtagagtggggtaagctctatataatggtatactatatgaagggaaattttcaaaaattttcgagctaggccccctagaaattttcaaaaattttttttgggttgaaaaagagggtttaataaataaaaaattatatttaatttaatttttttttgataaataaattttataagtttaaattaattatttttttgattgatagaatttcatgtattttttaaattaaatttgttaaaaatattttcattttaatttaatgaatttactaatcactgttgtatcaatttatatttaaagatttgttgtaaattaataataaaagaatttaaaggaaaaataacaattatcttttaatattgtgcctct

SEQ ID NO: 28837 - DNA, 998 bp, Heterodera glycines
cttttgactatcggaccggaatcattggccgggcatttcgaagggaaaactttcagtcggcacattctttcattttgtcctcaaattgtccatcgaagcatcgcagtaaattcggcagcagtgattccctctctcgcatcagcataaatctgcacaacaccaacaaaaacaaacgctttgcccccgatgcattcatcctcccctttttcatcctcccccatttcttcttccattcccttttcttcctcctctttttcgtcttcctcctcctcccattgttcgttcccttccatttcctccccttcgtcccgtccttctttttcttgcgcttcactttttcccacaaattcggcccaaaatgtctctgatcagtcccaactgaatcatcaacatcagcgggaacaagaagaagaagaacaagaacagctcattcgactgctgacagtcacttccgactcttctgccgatggccaaaaagagaagcaaaaggaaaaacgaacgcaaattccaagcaaaggttggaggaatttaaaaggaaaacggaaaggcaaaattataacgaaatgatgccattggcaggcaaattaatcaccgctttgatcgctaacactcgccggtgccgctcccgccaaagtcagttgggttaactctcaatggccattcgaaatttgtggaatgttgatgctaatttaagcacatcagaaccaaatgacgcagttcagcgcgagctttttagccgggcaaaacgaacaaaaattaaaagaaaatgagaaaacgaacagcacaagaaaaagaaaacgagaggaaaaggagggagaggaagaaagggagggacagaaaggagacgaagagtttgagagagaagaggaggaaggtaataaagagagagagaaaagggaggagagagagagggggaggagagagaggaagagaagggggaggagagagaggcgggagagagatagaaagatgagagagaggagggaaatgggagggag

SEQ ID NO: 28838 - DNA, 1496 bp, Heterodera glycines
ctttatttttctactaatgatttagcaaattttaaaattaaaattgttcaccaaaattcctccttccatttggcagtcgattagataacagatcaactcagcgataaggtcgcaatccacggagtcttcccattggcggccaccagcatccaaataagtctaaaattatctactttttatgagttggatgtaaaaatcaagctaacttcgatcaaagcgtctttcgtaatgcatttgttcaacacttcgcgcacgcgtcgcacataggtgggcaagaaatgcatgggacggtctctcaacagagcactcaatttttgattaattcccttaaagttttctcttcaaataattgggaaacaaatgcaaaaatacaggctctgctgaaaatgcactgcaatcattccacaaaaagaagccgtccaaagaggcggcggcagcggtcggtgaaacgaaagggtccggcggaaccatttgaagttgggggtgtgtggtggggaagcattggccggaggggaaagaagtgaagccccagggagaattggaaaaagagccaaaacattgtggccgaggttgggaagaagcggcgaatgcgttgacgggcacagcggaaggaaacagaggaggcggaggggcagggaaattctgctaaattggaaaatattaaaaaaaacaaattaccaaagccaaacgcaccgtcatggatcgctcgtcaaacattccgccgtagtgggaactcggcatataaccggtcatggcaagcatttcagccaaatgatacacttccacggaaaacaattgagtaggcactgcaaaaacaaaacgattgaaaaggatgtgcccaaaaatagaaaattcctaaaaaataaccatcgacgcatttgatgcccgtctcgcgaaagtatcgcatgaatttgttccgattgtcgcccattgtggccgacatcagcacgactttcaggtccttccgttttttcagcgcttcgcgaagtgcaatcaaaagatagtccgtgttcgtctcgcgctcgtggacttcgtcctgaatttttgtggtcagcattttccatgtttaaaaattcccattagtttcagcaaaacctcacaagaatgacgtgggtggcttctgtggccaattcgtcattagtcaatttgcgcaacaaaacgccacttgtgcaataagtcaaaagggtttcggcggagcaactaaatttataattatttcaaaaataaatgtctttaggatcaaaaaactgttttaaaattagggacaaaaatcgcagaattccattgaaaaactgaaactaagccaatgtcagaggccatactttgactcaagccgaatgtgatagccaacggtggcaccgaaacgctcgccacgttcgctggccacgcgtcttgctatggcaattgccggcagacggcgcggctgagtgcaaaaaatgcgtgtcggacgccactaaagggaggcattatccagcagaaattggggaacctgaaga

SEQ ID NO: 28839 - DNA, 893 bp, Heterodera glycines
cagcttgctgcctgcggtcgccacacccttcaccgcatcatcgccataatacacaccgtttcccccccccaaatgttcggtttgtccgtcgtcccccccccccctccccctcttcccgaggtttcctcatgaaacagaggcatcggaagtgctatccctccccctccccactttcttcgaccgtcgcttttccctcgcgccgctctctctgctaacaataagcactatctctcccctcagtcctccccccccccctccttctcccgtccattgaaaccaaaccgtctgaagcggcggcgaatgatcgctccgtccgatcattcccttcgctaccgcacctcttttatcatttttgggattccgtttttcaattctgtgtggtatgggcagaatgattaatcaaaattcacttaattgccctcttttggcgataattttcccattgaaaattgaatgtccgattctttaacagatcaaatgttttggaggcataattaccatttcttattaatgaccggccaaccactgctcactttgttgtcagtctttgctcttttgttggccaatcagccgctgatcgaatccgctggtcagtcagtcgttcgctgatcattctgatcgcttcccctcaatccgtttgatcacttttgctgatcactttcttccctcctccctcatccgttttcaccaattccccccccccactctctgaagatgcacctgctgcaggagttgacctgtgcaaacgccaacccttccgtggccgctgtccgcccggtcccaatggcgtccaaatgcggtcccaatttgtgcttcgctattacgttcgcaacggggaatgcatctcctaccactgcggtatgcccattggcactttgacatttgaattttcg

SEQ ID NO: 28840 - DNA, 1738 bp, Heterodera glycines
  misc_feature (1720)..(1720): n is a, c, g, or t
atttatatatttatctctccttaaaaaaactcagggcacataccatgatgaaaaaactccttggttcaacagtacgctacaagtgtggattagttttgaaatttaaaaattaaaaaaattgaaaacattggtaattatgaaaaatatttaaaaatatggttaaactatcgcatattttttcttcttcttttttaatgagtggagcaagaagtgcaataataaaatacctaaaataaattatttgtattttaatatttatttaaattttcaaggccgacgtgcgtggtcaacagttggagtcggcccacctagtgcaacgctcagactcaacgactttaaaaatgatctgaaagcgaatgatgtgcgcttgcaggagatgaaccaaatcgcgatacggtcagcagaagatttttggggggtttttcatttaataatccgagcattggatgaaaaggtgggggcagaggcgtaagtggcatgaaaattttttgaattgtgctataaattgtaatctctaacctctcatatatgttgatggggctcaacattcgctgtcatttgacttggcccatccgatttcttgtctttgaacaaaattttcttaacgaaaagccacgggggatgggatgaataggtaaaaaggaaggaagaagctggtggacttttcattcgtgtaatcattgatcaattcaaaaaattccgaagttttagttttgagtttaaaaaattatctattgagaatctgtattaattttcacacattttatcgctatttttctcccctcacacttcggcacattccgtgactatgacatgcattttcaaaacacaatttgcacaacaattaaataagtcacaatcgatggcaaagttattttttaataaatttaacaccggccagtaagaaaaatggtgagggcatataaaaaatatataaataaaatggacacaaatagaaaaaattcaaaatttggcacaaccatcaaagaaaatttatgcaaaataaaagatggataatctgagatctcattttgtgagttgtaacagaaatataaattaatattactttttttattctagttagtgtattttatttatttgttcattttttctatttttatttatcaattattatgattttattgcccgtttttgagttttaacttactacccagattgtcattgcaaatactaattatcatttacttgccaatgcccttcccgttgacattttactggtgttacatttgtcaaatgtcataaatttatcatttttaatttttaaaaattagaatttttctgatgatccgaaattgtcccattttattaaatttcataaggaaaaaaacattttcgtgccaacttcctctcccctccctttctcaaaagaatgacattcgcatgagggacttttttttgcccatcttctccaccctcgccgaccccgcgtaatttgtattgtcgtcgtaaagcaaatgttgctaagatagtgttcgtgccagctgccccctccctcgcattcattcggcacaaaaaatgtcatttgatttggcccatccaattttttttctttaaacgaattttccttacaaagccacggcggatagcacgaataggcaaaaggaagaagcagccggacccgcttctattgtgttgtgctggcattttgcgacaaaatatggagattaaaacaatagaaaataaaaaattttctcaaaantttatcccccaattttat

SEQ ID NO: 28841 - DNA, 595 bp, Heterodera glycines
  misc_feature (52)..(52): n is a, c, g, or t
  misc_feature (56)..(56): n is a, c, g, or t
  misc_feature (59)..(59): n is a, c, g, or t
  misc_feature (64)..(65): n is a, c, g, or t
  misc_feature (70)..(70): n is a, c, g, or t
  misc_feature (75)..(75): n is a, c, g, or t
  misc_feature (91)..(91): n is a, c, g, or t
  misc_feature (468)..(468): n is a, c, g, or t
gcctacacctcaaaatttttaaaaggtcaacaaggggcttacaaggagggantttntanatttnnatagnataanagacccataaaggtanttttttaatgaattttgattaataatgtaatttttatgaaataaaaatttggaatattgttgatatttaaaaattttgaggtgtaggcccaaaaccgaaaagtaccaataattacttatcaaatttcttgttttatgaattgtaagaatattaaaagtgaacaaaatatgttcttgtgcgccatgcaatttgttaatatatagcaattgaacctcataaaaagactaattagtgtggccagcctcgatggtcatcttcgaatgccaattaaaattaaaatattttaaatacttcaattaatgatacagaattatacgttgtttcactcattttgattttttttttaataaattaatgccaatgtgaatgatgaatgnaatttttatttgataatttttatttggtaatgaatgtaaaagaaaaaagtagtagtgaaaatagttataataattatgataattgaattgagaattaattaatgaaattatattttttatttagggt

SEQ ID NO: 28842 - DNA, 912 bp, Heterodera glycines
cacccccctcccccccccctgcccaccccatgcccacctaaaatgttgcgttattttttatgaaaaaaataaaaatgtgataaatataggtgaaaaacaaaatcaatttcgaaaaatgtgctcgttgagccttctctgctggttccatgttgaacagccggccactggctcttcctccagatcggggtccgccggcggcaccgctgcctcctccacctccacaagcatttcttgcaccggctcggccctggcccgcttgcgcaccggctgctccagcccatcgctctcgccgccagcgtcatcactgttcgcgtccgcctcctcttccccctcctcctcctcatcatctgtctccatttgctgcgcctctgccgaacaccagccaaacggtcgcgtgcggatggacagaggcgtcggcgtgaccgcttcagcttcttcctccgccgcggctgcctcgcctcccgctgttggtggtggtcgcaggacacgccccttggtgtagacggggcggtacacgcgggtggagcgacgcgtgaagatgtccgcctgtcgagtgcgcacaaagcgttgacagggcacggcaatggtccgctgctcggtggccgcctccgcaatgtcgcctccgcccccaccaccatggttggcgcgctgctcgggcctaagaaaaaaaaaactgtgcatgagtgtggggtggtggtggtggtgcttgtgcaagtgtcgtaccgatttcggcgcctttacctgccaaaatggttgatgaccagctggcgcatccgtccgtactgcagctgttggtccgccgcgtaggtgagctcaaaggatcgcaccttgcgctccgccctcaggtcctggcccgtgcgcgcgtccacgtgctggaacccgtagttcttaggcccatcagcgaagaagtcg

SEQ ID NO: 28843 - DNA, 1442 bp, Heterodera glycines
acgagatagtggtagaattagagcgtggtgtatggctcttccctgtgaattgatcttttaccgatcgatcgagaatggtcgttgggtttagagatggtctcggctggcgggaatgggaggacaaaccaccggcggcagaagcagcagcaacaaatggtggtcgttgttggagttacattttggtatgggggagagggggggggaggggagggacaatgttcgggacttggccggcggccaacttcgtcgttttacacattctcgacttccaactcttcaaatgtgtgtggatgtgtgtgtgtgtccttgaaattcaatacaacaatcgcctgaaatgagagttattgagttggaccggataatgggaggaaatcagcggcaaataaaaataaatcaaaaattattttcaaatttgaaatcggcggcaaaaaaaaataataaatcaaaaataattgtttttattgttttatttcttgtttctcatagactgctaaaaaattgacaaatgttaaaccctagaaatatgtgaaaaaaattgaaaaatttaaaaaaagaacaatttttcttccattcaagatttgaccaaaaataaataataattgaaacatataaaataagattttttagtttttttgaaacaaaaaaaagattaaaaaatgttaagcgttttaagcaagtatataattgcaaaattaaatgttttatttctgtttctcatcatacacagataaatttacaaacgtaaaccttgaaacattagcgaagaaccgctttaattccatttaagatttaatcaaaaattttataaaaaaataactgaaatatataaaacaatattttttattttaagacataaaaaattaaaatgttaagcaatgtatttatgtataagcaaaaatgatggtcaccttgtaattttgaatttcagtttttaaaaaaagaaaaagtaaagccatatattaaagagccaaataagaatggcacttttgctggctgaattttagaggaattaggcaaaaaataaatataatttaaaaccaaagatcatattttaaagaattaagaatattttgaagaaaaaataatgcaatttttaaaattttttcccgaatatcggtgaagcgaaaataaaattgttaggtgccggcaccggcggcacgggcgatgggcaacggcacatattaatgggcgagagagaatgagcttcagcagagcgaagcaagaagcatccagcgagagcgggcttaacctcacccacccgacactttatgtgtcctctcaattggactcgctggtcgtcactcgccgacgacctcaatgctcgccatccgtcccccatagtcgcccccgccgcccctcccccctccccgacacgggtgtcccaattcattcatttacggggcagtagtaatgggtaaaatggtattggggggggggggggg

SEQ ID NO: 28844 - DNA, 932 bp, Heterodera glycines
aaatttattcaaaacacgtttaaaatgttcaaatgttgtgtttttgattgtccatgatcaatttgagcaattttttgtttgaaataagcattttgtgaaaattgaaaaaaaacggttgtttgctccaagcccgtagccagaaaaaattttcggggggggggggggaatctggactttttttttgctcttcgggcaaaaaaaaaaatttttttctattgttattatttattgttttaaaaaaattcagcgcccgagagcaaaaaccagggaattgtagccgtttttgcgccaaaaaattgtcaaatctttgcaattttggggctaaaattccaaaaactatgtaaaatgggtgtccggcggtgccaataggtgcagccgggaaaattttgaaaatttgagtgtgatttattacgaaaatacctataaaattcaaaaatgaaccaaaaggttttaaaattttcggtcggggggcgagaattcctccccttcccccccccctgctggttacgggtctggtttagagactggaaatttcaaatttgcgggtcctgttgcaggattggaattcaaaattttttacaggacaggatccggcaggattaatcctgcatttaaaatcttcctgcgcaggattgcggattttaggaaatttcaaaaaattctgtattataaaaaagtctttcaaagtataaaaaagtattcaatatatttttaaaccaaaaaatgatgaagatgaaaaattaataacgtttttttcagggttgccatccgtccttgaatggcaaggacgtccttgaaaatgagcatttggaaaagtttaaaaaaaatcaaagaaatttgagaaatctttgtaattttcaacaatatccccccccccccctcccccctggacgacggcggcggcggcggcggcggcggcggggcaatgccaa

SEQ ID NO: 28845 - DNA, 1646 bp, Heterodera glycines
gaggagaaacgaatgatcaaaagactgatcgaaagcaccagagggagccatttctttgtcggggaacagacggacgagcagcgcatcggcagagattctgatcagttcagtcaaattcgacggttggtttggattcctgaacaaatttcgtcatcgatcaatgttcacaaaattccgctttactcgctgttgaacaatccgaaaaacagcgccggggccctctgcggctgaagtgaccttccgcccctccacgcgccgtgctcaaagcgtacccaaatgctcaaagtgagtgaagcggaagtgaaacggaaaggaatggaaagcgcggcacgggacggttgctgggcggactcgacgaagcgcaggtcgaagtcgggatcaatgcgcttctcacagttggcaccggtcactggacagaagagaaaggaaagcaatgtaaaacggccagaggaaaggcctcactattgaaggggcatttgcagtgaaagccgttcaccaaatcaacgcattgcgcgaccataggacacggagaaggacggcactcgtcgatgtccgtctcgcattcgttgccggtgaatccgggcggacaaatgcatttgaacccgcggggaccaccttccggcaatgccgtagtctgttgctgatggtcctccacttccacacacgtgcctccgttacgacatgttccggcgcggcatacatccaaacggtattggcatccggggccgccaaacccttgcgggcatgcgcattccgaatgggaaccgaagtcgccgcaaactccgccgtttcggcatggctcgcccaaacatcgattgggtgccaattcgcaattctttccgcttacgccctccggacaaacacaaaaatagtcgtccaccaacggaacacatctgccggcgttctggcacggcttgcgctcctcgcacaccgactccatctgttcgcatcgctgtcccttccatcccggcgaacaatcgcattggaaaccggcgcccaagtcaacgcatgtgccgttgttggcacaaggtgccgactcgcattggttcacgtgccgttcgcacagtgtgcccgcgtagcccggccggcaatggcatcggtacccattcacaatgtcctcacatcgttccgtccccgtcgcgtcgcacggagacatcgtctcacactcgttcaggttatgttcgcaatgcattccatcaaagccaagtcggcattggcattcgtaggtggggccgtggttgacgcaagtgccgttgttgcgacaaggagagacagcgcaatggtcgaccatatattggcactgaaagccgtggaagcccggggcacattcgcactcgaagccgttctcctgcaacggcaattaaattaaattaaattaattgttctaccaaatcgcgacatgtcgccccgttcttgcatgggttctgctcgcattcgttcagttcctgctcgcaaaatgcgcccgtccacccttgtcgacacacacaatgccgatcaaaaagcgtgtccacacattgaccagcatttaggcacggggttcgggtcacacaaattgtcctaatttggcattgacacgcttttgctacaccaatgtcatccaattgaagcaccttaatttgacatcgtttcccgctgaatcccatgcg

SEQ ID NO: 28846 - DNA, 983 bp, Heterodera glycines
  misc_feature (931)..(931): n is a, c, g, or t
tttttctctatttttaaggctttattcctgtaaaattgatcaacccttcgatttgttatgaattttcaaatattaggccaaaatcccgagggccaaaaaattgccaaaaaataaagaatttttaaaatattccaaaaaatctgaaacttaaaataaacatcatatttgtgctcaggaccctaatttaccccagaaaaatatttttcaccctctttttaaacccaaaaaaaatttctgaaaatttctagggggcctagctcgaaaatttttgaaaatttcccttcatatagtataccattagatagagcttaaaaagctctacaattttgctctaaggcattttttggctaaaaccgacccctgacgagttatgggcccgggactcaaatgtcccgcttaggccaaaaattttttctatttccggaaaaaaatcgaaaattttccaaaaaaattaccattcgatagagctcgaaaaactatgttttggaagtggtcttcgtttttctgggaaaattcgttaaaaaatcataaaattcaaaaacccgaaaaccgttttttaggcctaacttgaaaaattttgaaaattttcgaaattttaaaatttcaaaaaatcgagctttcaaagctctacaataagtccgctggcagcccttcggtcagatcaaaccctggcgtggcattcatctggtactgaagtgtactttttgagcacgcttcagttgccattttttgcaggccaggggtttgctcaaaaaaaatttttaaaaataccagcatttagaggacactttggcggagtgccctcacagcgggcactttttgattcgagttttacaaaaaaagttaggggccttcaaatgcaaacaaaagtgacaaatcagtccccggtactcagttggcggtcggatcaaaaaacctatagttttcccgngattctcctcaaaaagttgtaagacccttccactactttcagggcgctcccg

SEQ ID NO: 28847 - DNA, 956 bp, Heterodera glycines
atttttctgagaatatctattcttagttatggagccattttccaaccgaccatttgtagggctcaaccgtatatagtaatgcgttttcggggaaaacctcatgttgaaggttgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttccgggaaacctcatgttgaaggctgtagaaaaagagatagccatttttctgagatatctattcttagtatggagcaatttcca

SEQ ID NO: 28848 - DNA, 1270 bp, Heterodera glycines
  misc_feature (1179)..(1179): n is a, c, g, or t
  misc_feature (1241)..(1241): n is a, c, g, or t
tgaaaatgagtgaaaagtaaagaaaatgatgatgaattaatgaacgaattatgcgcaaaaatcaaaaaaatggggcaaatgaatgacaaaaaaaacgaatattattgcaacttttttggagggagtgaaaaaacactgcgaaagtgaaagaacaaacggacacaacaaaacaaaatgatgaagttagacatttaagaatcgtttttggattatttggcattgatggaagtgccgttatcgtcggccgttggactcagtgagtgccacttcttcgccttattgtcacactacttcttcctctctgtccttctgatcactttctctccctccctctgtccgatcacttttcgcttctctctctgtctgataatttcctttctctctttctctcccctctctcttcattttcgtgctgtcactgctccccctttccctccgcccgccgttggcaatttagcgtaaacggtgtctataggcttcacttcggtgttccgttggaatgtcttgcgaatttgcggaaccgaccagttcacctgtaattggttttaccgtttctttgaattttggcattggctaatattttttggccaaatgtttccgtaattggcattactttagcattgtcttttttgcccaatatcacctccaatttgtccaacaaaagttcctccgctgtcctttttggtggtatatatttcgtcagatggctttgcttctccaatttctgcggtgttttcgcacttttcgtcgactcttccaaaatgccatcgttttttcccaaaaaattgctgccgttggcacaaagtgccgaagttgaacaacgcctggccacctcagaagaaagtgccgaaaccttcgtcagatttggtgtcactgagggcactgccacgtgacaagtgttcgatgccgcctctttgctgaaagtgttttgactgacgaagtctttgacaccgatcagccgacgcttttccgtctgaggagtccacggaggacggcacactgaagagaaaaatgaaaatcggaattgttcgttgccaatggcaccatttgttgggctaaatgactggacagtggcgagcggttgttgctgaacacgaggggaaagagacttggccacgaccaaattgttggcctcggcctgctggaaagcattttttgtaaatgataagccaaaagatnggcaacaaatgccaattggcacctgctcaatcagtcgcccgtgcctccgcgcaattcccctnggcaccgctgcagacgctgccgaactgtt

SEQ ID NO: 28849 - DNA, 1139 bp, Heterodera glycines
actagagtgcagcgggaccgggaattttgggcttaaccgggaccgggaccttttctggttgaaaaaccgggactttttggctgggaaaaccgggaaaaaaccgggaccttggttctcagttgtactcagttgtccgtgtccaggtcccggtcctgctgcactctagatagtacgccaaagtgagagaaattacaaaggaaaaaagaaacgatgagatagtactagacttttctctgcacagtggaattgacccatagtggcgcctgttgttagctcctttaaatggtgcattttagttcaatcaaatgttgcttaaaatacctaactagttttatacaatcaagcaaccatcaaacaaagcaaaaagtatgttgatcgtgaatcatggtaaataaaaagtcggataacttcgcaagtgttcggttgttctcagtctgaatttttcgggcgcaatatccacgggagcgcacacagaagcaaaagagaggcaattagactttgttggccaagaaaaaagaggacaacgatcattcccatgtagggatagaactctaagttgcctttgcctttccccttctccaatgttattaattttccatttttctgagttttctttgattttttgtcatcatttccttcgcttttgccatcgtcggctttccccttgtttttaagaaccgcattgaccaggtcgctgggcttcagctgctggttggccttggcctccatgtcaatgccactttttgccttttgttcgggtgccaatgccttcgcacactctttgaacgatgcgtcaaattccgcaagtttcgccatgccctcggcattttgttcctcttgaatttgctcctcctccgtttgcatttgtgccaaaacgcattgtccggtggcaattagcgccgatttcccccaattttgtgcaatttccttcgcttttgatgttccacccgcgcacatttccatcattttttgccccatttcttctcctacacattcattggcggtctttgtccccaatttggccttttcccacaatttttctgccatttcgcaccctttggccaatgcccaatccatcgtctgctctgagaaacttgcgatcatttctaaattgcattttatttattaatatatattta

SEQ ID NO: 28850 - DNA, 1167 bp, Heterodera glycines
cgcatcggttcggggggactgccccgaaaacaaaaaatcctctactggtcaagtgtccgtttggggtactcaaacaattatcggtggagcaaaaatccaacgcagaattaaagtacaggctatagggaagctattcccgaaggattcggtctccccataaatctgggcgcatcggttcggggggactgccccgaaaacaaaaaaatcgatttttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagtaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttagcctaaactttt

SEQ ID NO: 28851 - DNA, 1642 bp, Heterodera glycines
ttcttaacaaattcattaaaaattcttaaaatttttccccgtcggcgagtatcggcaccgccggccccccaaaaatcctactcttttccttaaaaatttgaccaaaaatctcaaaatttcgtaattttttagacaaaatccgcttataaatagcattaaaatttaaaaaaaaatttctcggcgcctatcggcgccgtgaacccccctgttcccaaagttttttaaaaaccacgccgcaaaaaaatgcgtcgacttgctaaaaaatcgcaaaatttgccagttttttggtgaaaatctgttaacaaattgcactcaaatttttaaaaatttttccatcggcgcctatcggaccggccggaccccccccccccccccccggttctgcaaaggttttttggaaaaagcgcgccacaaaaaagcggatatgaaaatcaaaaattttttcgcccgaagagcaaaaaaaagctcttcgcgaagttgtttctggctaggggcctgaagaggacttcgggaagtttcgactacgaccccccccctggacttcaatcgtatgaagtggggtgacaccccactactatttcatgcatgtttataaggatggaacaaacttgcatttgtgatgattcctcactacattttgatgtagctagttgaggagtgagaggtattatggtttatattagtatattccgttttccacttattcattatgtccatagtttcttagttattgtttataaatttttgcaaggtttttgaaattattaattcctagagaatacttaaagccataaaattttcaatgaaagaatttagttgtctttagcaattttatgattttatttttccattttaacaccatttggaggatttataaaagccctgcttgctgattatgaaccgacctatcagccaacagtttgtggttttttatgggttttgaaattttcaaaaactttatcataattttcgaaatttcctaaaaatactcattgacgcatcatcggagccagtttttatatcaagtttttgtttttttaattcgctaatgtggaaccctttcgccaaagtcatcatcattcatcaattaatcatgcaatgaaagtcgtccttcagcagcaatttaccaaaaaaccattaattaccccattttatttattaagttagagaaatcttttctctttttctccaaaaataatttttgaaattacaaatttttgtaataaacaaatttattaattaatgataattagtgaaaaatatgtttaattctatctccttttgaaggaataattagaaaaataaataatttagagaaaaaaatgcttattaaaccattgtttactttctcaattttgttggcgttttttggccaaatattttgcgacattttgggccgtgaacaaagtgccggtgccaaaggtttgctgacatgtgagggaaaaccggcaaaaaatgtgaaggtgaaactgtacgatgatgaccgaggtgaaattaataataaattcaatttttaatttataaaatttgcagggattgatgcggacgatttaatggtgtgaaaaaaacaaaataaatttgcatttaaccctatttaaataattttattttaaatttgttgaattattaaattaagagaaaa

SEQ ID NO: 28852 - DNA, 217 bp, Heterodera glycines
cgcggtatgcggcagaatctagggccgttttccgtgtcgagccaccgcaatgatccagcaagaccccggcaccctgtattccgaccacctggccgtgctgtgccgacgtgccgaacaggcgctggcccgcggcggcttcgatcacctggtagtgcccagcggcaccctgcactaccaggtgttcgacgatcgcgactacccgtatgcggtgaatccg

SEQ ID NO: 28853 - DNA, 867 bp, Heterodera glycines
  misc_feature (806)..(806): n is a, c, g, or t
  misc_feature (857)..(858): n is a, c, g, or t
tttcacgttaaccaaccggcaagcacaaaacaggccacggtggagatgaatccggcaaggaacgcgttaaaagggaaagtgccgacgagcaaacaatagacaaattggaagacaccggttaagaaaatgtagaccatgtaagcatcgatgatcttcaacttctttgccgttgtgcgttgataatccgcgtaaagtttgctgagagagtcgaacacttcaaccattttggaaattaaatcttaaataaaagaccaatttaaagacaaatccatacaatttttaaacatattaaaatagaaaatgaataaaacataagcaaaatcagcgagaatattgtgacgttcatggaaatgtatgcgccaaaaccaaacaaaaaatcaaacaaaaaagtaacaattacaaaattcaaatcattctccggtcggtttagtgctattataatgttccccgagagtgtaggcaaatttgtggtaggtcacaatgagaggatggccagaaaacacttcgccaaatttgattgttgctccgtccgcgtgaagcacttcaataggacagcgcaaaacgcaactcaatgcacgaagctgaaaatggtaggaattcaaagtcaattggcagaagaaaagctcacttctggctccccgccccaagttccgccgcttgcgcacattcgcgccactttggagcagtagtcgtcaaactgttcatctttgaacatttctccgttttcgttagccaaaaagggaaggaaatcctcgggattttgctgaatgtaatccgccgccatccgacgtatttcgaaggcaganaacttaatttattaagaataatggccacgttgtgggcattgatttaatggnngatgacgac

SEQ ID NO: 28854 - DNA, 1130 bp, Heterodera glycines
  misc_feature (37)..(38): n is a, c, g, or t
  misc_feature (44)..(44): n is a, c, g, or t
tggaaaaaaatttgaagaggctctgcggacagatagnncatcgnggttacgagatagaatattgtcctaaaaagagatagccattttctgagaattaattcacaatttccgcagctcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaacgagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaaagagatagccatttttctgagaattaattcacaatttccgcagctcttgcggtaatggaaaaaattttgaagaggctctgcggaacagattagcatcggggttacgagatagaatattgtcctaaaacgagatagccatttttctgagaattaattcacaatttccgcagctcttgcggaatggaaaaaatttgaagaggctctgcggacagattagcatcggggttacgagataaaatattgtcctaaaacgagatagccatttttctgagaataattcacatttccgcagctctt

SEQ ID NO: 28855 - DNA, 1055 bp, Heterodera glycines
  misc_feature (24)..(24): n is a, c, g, or t
aattatgccataaaaatgcatttntggctaatttagcgatcaaaaaaatttttcatgaaatgcaaaaccatggggtcccccctatggttttgagtttcaaaatcacaattaattttataactttttttaaactcatggtaaaaacatgagataaagcacattagattgggcttttaattctctacaaaaatgctcttgcatgactttttgctaaaatcaactcctgacaagttattgcgccagaactgaaattgaggcctaccaaccaaaaattttctatttccaaaaaaatttttaaaaatttttctgaaaatgacaccaatcgatagagcatgaaaaacggttgcttgaaagtggtctccgttttccccggaaaaatctgtaaaaaataataaaattaaaaaacggaaaattttcgagggggcctagctcgaaaatttctgaaaatttcagaaatccaaaaacatggttggatagagctcgtcgagctctacaaaaaagccgcttacaccgacctcctcaaatcaaaccccggcgagttattcggccggcgctgaaatggcccaaaaaagtatgcaatttttagccagtttttcggaaaaactgacaagaccttggggtccggtcaagaaacaaaaaaaatccaaaaaagtccaacttaaaatcctatcgaggccgatttttcaattaggcctttaaaaaatttttgaatcccaaaaacggcaaaaaaaatttttaaaaagtgacttttctgcgcctggcgctcagttggccctcggatcggaaaatctatagttttcctgaatgcgccgtcaaaagttacccccaaggtcgaaattttgaaccccttcctgcaaaccgtaaggagattttgtttttggaacgaaactccttgtttctttagttatatataaactagggtgcacagttggctttgttgtattcagttgagttctgttgctgtggggaaagcgcttcgcgctttgggaacgcggcttcgccgcgtcgctagaaagtgatgtaattttagcaaattgatcgcaggctcaagacgg

SEQ ID NO: 28856 - DNA, 774 bp, Heterodera glycines
  misc_feature (718)..(718): n is a, c, g, or t
cctttctttggcaaaatagagaaatgggaaaatttaaattttatactttttgctcgaattcgggtccggggttctacataggtcgaaattgatgccggattcggattctcctacccttaaaacccctaatacaatcttttctcgaaaaaaatttcaaaaattttattttttgaaaaagggggactaccatcggtactattacctatgattgggaagcttttaactctgattagtagggcttccttttttaggcaaatgcctaaaattttgcgcacttgatacgcaaagataagcacgaaaaacgcgtttttcgcttggtttggggtgtctacgatgacttttataatgcctatttttgcctatttcgtggtttttgtgcctaaagtgcctattttaggctttttgaaaaaatccataagaaaaatgcaataaaaacgaaaaacacaccccctaagaaatgacccaaaaaaaatttcagaaaatacacccttaagaattgaaaaaattttcaaaaaaatgatcccaaaatttaatacaatatatatttttcttaataaaaatttttggtttaaaatttgtccttatttaataatttcatttacaattgaaatatttaagttttacttgttttaataatagagtgagcgggaccgggaaattttggcaaaaccgggaccgggaccttttcaggttgaaaaaccgggactttttggctggngaaaccgggaaaaaaaccgggaatttcccggtcccggtcccgctcaactctagttt

SEQ ID NO: 28857 - DNA, 1192 bp, Heterodera glycines
caccaccattttttccgcttctgctagcttcatatattttttagttgttagtaataaatggttggaaaggtattttttcttttgcccacgtttcagttacaaaaactaattcaaaatcttttagggctataatcgcagtaaattcgttaagcttattatttagggatcgcatattgataaatgttgagtataaaaaattttgttttttatttagtaaagttttcgaattttctatggggtgttcaattttcctatatttagtttgtaaaagagataaattaaggttattgcctcgtgagtggtcacccaaaacacattaagatttgttatgacaaatacatttaaaattgaggtcagatttaaaggcgggaatgtcgtcgcgggcaagcacatgccccgcatagacaatgtaatcacaggatgggtcattttcacgttgagatttacacagtgtaatgagtcgggcacggtcaatgagatcacttttagatagggaggggcgcaacaaaactttggaaaatttgttaaaatttttgattttgtttttgttgcgcaaaaataaattggtatggaatttggtcgggagttcaactttgagcaaccttggacgtccgtcggcttgttttttgcccattctgtacacttgggtcggcaggcattcgatgtcacaatggtccatcagttctttgacattcgccaagtcatcggttgcacgttgagttggcgtttggctgttgctttcctgcaattgcgcgatgacaacgctgtgcagtcgtcgttcttcgtcaaaaacactgttcgggttgcttcctccgtcctgctcgcgtaccatgaagatcagctcgcggcacattccaaccatttggttcaccagtcccaacattgcggaagcccatggaggcgcatcggtaagatgctccatgtggaattgttcaattgctgaggcggcaggtcgttactcaaaaaccatcaaaatgcgcgtctcaaaaaactagggttcggaccccgcccccgtcacccccgcccctgccgggggcgggacaggttttttggcctcacccccgtccccgcccccgcgactctgacccccgccatcccccgcccccgcgaccttcacccccgctggggcgcgggggtgaaaatacacccctaagaatgacatattcatggataaaaggcaaaaaatttatac

SEQ ID NO: 28858 - DNA, 1656 bp, Heterodera glycines
cgcattcgagttcccttttttcacaacattcttaacccttctttgggcaactttcggcatcaatacttttttttccacctatatacattaaacaatttaaatacttaaatatttttaattacgggtgccaatccaggaattattttcttagtcgccgtagaaaacaatggcgcaacattcggccatgcgatttgtgatggctttggaacaatctgatgtcatttgtaattaatactatcatatgtaaagggtttttacagatcttggggcatcagaattttcggcaatcattttattttcaatgctttcccagcggtccaacaatcgacgacggagacacccgatgacgtgcccgcccatggttatgcctgcaccaccggcatccatgatttcggctatcacaccattgatgtgtaacagctccgtcacattgtcacgaccctttgatagattttagtcaaactatttaatagaaatttgttaagaatatgaaattttaattacttatttcattttattttttattttcaatttgttacatttagatgaatattttttattaacctcaatgggctttgacaaaatttctagatcgtactcttcagcacacttaagatccagtttgtgaccgcaaatcacgagcttctttggagttatttggacaatcaaataacgcatcttggcgaagaatttttttggggatagaaagggaggaatagctgatatttagagttttctgaaattataaaaattaaattaattaaacaaaaacaaaaattcactaacaaattgtgggaataaatttatgtgtattttaataaaatattttagtgtcgattaaatgatttctaataaattgcaaatacaggaagtcatcaaaatttattagttaatgactaattaattgctttattaagaataattgtgtgtttagtaattaatattttgaagttttaatttggaggtgcatgaatgaatatttgggaattgtagattattattttatatagtagaaatttcattttgaagagaagcgttgcaaaaataagctcacaacgacacaaataatgaatagatgtggaataattatcttgaagtggtcttttgtcaaattttgcagcataaaatccagcatatgaccatatcaacatacgcttggaattcatgtcacaaaaaagtttttttccgtggaggtatctcactccagttcaatacaatgcgcattttgttcaagtattttggaataattttgataaatattggttttcaaaagggaaatttttttacggattttttttcaaattttataacaatgttttgtgaaatagtccatttgaaatcatttactggtcgatggaccataaaaagcggagtcgtcaccctcgtcaaacgaatcctaaatttatgttaactaattcattttaattggtaatttactctttggccacgcgaacgtttagaccaagatttgcattcgtattgaaattgaacttcgtcctaaatagtttattattttttacaggatttattgctattgcacctgctccttttggtcaattccaacgaacgcgctatcgtcgcactcatcgaatgaatcctatatttattttgttaataattattttttaattttttattactctcattcccaacgct

SEQ ID NO: 28859 - DNA, 1259 bp, Heterodera glycines
ctcgagcgcttttgtaacgtataaaatttcacaatatgagagattctctttttttggggatatgagataaattaaaattcttatgagaaaataaggggcgattgcgcaccccttctctctcgctctcgagcgcttttgtagtgtataatatctctcaatatgagatatactcttttctcttggatataagataaatttaaaaattctctgagaaattaaatggcgattgcgcaccgcccttcctatcatgctcgagagcatttgtaacgtataaaatttctcaaaataagagatagtcatttttcttggatataagataaatttaaaaattctctgagaaattaaatggcgattgcgcaccgcccctcctatcatgctgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgcccttcctatcaagctcgagagcatttgtaacgtataaaatttctcaaaataagagatagtcaatttcttggatataagataaatttaaaaattctctgagaaattaaatggcgattgcgcaccgccctccctctcaccctcgagcgcttttgtaacgtataaaatttctcaaaataagagatagtcatttttcttggatataagttaaatttaaaaattctctgagaaattaaatggcgattgcgcaccgcccttcctatcaagctcgagagcatttgtaacgtataaaatttctcaaaataagagatagtcaatttcttggatataagataaatttaaaaattctctgagaaattaaatggcgattgcgcaccgccctccctctcacgctatagcgcttttgtaacgtataaaatttctcaaaataagagatagtcattttcttggatataagataaatttaaaaattctctgagaaattaaatggcgatgcgcaccgccctccctctcacgctcgagcgcttttgtaacgtataaaatttctcaaaataagagatagtcattttttctggatataagataaatttaaaaattctctgagaaaataaatggcgattgcgcaccgccctccctctcacgctcgag

SEQ ID NO: 28860 - DNA, 1422 bp, Heterodera glycines
  misc_feature (39)..(39): n is a, c, g, or t
tttacccactcaaaaatagtacgggagttagtggtttgnagtgtggaaattgggatcggattgggtccagactttgccaattgaagaaaactacttactgatcagactttcagcaaaaataatacttgaattaatgtccacggggaaagtaacaccaatttgaaggtttacttaggaatttaaaaaagtaatgcattaacgaaaataataattgtagaaatcaatgaaaatggaaaattaataaatttgaaaatatttaaatagatttaaatagcgcgaaaagaattgtaataaaaaataataaataaagtaaaaaatcaccgttatttatcccacgcggtaactccgaaccttttacggaagttgtgtatgatcccaaagcttcttactgcaatgctgtgctaataactgaaatcacaggcaattggtttggtgttatttttttaaattctttttaattcattcataaacttaggaaacttaaaacccttaattttcttaaataaatgttcgaaattacaaaaaatatatttattttaggttttaaatattgtcataatcttttttgagttctttcttagtttttacgggtgattacgcaaagttttaatgcgggattgcgtaagttaaccccgcttggcataccccgaaaaaatttttgagatgcagcggaatctgcaaatttgaaatttctgggctccagtccctaatatagcttgagattgaacatattaaagcttttaatacgggattcaatagatgtgaaaaaagtgcggggttttttttgaccccgtaaattatcaaagactaggcccggtcccagcattttcaaattccggtctttagacccgttaattttggctaacttttcatatcttttttttccatttttcataacttttggcgcttttgttagaaattaatgtttgtttaattataaatttaatttattcctataattttcataaaatggtcattttttatgtgagaataaaatttgatgaaaaaagcaatattattttttaactataaaaatcaattaaagaaacgtttttataatttgttaaacaataatttaataagaaaaatttattaaaaatataatttcaataaattaaatcttcaataaagcttatttgttagcttttaattttacacttttttatttcgaaatcattaaaggaataatttttacagaaaacatttaaaaaatatttaaaataaaatgaatttattcattttattctttttgaatattattttattttgatcgttaaaattgatcaaattgaaacagttaaaaaaaatagaacagaaatcattttaacgaaatgtttgggaaaatgaaaataacaaaaagaatggaataaaacaacgaatataaaaagcgctacaaatcataaattgatgaaaaaaaatgaa

SEQ ID NO: 28861 - DNA, 966 bp, Heterodera glycines
aaataattttttactatgagtgttggtttggaaactgtctaaaatgttccggtcgcccacattgcacaatttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagca

SEQ ID NO: 28862 - DNA, 1891 bp, Heterodera glycines
tgcaggtcgaaaaaaacataaaaaaaaatttttaccagaaaaacaaaaaagatatttaagttgtttttagaccaaaaatgcgaattttaaaaatttgaattttcgacatttcgtgcgaattctggtccgtgatccggaattggccgaaatggatgccttatacgtgatcagcgacatcgaataccacagaaaaattgtttttctggcaaaaaattctaaaaaattttttcaaaaagggggtaaaaactacaaaattaacgctttttgtttgtaaaatgagcatagaagtcgtatatatttttatatcgtatcagctttttccatccatcacaccggttttttaaaatataattcaattattgaaaaaaactgaaccgtccaactgaatgatggccatattcctccgatataaatcaccgacaacgcgcacgttcatttgcaagccatccttgcaaatgcatgggttgtctattaacggataaagagtttccttatcgaacagactgtttccaaagagataataatcttttctggaattataatattaatcattaaattaataaataataaaatattcggataaattctattaattgtgtaaacattatcttgacgaaagaaaagtctcggattcttttttggatcatgattaaacagcttttcaaattttaatcttctttattagactgatacattttacacattaatttagtttctcgataaaattaaatatttttaatattcttagagactggcagagaagcggcgccaggaagatccagtgtgagaattattatttttatgatttttgcttgtttttgagattttgagaaaatttaaaaattttcagttataaaatacttcaaaaaattttagtttttttataatttttgaattagacacaataattggaaaaaataatgtaaaaagaaaaaagtcgtcgcttttttaagaaatctttttggggtcaaatctgagaatgtaagcatttttgtctaatttaaaaaaacttccagaaaaagccaaaattttgtgcaaaccctatgaaaaaacagggccaaaatttcttgatttcctggcagctcccccccccccccccaaaaaaaaaaaccaaacgaaataattgtttaaaatagaattgctagataaattatactataattaataaatgtaaattactctaattaatttaaaaaataaataattttaaaaactcggttagtctgttaaatgatcaatagtcgagattgggatccgaatcacagaaatttctcgagtcaagaccctgacccagacgctcaaatgtactgcattaatataactatggctcacagttcatgcattcgctgagtgcttaacaatttcaaaaaatggcacgccgagttgcgttcgcatccgggctgcatctgacaaatattcctgacagaaacatctcctctgtatgatatggtggcattaatccaggcgaaattgactagaaaatcacaacttcgtcggctcaaccatgcctgtgaaaaatgaacagcgtgccatatattagaactctaattcgtttcgtaaattttgccacctcggatatttataaacccaacaattcataaaccgtgctctatattttttgtaaaattgctcaaaagcctacagatcatttttaatttctttcctttataaataaggcgattaattttgaaaatattaattctattattctaaaaattgatccaattggtttttatttcacgttatggcattttatgtagcaaaaattttacttcgggtttgccaagaatgttaaatttaattgtatttttggacattaataataaagctcaaaataaaataattatttttttcatcaaaagagtgtaaatttaaaagttataatctttgg

SEQ ID NO: 28863 - DNA, 540 bp, Heterodera glycines
cggcgggggagtgaccggtcccggacggatcggctaaatagcagtcggcataatggggggtaatgggagccgccgccgccgggtggggcttgtgtatttgttaagaatacgccctccccccccccctccccccgcggggttcttttgccgttgttttggcccatttgttgcttcggctcacctttttcctccactccatcagcaccattcccccgtccctattattattattatcattcgtcttcttctccttctcctctcttccttcagtcgtcatttgtcgtcgtcattttggcagctttttgcttaatcggaaaacattttgaacataacaaaaaaagaaaagagagaagcgattggtgggggggaggagagaaattgggtgggaatcatttggaagaggaagataaatgggaagggatgaagaaaaacattctcgcgggataacaacaatggcggcactgcaaaaagctgctgatgaaccctccggcgatggggggggggagagtgcgcactgcgcagtggcgggggagggggggg

SEQ ID NO: 28864 - DNA, 1646 bp, Heterodera glycines
  misc_feature (143)..(143): n is a, c, g, or t
  misc_feature (1548)..(1548): n is a, c, g, or t
ctttttaggcgctaaaaataaaagcctagaaaataggcactaataactcgaaaagtagcttaacaacaacccaaaaaaacacgtttttcgtgcgtttcagaccacggggagctcagaaaaaaaggttttttgtctaaaaatcncatccctagttatgaatttatgtgttatacattttttgtttttctaccccttggcggttttgagaaaacgcccatttggcggtttttaggaaacgacctagcacccttacaattagcaatgctattgaattttctggactagaatcaccgtgctcagatttacattcaaacccaaaaattccgatttccagttgaatatatttttttgatagagtagaacgagaccgggatctggtactaaaaaacgtacaaatgagtacctaagtcccggttttgaccgtgaccgggaaaagtcctgggtttccttgccaaaaagtcccggccccggctttgctcaaaattcccagtcccgctatactctatttttggataagaaaattttatgggaaacttcggggtttttgtgcttcgaacttcaaacttcgccttcgaataaaaattgggcttcgccttcggctcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcatctcccaaaaatcaatcgatggcaaagagaacggcggcgaatttttcccctcccatggacaacaccgcaccaaaaaaattcttaacttcccttgaccagcttcaaattccccccgaaattgacaacgacagcgccattcccgactacgcaaaactgcttattaagcagttgcactcgctgctggccaccgcttcgtctctagttcaatctcaagtgacggcgaatgacgcgattgaggaagactgcagacagcgaaccgttgttatcaccaatgtgccggagttccaatcctggaaagcgtcggagcgtggggaggcggacagagcactggtcaatttgattttggacacagtggacctcgaccaaacgccagtggtgttccgtgtcggcatgcgaacgcccaacagagcgagaccgctcaaaatggaatttcccacgcgacatgcggctcggcatgtgctcagaatgaagggcaaagctttggcgttgaatgctctacatggtgcgcgcatcagggaaagcatgaccaaggagcaattggccgaacgccggaaattaattgagcagtgcgcaaagaaaagaaaagaagacgcaggagattggattatctacgcgaatcaggtcatcctgcgcagtgacattgacacaattcgtaaaaatttttaaattttcatgtcaaatcaccaaaaaatcatataaatttttacaaaaaaagtttttgctttttccggttggtagaaaatttttataaaaaaataaacaattttaatttcttacaaacagttaaaaggggatgttaaattatttaaaagngtctaaagctgttgtttaaattaatattcgttctataatgaacaaaaatgacgaaatatctttaactttaacaaacaaaatacagatttattactaat

SEQ ID NO: 28865 - DNA, 1949 bp, Heterodera glycines
ttttgttttgtaacctcctgaatttgttttaaccaaattttagcattttttacgcctaaaaatcttttgcgttagttacataggtaggtattgaaaatttaagtgataatagaataaaaatttaaaaaccaaaagttaggaggggtgacaaaacaaaaaatatacgtataaaattggtaccatttgaagaaaccacaaatgacagtcttttgaacattgctagtaatgcattctgcagctggaacatcgagttcaaacttcaattggtctaagtatttggaaggaatttttttatgtttaataatctttttggttgaatccgattgggttttggctggagacattgtgagtattctaatttaattttctctaaaaatttatccagatgtaacgttaaatattattaccatatacattgtatcacaagctttactgactcacattaaaccggacacgctaaagcatcttcacatttataacattttttttagatgaatgactcctaaggaatagaatttagcttaaatgggcagaagtttgagaaaaagcaaaattttttaaatttttcaccccgggaaccgttgtcggacccggaatttaataattccgttttggccggttttgaagaggccgaatgcggataatgtcagcccgatcaaacaaaaaaatttttcaagaagaaagaaataattttttggaatgaattttatggaaaaattttcagcataaaatcttaaaagcttcaaatcaagcgtaaagatcgttttactggtttatttcaacgtattaagtgtgcaaaaattcaggcatttgcctaaaattccatccctcaaaaatagaaatccactggctctattaataactagctttttcaataacgcctcattttgacaacaaacggggctagttgtgattggtctcttctgatccatttccagatcacttcctgtctcttcatataaaaaaattttattgaattggctaatatgcggcaaaaatcaagcaaggcggctatttgttctatcccagcttactgtttgcgtggaattggttgtcgacatattctaattggcgggggtggaggaagtgcaaaaactggagttcccaaccaaattcaggcaatttaaacaaattttcaaatcttttgcgatattagcaattgaaatgataccgaatttagctttttttgcttgggtatgatagcaatttcgaccttcaaaagggaatctatgaatcctctaatcaaatggttgcgcgactgagcgatgttgttgacacaggccaatccgccagcatgaacatggactgcattgcgttgtcggatgagccgtattatggccaattccttattgtagccggccaagatgaggtttttcggggtttttttttttttgctaaaagacacggagaatatggtgaaatttaacgaccgatcgagtccgcttggtcttatctatgactttttaagttctgcgcattgtatgaaacaaaacatttctcgttgtctgaaatggatggtgtggtgaatttcgaccgtcgttttgatgctccgtcgaatttgtcttttaatgtccaagaattggtaagagtacagactgacaagcacccgggcgacgattcttaccaggcaattttattttattagagtaaaaaatttttctatcaattcacaattttactaacaagcaaaacaatggttaggtaattacatgggtactttttaagtttacctaatagattttcttttttggttttaagaaattaatgaaaaataagttttaaggggatcactaataaagcatcattttttgccattttcgaacccctttaccccaactcaaacaaaactcaaaaattttaaattttcgggtttcaagttttttgccaaccatatcttacataaaaatgattttaaaacatccttaacagaataaaaattattttaactc

SEQ ID NO: 28866 - DNA, 1199 bp, Heterodera glycines
ttctttttcatttttcatatctttgatgaacctaatcaatgtcagatttttaatgattaaaaataaaaaaatttaatgtctatctttaagactagtgattttttgaaatttttcaattcgttagttttgtcgtagattttagtaaagaaattgaaataaaaatattatttttgactgcgtggcgcaaatatccatttttgtttagcgccgcaaatatccgcggcgcaactgtctgcggcgcaaatgacgcggcgcaagtgtcgactttgctgagcggcgcaaatgtccatttttgctgacggcgtaaatatccgcggcgcaactgtctgcggcgcaaatgacgcgacgcaagtgtcgactttgctgagcggcgcaaatatccatttttgtttagcgccgcaaatatccgcggcgcaactgtctgcggcgcaaatgacgcggcgcaagtgtcgactttgctgagcggcgcaaatgtccatttttgtttagcgccgcaaatatccgcggcgcaactgtctgcggcgcaaatgacgcggcgcaagtgtcgactttgctgagcggcgcaaatgtccatttttgctgacggcgtaaatatccgcggcgcaactgtctgcggcgcaaatgacgcgacgcaagtgtcgactttgctgagcggcgcaaatgtccatttttgctgtgcggcgcaaatatccgcggcgcaactgtctgcggcgcaaatgacgcggcgcaagtgtcgactttgctgagcggcgcaaatgtccatttttgctgtgcggcgcaaatatctcatcacgttagtagtataagaccccgaaagcgagcgggttccgagcgggtgtttaccgcagaatcccaaacctatgggaggggtgcaggcctttgaagatgccgcccaaataccaaaacctatcgggggtgttcgaatcccgagcctatgggagggtgttctttgaagtctgccgccttggggattttattttccccaaatcctcgcgggtgttttttcattttccctccccgcgccgcgcagtgccgcggaaggtcatcaatcatccgtctgtcaccaaagtgacgggtggaggaaattcaattcttgcaaattaattccaaatctttttgctcgcacacaaaccttttgggcggttttattttacgaaatcctgagattttttatcatgatttttttatcctgaaattaa

SEQ ID NO: 28867 - DNA, 1047 bp, Heterodera glycines
atgcaaatttgaaagcgaccatttgtagggctcaaccgtagatagtaatccgatttggctgaaccccacatgtctaatgatgtagaaaaaagggatagccatttttctgagaatatctattcttacctacaatgcaaatttcaaaccgaccttttgtagggctcaaccgtagatagtaatgcgatttggctgaaacccaaatgtctaatgatgtagaaaaaagggatagccattttctgagaatacctattcttacctacaatgcaaatttgaaaccgaccatttgtagggctcaaccgtagatagtaatgcgatttggctgaaacccacatgtctaatgatgtagaaaaaagggatagccattttctgagaatacctattcttacctacaatgcaaatttcaaaccgaccatttgtagggctcaaccgtagatagtaatgcgatttggctgaaacccaaatgtcaaatgatgtagaaaaaagggatagccattttctgagaatacctattcttacctacaatgcaaatttcaaaccgaccatttgtagggctcaaccgtagatagtaatgcgatttggctgaaacccaaatgtcaaatgatgtagaaaaaagggatagccattttctgagaatacctattcttacctacaatgcaaatttgaaaccgaccatttgtagggctcagccgtagatagtaatgcgatttggctgaaacccaaatgtcaaatgatgtagaaaaaagggatagccattttctgagaatacctattcttacctacaatgcaaatttgaaaccgaccatttgtagggctcagccgtagatagtaatgcgatttggctgaaacccacatgtctaatgatgtagaaaaaagggatagccattttctgagaatacctattcttacctacaatgcaaatttcaaaccgaccatttgtagggctcaaccgcggatagtaatgcgtttttgctggaaaacccacatgtacaacggtgtagaaaaaagagatagccatttttctgagaatatctattcttacctacaatg

SEQ ID NO: 28868 - DNA, 783 bp, Heterodera glycines
tttttgcgattattaagctcaattggtaggattttcatttaaaaaaggataaaatatgtatcaatttaaaaaaaaactatgaggaatcatattttctttataggaaacccacgagtatacaaaaaaaaaatgaaaataatctaatttctgtagagggattgaaccaggggaaagaagcaaggaaagtcaaggagactagccactaggccatttgcacacttaggagttttacttttaaagaatatattaattattattttttatttttccctttgactccaattttcttcactaatttttcactcagaccccccattcttaccagtgcttgtttttcccggttcccggttgccctaccgggaccgggaccgggacctgagcttttcaaaacccgggaccgggaaccgggacaaacacgcactggtaagaatggggggtgggagggtggaagcccttggcacatcgattgcaagtcgggcctgaacccggcacaatcgaattggttcggccttagctttgcctttgcccaattaccgtcgacccccggcttgcaaatgcattgtccgcttgtttggttgcaattgcgcgacaatgagccgatcggatggcaaagacaggctgaaaaaaacgttgtccttaatttgttgtgttcctttttcttacgtttgcacgccttccgatgagagatcggtttgctctgatcacgaaaataaccaaagcgaccaatactgtaggaggggagaaagagcaattaggaaggtcaaagagccaaatgttaaattg

SEQ ID NO: 28869 - DNA, 1061 bp, Heterodera glycines
tttcattaagattttgcatcgtccaaagttcgtccgatagaattcaaaattcaaatgcaaatccgccattcccccccccccccccttcggcgcaaaacaaaacattggccatgaccataaactgatgattgaacacaatttttatgttttagttccgttttaatttatttttcccctaattttgtaaattaaatcagaaaatgccaaaaatgaaaaccaaaggaacaatcgcttaacaattgaaacgcatgcgcatgacttctgaaacggcattttgaggtggaaaagcagtctctgctttgtttgcccccaccctttcctttctcattgacttcccttttttctttttgtcttggctttatttatgcgttcattaattggacaaaatgagagaatatacaataatctgaatgggagaagcactgcttctcctgctgctgtgcttcttctcccccccccatttccctctttcctttccctttctttgcttttcattttttcttatttttgtcagactttttttatttgcttcaaaataaataaataaatataaaagccgtcgtcttttggcacttttccaaagcaattgatcaatcaaattgatcaattattcaacggcgtctctcacccccccccccccgtcgtttttcctctcttttccatgggatggccctcccctcgtcgcatttgcccaatttggccatttcattccattcaaatccattctcattaaagcccccgccctctccaaatttgttcagcttctctccaacaaagtttggtcttcggcccgttgccgttaaggtttttcagtcatgaaattttgaattttcgagtcgactttttaggggggggggcaaaggaatgattaaatgagaagcatccattcattcactctttcgttcgttcattcgtcgcatccttcccaattttggatggatttgtgaatgaacggacgaatgaatgcataaattccatcccttcgctgcccatcttccgtttatggcccactttttttacgtcgcttcggtgagcattgatgagcagcacccgccgtaccc

SEQ ID NO: 28870 - DNA, 767 bp, Heterodera glycines
taattagtaagcaaaattcattttaatttttcaataatttttatttgtcaaaacgaatgttctttttccatccattccctcgcccccgccccatttaaacccaaagcgcctttttggacaaagaaaagcattgctagcatattcgtggtcaatttgttgcaaatttggcgcgctattggcccaaaaaaacactcagaaaatcggacagaaaaattggacagaagaattggacaaataaattggacagatgttggcttagccccaggggaagcaaaaaatatgcaaacggacgaaaggactaaaaagagacattttatgcaataaaacgaattcgaagtcgcaaaaaaggttttattaattgcgctgatcagtgaacagagagaggggtgctatgtcgttatataaaaaccatcaaatggagattttcaagataaaactgtccataacttttgtaaaaataaaccaaattaaatattattcatatcattccatagccctaacatttctctattagctcacctaaatttcaaaaaatttggtcaaatttgagcaaagttatggccaaaagtacccaaggcaccgggttttcaaacatttttagctataacttttttgaacctaacgaaattttttgaaattttgcaggttaatagaggacacatagggccatcgatagcaaaaaaataaagaacaaaaataatttctaacagaaattttttaataagaaataatattattttgatcatcaaaaatgctgatcaaaacat

SEQ ID NO: 28871 - DNA, 1459 bp, Heterodera glycines
tcaaaataaaaaaaatttgctttttgagtttatcagttcataacttttttgaaacttaatgaatttttttgaaatttcgcaggataatagaaaacacttagggctatatatcaacataataaaatttgattcattttgggcgaagttatgaataatttctgtcaaacatttttaatttgatggtttttgggtaacgcccattttgatgggttttgaataagacccggcaccgtcagaaatagaggagtttctaattgttgtggaaatgcggaattttccgcgctttggaactctgccgcatttttgaactcatgcgccgcttttttggttatttgttttggaaaccctggttaaaaattctgcaaaatgctccccgatttttaaaatttaactgaaaaaattaatttgtctttttcttttgctgtggcgccaattttgcactgcaccgattcttcaattgtaccaaaattttcaagctttggttttattatacccgttttccaccaatttcaagccgggcacccccattttgagatcaccacccccatcgattagacataaacaaaatattgaatattattataaaacaaaatgattgaaaataaataaataatataaatttaaaggaaataatcggctcaatgggagtttgtgccttggacctatttttattcacatgtaccatggagaatgttgaaccaaatgatgacattcagcagaacaatatgatgaacatgttcagtgttgaattcagcaacaaaaataacaacaacacatttgacatgaaaaggcaattgaatgtgcgcgatttgaatattaaaaaaattaccgtaattaaataatagaaaaattaattaatgatattcagctgagcccaatgcagcccagttataagccacgtgcgcttgttttatgtattagccggatttttctctttgaaaaatggcaattgctaattgcatgtctggaagcttatcgtatttttaaagtaattttattggattcatttgaacgcagcaaaaaataaaatgtttgaaaattaaaattcataatttttatttaaaattttgaaaattggaattacactttctgaattatttcaatcattttgcacaggttgacctggttgttgcctatgttcaaagtgccattttatcagttttcgagttgatgcgagcatatgaaaaggatggcatattgaaaattcggcctggcatccgtttcccgcaccatcgcggcatgaaatgggacccaaatgcggaaacggagttggaacaaactaaaaaataacattacccattttccgatgcctaggtttaatggccaaattctgcttgcccatgaatgcttttatgaacaccgggaaagtgcccaattcattggcctgctcgacttggacgatttgctggtgccgtcaaagaattttgaggatttgcccgcggcatttttggccgctttt

SEQ ID NO: 28872 - DNA, 1764 bp, Heterodera glycines
  misc_feature (108)..(108): n is a, c, g, or t
  misc_feature (159)..(159): n is a, c, g, or t
  misc_feature (183)..(183): n is a, c, g, or t
aactcaaaaatgttggtataaatggtactttactaaaatgctttcaaaattatctacaaaatcgtacatttttcgttagagttggctctgcgttttctgatgaattcncatgcttaagtggtgttccgcagggatcaaatttgggtccgcttttatttntaatttacatatcagatcttcctnaatttttgtaaaactgaaaatgttgaaattaagctttttgctgacgatcttaaggcctattctattctctcaaaaaatactatttctccactccattcttttataagtattaacaaatttcgggaattactgtgaattaaatggccttaaaatcgctcctaataaatgcatagtttcacatcttgggcctaaaaaccccaatgaattattactttataaataatattccaattttaaaaagtgaaaaaggtgaaccagttagagaccttggcatttatgtttcaaatgacttaaaatgggaaaaacatatagaatttattaccaaaaaagcaataagaacatcttttgctttactcaagtcacttaaaacaaaaaacccaaaaattcttataaatatatttaatgtttattgtcgatccattttggaatttggttctccggtttttaatccatatatgaaaaaagacatcgatgctcttgaaaatgtccaaaaaacatttttacgtattatttttagacgtaataataacaaggatgatatacccgggtataacgaacttcttcaactctttaaacaagaatcccttttaaaacgcagaacaaaaatcgatttaaaacttttccatgatataattttgggaaagatccatattcagcataatgattctttttcaaaaatatattcaggactgaaaaacgattatattataaaaaccgcttattgttcaaccaatgttcggtttcattcgttttttattcgtacctctcgcctctataggagtttgcctaaagaggcgaggttacttaattctactgagtttgctaaacttcttgacacctatgatattgatgttttacttttgaaaccgccccatctcattcagtgaccaattttattttatttattttgttttaatgtcggtgtcacgcttttgcgtataaattgaattgaattgaatatattgcattacaaaaactacacttttccatttttcggtggaagctgacaccagcggaagggggggggaggacaatcgactggcacgagggaggagagaaggggggcgaagaccacccaaacaaacgtaaaaatagcagaaaaagaacgaggggggagacggttgggcagaacgccacgatatagaaaaaagacaagcgtttggattcaatccattggtgttgttgttggttgggtgcgtccgaccgagcaaaggccaaaatgcgatggggagacagaccattttgtggttatgtatttattatttaattttatttgtgctactactttaaattttttttaaattaaaaataaaatttatagctttttagtcgaaaatttggtaaatattattattaattcatagctcccaaactcaaagctcaaaaatggactgaatcaattccaacagttagagcagttttaagtttgggagctatgaatatgatgaatatttaccaaattggctcttgtccgttttctgtatccctgccataattaaagacggattttgagaaatatggcctttttctgcccactaatttccggatataaaaataaaaaacagtgtttcacttcgtttg

SEQ ID NO: 28873 - DNA, 693 bp, Heterodera glycines
ttctttgcgataatggatgtccagcagctgcaccatgcgttcgctgtactcttcccattcaaccgcccgcaggcgaaattgctcatcgcaaatcacccacagtggacccagtggcgtggcaattttttcttcaagtaatctcagcatccgttctctcttaagacaaacgtgggtaaatacccggacctatcggcagaccgacaagataccacgccagcaacatcagcagccataccaccaaaaagataagtggatagggcaagactaacgaatagtaagtacccagtttcgcgtctggtttgtagcgttgcaggaatccaagaaacagtggaacaaaaggagataccggcgctaaaggcaatacggatgagtcggcaatacgaaagaggatttgcgcaaatgccgggtgaaagccaagtagcataaacattggtacgaaaatgggggcgagaatcgaccagattgcggaaccgctggcaataaacatgcataagaaagaggaaagcaacgccagaccgacaaacgccgggatgccgctaagccctgaactttccagtatatcggtcagccccacggcgatgaatttccccatgttgctccagttaaacatggcgacaaattgggcgaggggaaaaaccatcacgataaatcccgccatctctttcatcggttcaatcattaaatgcggtaaat

SEQ ID NO: 28874 - DNA, 1405 bp, Heterodera glycines
tgaggaagataaggttgatatctgttctccgcccccttgactcaccagagttattgtaccacacattcttaccgtatttgctgtagaaatgctctgaccgtaccgcaccgccgttggccgagatcagctgtccgtccttgtcgtgatagttgtcggggttgttgaactgctcgaagtcgaagtactccgggccgaccactgtcgtctcagtcgtcgcttggtccaggtagcgccgccacggcaccgtccggttgagcagcagcaaatcgccgatgatgatcattccatggctggcgcgggagatggcgacgtctacccgcgcggcataagcccagaagggctgcgagtcggctccactgtcgaggacggagcatgttgtgacgacgacggcaagtgacgactcgtgcccctgtgttgcgtccgctgttgtcactaaaatgtccgggatttcttgttgggccaccaaccgttcgatctccagggcttgcgcggcgtagaagcaaatgcagcggacgagtgtgcctgggaaggcccgcgccaaacgccacagtgctctcatcgccgtgtctgtttgtccaggattggccgaagaagtggacacttcgtcgcgttgcgcaggcgtgctctgatggaccaaaattagagggactccctttttcggcaatttgaaggccgcttggtcggtcatgagtgcccgctcggagtcgtcacgtcctggtgtcaacagctcgccgtgcggtttgtaaaagccggcctccgtgcagcggaccagagcagaatgtgagcgaaaacagaccgacaatgttgtgacgtccgtcccttgcgcaacatccaggttctggatgaccgtgtccatgccgaagccctcacggattgcgatcggcagggagggcaaatggacacgcagttggcggcgatcgccggtgatcagtaccttggttaggcaggggagttggcttaccaagttgaggatttggacgtatggcgcctgtccagcctcgtcgatgatcaaatgcgtcgtctccccaaatagtgcaggtagttgctcacaaaaggacagagtggcgaagcacaggcggcgatttttgtgctcctgcacaatttgaatacaaaaagcacaacaattttcaaacaaaaattgctttttctcattttgtcagcccaacaaaaagcggccgaacaaaaaatgacacaaaaaagtgaaaagaaaaaatttcgcaatgttttgcgtcgaccaccacccctcggttttacactttgtgaatgtaacaattaaaatatgctttgaacaaattaagcattcattaatgggcatttaatgatcaaattagggtgcaattggaatcggggacggtgtactgttgcagtggtttgaggatgggtttactgtaggtgtcgatgttgg

SEQ ID NO: 28875 - DNA, 1434 bp, Heterodera glycines
cgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttgggtacgcttctgctcaattagcaaaaaatatgagtgatcgaattttcactaaaaaagatgcgagtatcgtttttgttatcgttaaatttatatccatgtttggcatggcatgattcaccgctaaccggagtaggatagagagctaatcttgagggtagggtggattccatgagataacaatagatgacgacatatacaatagaggtgcaaggcgatatcgtgacagatgttagataagatcgtgtgatataatgggcgtatcagtcatgaaggaaaaacctagcctcttaaacatcagaatatgtaccaaaataacaagtaaaaataaaaatgaagacttttaatcgaactaatcttttgagaactgagttttcataagaagcaagaaaaaaaaaaacaaaaaaattgcatatagcggattcgaacctggtgcgactgatactaaagcattacctctacaccatttgacaatgcgactggatcgcaacaattatttaatttggtcgctcatcaaacaagtttggcacgtcctatctcggcactcatgctcattcgacaaaaatagccaaaacttcacaattagaacctgggcgtccatctatcccacccaccaaatttcatttggaaatccccacggccccttgccgacccctccttt

SEQ ID NO: 28876 - DNA, 1035 bp, Heterodera glycines
gggggggctgtcggacatacaccgtcggaaaaaacaaatgaaatttaaaagaaataagtcaacacatccaaacattcgccaaactgggattttaagttgatacttgaaaaaattaagtaagatattgtggcccgacaggcaccaaattatttttagaaataattttaaaaaataaaatgaaaaaatctaccattttcggggttgaacccaagcaaaaatgacttaccaactaagctatgtacatcaagatcatgtgattaacaccacccttaaattggtcctactcatctttttccagaaaaattttcataatcccttataaatttctttcgaaaattttcccgattttcagtgtattttggggtgtgcaggtcaccatgaaggagtagtctgatcaagttggtgtaaaatatgttcttttttgatcaatatcaaaatttagcttattgttagcaggataaaattcagcagcagaagcggggaagcaaattgaaactttatttgttttttaccggcataaataattacaataaattaatttccttcacattatgaatttgatttgattgttttttccaaaacaatccttactcaaacattagtaaaaccattaaattaagaaatattaacattataaaaagactctttttgaataattattaaaaatactgaatcgattaaaacggcatttaatggtcactcattttgaattaattgcctccattgacacgaaaaacaaatgtttgggaaagggaggacaaaatgacagaatcttcgcaaaagtcagcaatgcaaatgaatgcattgtttatcatatcgattttctgtttataattacggaaaataaaataaacatttttaaaaagaaattaatggaaaccaaaaaagataatgactagggagtccacaaatatgcaccaaaaatggcaaaatatgcacataaaaagtgaaaaatatgcacataaaattttccaaattaagcgtaaaatctctcaaaatttcttccaattcgttaaatttaagctaaaatagcta

SEQ ID NO: 28877 - DNA, 983 bp, Heterodera glycines
ttgttctttcgctctgttctagagtccttaatttaattatattcatattgacgtattttataaatttcctatccatttcctatactatttccccgtgcttttcctgtctgcttcatttggtcatcacttaccgcgttcgttctcttcctcttccccctcttttttctcctcccttactctttttcctctactatgctttatcttcctctctcctcactgtgtcctgcttcgtcttccttcctcctcctcttcttctttgttgtgctctgctttatcttcctctttctacttttcgccatttttcttcttcctctttgttgctgtactgctccatcttctcttcctcttcctgtgctcctcttccttttcccccctcccatttcctctgttccacttcacaaaatggacctcgaaatgaacttggaataagaattgttttgcgcttctcctccgtccatcctctcttcccccccccccccgcccgccccgcgtcgcttttgtgtgtgtgttcatcccgcgccctccgtttgtcgcgtttccgtccgtccgttttattcctccgcccctccggcaacggcggcgctgaccgttttacgcgtgcgcgaaaaagaaacgcaaaagtggaagccaaacaatggacggaagatcggcggagggagaccgaacgacgaaagttggccccctcaattcgtgtccaattctttcattcatttgacctcccaccaccgccggcggtcagcaaatgatgaccattaggaaaaggacagggcaaaaaaaatattttttaaattaaaattcaaaatttggcgacagaatttgaaaatccatccaattggaaatgtgtgaaaaagacttcacatagataagcaggctatatggaaaattgtgcctgccgttttccaaggcttccgaattgagggttcagtaattgtcaaattttttatagaccccactttctagcatttgtaaattaaatataaaaa

SEQ ID NO: 28878 - DNA, 1034 bp, Heterodera glycines
ttcttcgacgtggccatcagcgggttgtttcgtgacaaaaataaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttggaacttttcttcgacgtggccatcagcgggttgtttcgtgacaaaaacaaaccagtttgaaagattcgaatgagctagacgcgctctacattttcaaat

SEQ ID NO: 28879 - DNA, 835 bp, Heterodera glycines
  misc_feature (781)..(781): n is a, c, g, or t
ggtcagaagaaaattttaaatgaaatccttgcaaccactaattaggcttttaccggaaaattagtatataacctcaagccagacacgagaaaatccttcctcagtttaattgacacaaaatgccttacaaattcatcatggccttaattgggcaattaattcctaattgatccaaggaaggcttgacaaaatgccaacaatttttcgggattttgatgccaaatttctcctcgagttttcacatagtttgttatcccagtctcggcaccattgctcaagagtctcgacaaccttgtccagtctcgacacccccactcatttttggaacccataaattttcttgcccaaacattgaatcgcttttcaaatttatttgttttttttcatcgcttggcattctgtggatgtgattggaaaataaactttgttgtgcccttgtctctctctctctctccttctgcttcttctgccattggcacctctgaacagcagcaggtggcggaggcgcttcattaattttgtcgccgggggcaacaaaatttgattttatttttttcttgccccgggccaaaaaatgccactacaattttcaaaaaaattccctgttgacttgtttgctttatgtagctgctgaatttttcttggaagatttatttttgtgagtgggagggggccaaaacccaaacatttggagaaggggggggggcacccatcacccatcaccacgaccaatcggtggcggatcgactcggtgccatatcatcaacaaattggcccattntctgcggacccgtgattattgccatgagaacccccggtggggtttgctctcccc

SEQ ID NO: 28880 - DNA, 1889 bp, Heterodera glycines
cgtgttcatttcctgtgccgacgacgacaaatttgtgttgtgccaaccttggcattttgccctttgcctccgggggcggcgatttccttttgaccaaaactcttttaatggcattggcccaaaataaatttgaagaaatggccaagggatggcaaaaacaaaaaattaagggggtataaattaatgagagcggatttttgtgtttaaattggtttaaaaaaattttttttaaattaatttggcattaaagtttataaaggtgagaaaattgcaaattttaaatttttaaaatttttaaaaaaaattttaagcaaaattcaatttaaaaatcaatgaatctttaaaatctaaattaaaaaagcggtaaaagaggagagaattttgtattttttcaaaaaaaaaaaaatttaactaaaaaaaaatttagaaaatatttatttaatttaataaatttttaaattcttataaattgccatttaaagagtttggcctcaaaaaaaaaactcggcgaatgaatgctgttcaaatttgcacctttttggtgtcactgttttttggcacaacatttcaacaaattcccgctgacccttcgtcaattgatgccaaatatgggccgctgaggatatggcgccaagaccgttttgtgaggtgctaatttcagctaaaaatttaaccatggcttacagggggaaattttccaaaatttttttttttttgaaaatttaaattttaaactaagggaattcggaatgcgaatttcagctgagttttcccgaaaatttttttttttaaaaaaattttaattttaaattcaggggatgagaaatgcaaatttttgatcagggcctataggaggctgattttttttttttgaaaatttaggaagcgaaaagcaaacttcaattgaatttcccgaaaaaaaattgtttttttttcgaaaattttaaattgagagacgccgaaacgcacccaatgaaaaagaaacaatcgtgtctatcttaaaaataataataaatgtcccatgttttgatcattttttcaattttttcgtgtcttgcgttaaatttaaaattaaaaaaataaataaaatccaaaatttaaaacctattttgaatttaaaaagatgcattttctgcatgaattatgacgattacaacaacttgagcacgtacggttgtgatcggcgccgagttgcaacatgtgttggcaacatttgctatatgcgtaagggtcaaaaataaacatttaaattttttttattaggtgcgaaatttgctaaaaaattttggaaaattaaaattttaaacggaaaaaaattctaaatttaaataaaaattttttttgataatttttttattatctttttcaatgacatattaattcttaaaaaaaaaaaattaaattttcaaaaaatttctggacttaattttcttatgggcgagtgagagtgtgggtgaaaattctatgaatttatttaatttttaattttttggcgattttttttttaatttttaaggtcagcacaagaagcccgaatattttttgtacaccagcggttgtgtgaatttgacttggtccgatttggtcacaattcgggcacaaatttcggcacaaaatgaccagggattgttattgttaaacaacaacaacaacaacaacaacagcaacaaattcactttgaacaacaacaacaacaatgaaacgcaactttgcgaggcaaaaaaaaaaaaaaatttatttttaaattttttctattacaaaaatgttttagctaaaaattttttaaaacaatggtgtttattaaattaaaattaattatcggacaataattaatttggaattaattttaatgatttttttacagaaaaaataataaataatttgtttag

SEQ ID NO: 28881 - DNA, 1597 bp, Heterodera glycines
aaatacggttgaacggcatctatggcgccggcggtgctcagtgacgagtagcgctcgtggacagcgccgacggacgacggcacgaccggcgatgggctggccggcgtcgaccgattgtgcgccgtctttttctgtacgaggaaaatctaactgagtgccggtccggcgctcaaatggcaatgccccaaatgagaaaaaacaatgaatcaaacgcaaaaatagcactcaaacggccgtgtacccggcgctcagttggcaggattggaacccatggagcgacggtttaagtgcccgacacttggtggcgcctagttggttttttaccaaattgctgcgtttgctccgctgcggacagtcgccgtcggggccacccgcggcgccggctgtcgggcgccggccagcgcgtgggtaactgcgccgcccgacgccgccgagcaccggcgccatcgccggcggcgccaaaactttgcccgatgcaacaagctggacgctgccggtggcggaaagagcatcctcaaagcaacaagacggttccatgtagacagaactgaattttttttatacaatattaccgtatgttttttatattgcctatacggtatgtttgggtattgtaatcactcaagcaaggtccttttctttcttacccgagctctttggcggttgccgttactgtgtctccggcgccggccgtggtgacataatcttccgcaaaaccgtactttttgaccgaccgttccgccacgcgtgtgctaccgtaccctcggttacggtcaccgtcatcattgtcattgttccacaacagaagtgagacgaccaacaacagcgtgccaagtgccatcagtgtgtgcagcacggcttggccaccctccaagtggctgaaaaaattttatggggatgttgagatcactaattgggttaattcgagccgaggcgttgagccttcgcgatagcctaggattacggtaattaagagtctcgagcaacgacagttaatatattggcaaaatgagtctttggacttgagaaaatacggagatgatttgaaaagtgcggtactcgagagtctaggtaggagtaaaaatacagtaagctaaaaccaaccaaaaaaagaaaagattcagagagagatagagacagagtgagagagacagagacagattgagagagattgtgagagagacagattgagagagattgtgagtgagagagagagagagagataaagaaagagacagaaataaataaaatttaaattttcaccaaattacagtatctgactgtgtctgtgtactacagtaattgccccacctgtactgaattggacagtgctccgttgtttgctgttgctccgattgttccaccgaatcactcaaattgaaatgcgattcgcacaacggcgtgtgccgtagaaagaagctgtgcccaaacggaaggccaaacgagagctaaacaaacaaaaaaaatgatgtaaaaaaaatttcaatttcaaattttctgatttgggagggttcgataggttctctctttctgatcagtaaaatacagggaaacaaaaggttgagcaagcattgaactctgctaaaatttttagagg

SEQ ID NO: 28882 - DNA, 922 bp, Heterodera glycines
  misc_feature (15)..(15): n is a, c, g, or t
caaaaatatttttcntggggtattttgatatgctgagcatgaatctgatgttaattttcagtttaggaaattttagaattttttaaaaattcaaaaatatttggcaattttttgaccctcaggattttgggctaaaatttgaaaattcataactcaatggaggaccggtcaatttaagtgaattaaagctttaaaaatagcaaaaaatcgggagaattttatgggatttatttgggatttctatcttctaaagaaaaaaagttattccagaaattctggaaattttagatttttcagaaaaaaattcagaactcccttctgaaaagtcattctgtaaaagtaaaatactacaaaaattcgcaatttttttctctataatataaattttattttacatttttatctcttttttgcgaattgttataaaaataaaagtgatttttggtttcgggaccataggggggtgaccaggatttttgggtggaaaaattttttcaccgaaaatattccaaacacatgtctttaggggtattttatgacgctgatcacgaatacgtgatcagattttacttttgacatcgttcagacctcagaatccctgtgtgattggggattctgaggcatcattttgaggggggggggggaagttcgaatccgggcggtgtacattatttttctttgtatttttgggttatttttaatgttttaattaatttcaagatttttataaatatttaattaatttatttaatttcattatttattttttgaatttataaaaaatgaatttcatttcaaaataaatattcaattattaattttcaaattatatttaatgaataacaagaatattttattattaaaaaaattttaaaattaaaatgcaaatccgatttttataaaaacttttcattatttattt

SEQ ID NO: 28883 - DNA, 1497 bp, Heterodera glycines
  misc_feature (1449)..(1449): n is a, c, g, or t
  misc_feature (1456)..(1456): n is a, c, g, or t
gtacgattttgaaattgagtaccaacaaacattggagttcggcctagccgatgtgctttccctacttattgcgaaaactccgatgccagaagacgacataattttggccaaactctctacgagtgctacaagatgaaatttctgcgcactcagtggcccgacaaaaagacgatgcggaggacattgtcccttttcaccgacggagagaagcgttgtcaatcgagaatgattgtttgatgtatgccgaacgggtcgtgattccaaaatcacttcaaaaagaagtgctgcaacgattacatcactgacacccgggcacaaaacgcatgaaaaatctcgctcgtcagtatgtctactggcccggaattgacgatcaaattgaagaaatagtccgttcctgccaaacatgtgcttcggaggcaaaagcaccagtaaagactatccttcattcatggccaaaatccgatggcccatggaagcgtgttcacatggactatgcgggaccattctttgggaagatgttcctcgtcattgtagacgcatattccaagtggcccgaaatattcgagatgaattccaccggttcagccgccacgattggtaaattgcgctatctttgcgcacggcatggactgcctgaaacgttggtcaccgataacggtacccaattttcatcgaaggaattcaaggaattcacccgactcaacggcataaaccatttgttttcggcaccttattgtccgatgtcaaacggacaagccgaacggttcgttgacacattcaaacggacgtgtcgcaaattaaagaaggaaggaatcaccgaaatgttgaacacatttttagccacataccatgtcacgccgaatgagtctttgcctgaatgcaaaagcccagcggaactgttcctgcagaggaaactccgatcgacattggaccttttgaaaccaaaaaaccgtatcgtcatccgcgatgaagcaatggagcgtaagttcaatcgacgccatggcgcgaggccgagatcgttcgacttagacgatatggtctacgcccggcatcgactgtcgcaggattggcgacccgggcacatcacccaaaaaaaaggtgtaatgtacgacgtcacttttcaggacggatcagttggacgattccatgcgaaccaacttttggttcgacattctgatgttgatgaggaagatcccctcgacattttgaatgatgcctttggacttccattggcacaggccaatcaacaacttggcgatgttgtggcacaaccagctggaggagtgattgagatagcgccaccatctccgcgtcccgatcagccacagcagctaaacgaggtcaatgaagaacgtgccgttcaacagaatgttcaaaacgaacgaccccagcgaaaccgtcgtccgcctgatcgttattcgcccggatgaaagaacccacttttaaggnggaggtngtcgggatgggaccgttaattttgtaaattatattatattt

SEQ ID NO: 28884 - DNA, 1072 bp, Heterodera glycines
acaaaaatggtcattctcatcccaaaggcattggcctaaaggatttattgcgtaataagtaaatcaaacgaactctttgataacggagacaacgaaacgatatgaacgtaggacaacgacggatcagaaacaacagaagcagcagcaaatggaaactttggcagcagaaaatgccattccgatgccccaacaatcccttacgatggaatgccatggcacaaatattctttgtgttcaggtggtcattctcagcctatatttaatgaggcatgccacaaacagagcgagttcgacctgcgcactgtgcgcgtcgcggcacagtgcgacgcgccggccgtcagtccgtcgttggtccattctgaccccaacctttgccagaaggacgtcgcttcagccgcggcagcactcttcgcatcgcccggcactgccaacaacgcattaacggaagagcacggttttgatcgaacggacggaggaggaaatgccgtggagggcgaaggaaatgcagcggaagaagacgagtcgcgcggcggagacgcggcggacggaggcgcggcgcaccgcgtggagggaagtgcgccacgcagtgcgacgtcgagtcgcaagtcgtcggtgaggtgagacggacgagggaagatgcatcgaaaagccaagaattgattgacctcattaaaggtcaattggtcggatggcaaaagattaaacccataaaatgccaaccgatccaaatgccatcgattgatcacttaagggggcgcctgcggaaccaaagcgaattggaagtgaacgcgcagcactacaaaatgcaaaatgtgtacaaaagtcagcgggcgcgcaaaggcaaaaagttgctgacagacatcgattttgagggcattttgcgaatcatcggcggttgttcgacttggcaaattctgatctatctgatcatctcggcccaccaaatgccgcacgccatgttcaacctatctgttgtttatttcacctatttgcccgaccattggtgcaaagtccgtaaaaaagggcaaaaaaagggggggcaaagaaatggccaacgaaaaatggaagtgat

SEQ ID NO: 28885 - DNA, 995 bp, Heterodera glycines
atatcatgatgcgacccaataatcaatttagttatctcatgattaacatgcaccccaatttctgaggaggaattcagattatgtagcaaaatttttccagatgagactctggaaatttatttaccaattgaatagtatataagaatatgaatttaaattaaattaaaaatgtataaatttagctccgaagtgaaggagaatacagtgttcctaaagaagcttgcctccaccagatcagaacaaaagaagaacgaattaatcgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttggtcccggtactgagtgttttagcccaacatttattagaaaaaataacatcatgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaagacgtacggtaaaggggatacttgaaaatagaccacagaaggtagtgattgagaatcatgtaccaggtccaaatgttgcaccatatctgggcctcaataaccaatccaaaccacaggagaccgaagaaccacggaaaataattattcctaggaaaagacttgaagagcaaactcctgatcctgaatcagataatgatacacttgaggagttaactccggagccccaaacaacatccacattaaaaacacccattacgatcaaaactattatacacccgaccctttaaacg

SEQ ID NO: 28886 - DNA, 1019 bp, Heterodera glycines
aaaatcgcatgtgatctaagcctagaaaaaatggtctaagtaaaatcgtaattacgctcaaaaagcttctcaaacaattttagcgcttcaaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagctttctcaacaattttagcgcttccaattcctctacaat

SEQ ID NO: 28887 - DNA, 1793 bp, Heterodera glycines
  misc_feature (590)..(590): n is a, c, g, or t
gagacgctggcacatacaaacaacaacaacaaattctgtttgaatgatgcggattatcccatggagggcacggtcgaattgttcgtgcgcttcgctccttgcagctcgtccgtgcaacctcctcgtcctgactcggccgatgtcgacatgcgcttgaacgcttattgagccacattttgatcgattgttatcagtccctttgattttgttacaaataatcatttttgagtatgaccttagacttattgttagctattcattatttctggaataaaacttgaaaacaaggcttatccaaacaaaaatatctgttaaatgctgaaaatatatttactgacggttggaaatgcgatcgaagttgtgcagtgggttcttgtcaatgttttcgtaccattttatgtttactttagtgagaggatttttcagtaccggcactaaaaagcacttaagaacagggttcggatcgaaaaattttcaaaatcagaacatcgggtccaaaaaatcagattttggggtcgaaaatcagaacattttgcaaaattgcttcaaatcttttatttttacaatttattcgatcaaaaatgtattanatattatatttttcacctcccatgatcatctttaaaaattttggtgaggaaattaacaaatcgtaaatttcagtgcactcgggatcaaaaaatcagatttttaagaatttttttgcggcgcatttttccaaaaaacttttgggaaatgggcgaggggagagggtccggcgatgccgataggcgccgccggaaaattttttgtaatttcgttctgatttgttaacagattttcaccaaaaaagtgccaattttgcaattaaaagccaagcgacgacttttttttcgcttttaaaaacgctttttttgcggggcccttcttccaaaattttggaggacagggggcccggcaaaaatttgtgattttagtacgatttgttaacagatttttgtccaaaaaatgaccaaattttgccataaattttatatttttttctaaaatagtgacattaggccataaaattttaaaattatgagtttgtttaagaaatcagaacaaattttgatcgctaccccaaaatcagaacatttctgataaatcagaacagatcgcccctgggataagcggaggaaaatgaaaaatgtccaatgagaagggaagaccaatttaacatttacaaaatatgaaaaacttcttgaagtaatgagcccacgaggcctaaccttggaatattcaattgtaaggagcagccctcgtccccaaccctttttaaggcttcgaaaattcaattaatttttctcgcaactttttaagcgattggtggggggtgacgtgcagccaattcccgtgagaatgggagagaaagacaaaaacagaagggaatcatacggcgaacaaagaaatgtcagagggatcagctgatgtcggggagatgaatgtttgttggccaatgatcagctgaagagaatcccagtcgagtaaaaaggacgaaaatttacggagaattaaggaaaattgggggggggggggggaagcattatgaaaaatatacaattaaagaatgaatggcataatgataaagggacggatcaggatcagtaacatgggctaaaatggtgacattgtttcctgacaaatttaaattcaaaatccgttcccaaatggaaattgcaaaaaaaggacaacaaaagttgcctttgaaacgcactttgaatgaatggaatcgtttgggagaatgaacatttcccaattcgcatgatgccact

SEQ ID NO: 28888 - DNA, 997 bp, Heterodera glycines
ttgtccattttaggagtcctcaatgtggtctttggaagtcccagacatagacaattttgaaaccttgagaaacatcatggactcctcaaaacggcaagactatttgccaacaattcaatgggtgaaagcgaatcgaggcgaagacaacgaccgacacgacttgctgtttcgccttcaatgccagcatgtcatccgattgttggaaacaagtaggaaagggcaaggaatggtctaaaaaagtcaaattgtattaactgactatttttggatgggtttctccgaatgttttttgatttgtttagatggtaaaagacaagctttgggttatgtgaaggaaatgcaagacgaagagaaggaaaagtacaaagaagaattggtaaatcgaaaaagaaatgagaaaacttagaaaacgaaaagtcttccagaaacatttgatgttcgtcgtgatgacccacccgcagaagggcccccacgactatttgttcaacgagggccgtcgctttgaattggaatggaaattggccaatgcgataacggactatcgctcttcactgtccacgatgtaccaatggcatttaatcgttttaatcccaactattttaggcttaatgctggtgccaaaaccgtaccctctctcatgacaatgcgagcctttctgaatacttcccgaggagggatggcgacactgcccgacgaattgccggtaaaacaaataatatgaattaaaagtcgattaattttacgcataatttgagtgcaatgtgccggtgcctgagcaagtgcattcttcattttgctgtccaattctgaaggtgcaaagcacagaaagcgtaaggcttttttccattaggtgtacttttatttgctcattgacagaatcccccggttcggctcaattgcggccatgtgatcaggttgatttcatttatatttattagaaggagtgtttgaattgtttttggttaataacgatttttcttttttcacccaatttttt

SEQ ID NO: 28889 - DNA, 1754 bp, Heterodera glycines
cttcccgacttttcctttccttcccttcgttctctgctttattttctttctttgcttagctttacgttcccaccgtcgaagacactttccatgtccaattcggcgactttcgttccgttgaccaaatgccgcagcgctcacttctcattcttttccatgacactgctggcataacggactttggcagcattgagttgagaaaaccgtaccttcaggttattatcgtaataaaaggatggggaaattcgaatttccttgccaaggactgagtcaccaaaagaattccgacccgtccggggtttagtcttcaatactccaataagaccgtgtaaacaatttagagaaaaataagattcaaaagaacagtccccccccccccacaatacactccctcgagctaagcaattgccattttgaggttgccgatgcctttctgctcgtttattccgttttggaccctttggctttaagtcaaatggaagcgttgaaaaaatatttggagagggaaaagaacggcacgagcaaagaacggaaggaagttgccctttctgtgccaatgccttcaaaaaaatatcccttcccttttcaggtaccaattgccgtggtcggaacaaattgcgaaatgtcgggcaaaaaagtgaacacggaaagtgcacttctctgggcgagtcgtgtgaaaaaggtgggaagatgaataccatttaaatttatgcaattgaattcgaaaaaacgctaaaagggtaaaaatggtttcaatgtgctgaagaattaggccgagaaattcgccaaaaagataaaaaacttattgctgcttcaattgtaggtaattgaaaacaaagcaagtaaaagcttagctaattaaagcttttacttatggtaagattggaaaagagaaacgtaacgttgtttagtcaaactgttcgaagtgtccgcgaatgaccgaaaatcagtcgccgaaattgcgcagcacctcagcgaaagactcatccattcattaagtgggccattaactttgccctttttctgtcggtctttttgcatctcattcacaaccagcgatcaaatttgcaggagagtttcaggcatataaattaacttttttttttttttacttttcatgtcattttctcagttttttcgaatgaaacggcatgaaatacaaaaattaaatgcttaaaaatgcaaaaattggttgcgataatctgttacttttaacagaagactcgaagttctcacttagccggaaactgaagccagagaagtcaaatgcacagattgtgatggacttttaatattaatacattgatttgaccaatgtattttattatttcattatattgagaaaaatggaaatcctgtaagcatttgctccaaataacaaattcggtcaccatattttgctaaatcattatttatttattcaaaattttaaaaaatgcattttcgaaataaagctttttttatttgagagttatgtgtgattccttctttttttcattcgtttcaggcgatccaatatttgttttaactttgtcactttacaatatttgttttgacacaatgcccaatactccgccgcctccgtaccccgggggtccaaccgcagagccaacgaaaatgcaacatgggggcattccagtgtaagttcatttggggtaaaaatcagttaagaatgctcacatgacaatttgaaacgatacgaaatttgcctttcctccattttccctgtcattctcagttatccgcctccccca

SEQ ID NO: 28890 - DNA, 1771 bp, Heterodera glycines
  misc_feature (111)..(111): n is a, c, g, or t
  misc_feature (1704)..(1704): n is a, c, g, or t
  misc_feature (1712)..(1712): n is a, c, g, or t
  misc_feature (1732)..(1732): n is a, c, g, or t
acagcagggggagcagctcgtttcccgtttcccaccgccgcccgaaaaaatttaaaaaaataaaaattcaaatagaaattttccaagaaaaaatcttagaaaatttcttgnataagaaagttccaagaaattctatccttttttgaaaattttttaattaattaataagggttttttaattttccaaaaaatccctgaagtttttttcattttttctttaaatttctttaaaaaaaaatttaagattttttgaaaattttcatattttaaaattaaaaaaaaaatgtttgtggaagcgggataaacgataaagttctagcaattaacaatttttcatttctttgaattatacgttttaacaaatcaattattcactaaatataaaattaatttttaaaggaagattttaaatataaaaattaataattaaaaaaaacaatttttaacttccattttaaggctttttcacgcccgtgttgcccaagccattgagaaaagtcagcagcagcacaaccaaaacaagttcaaccagtccagtgccaaaaagccatgtcacaacattaccaagacgtacaaaagcatggacaacaaaacgaacaacaacaattgcaacaactgagacgacaacaccattaacaacaacagctccaactgttggtgggtgatttgattttaatgattagcccagttttgcagtgcatttcaaaaggacaaattgatgaagcaaaataattggggagtaattaaaggaatgatcagaaggccaagagaggcccgtagccagaaaaaaaaaccggagggggaagccgaacctttttattgttgttcgttttcaggccagaaatttcaaaaaaaaatttttctccagttttgttttcaaaattccaacgccgggaagaaaaagcaggaatttttagccgttttcaccaaaaaatgacaatttttgctatttgcgagtcaaattttcaagaaaaatggtaaaatgagggcccgtcggtgttgataggtgtaaaattttgtaaatttaaagcaatttgtaataagcatgtgcgaattgttttggcaaaaagccaaatggtcttgaaaaatttggacccgatcagagcaattttggaattggcatagaaatctggcgaaatgcactgccatttttagcttttccatcaattttttttttgttgctcgcttttttatcaaaatgttttgtccattttctgttcttttttcttctcttttttgttatgcttcaatttttacataaaatttgttcattttttttcaataattttaaattttttaaaaaactttcgtggtggcactcttttcacgcacagtcgtccactcacattttcattattatttccacataataattgtagctacggaagcgccgaaaatttcaaaatttatttttcgtgttattaatagagcccctggattttgaaaaagtcgggatcggaattcgggattggcatcagattggtgtaggattagcgggattgaaatccttgttttgctcccgattttgtcgggatccagatcccggctcttttttcaaaaaagggccgggatcgagagcctgggaaaaccccggcggtatcccgattcgtgtctgggctctaattactatacaaatattcaaaatcaaaaaactgtgaacacatattaaattggaccttgactgagattatatagctaatattntaatacantaaaatttaaaaaagaattntataaaatcatttccaaaaatgccaaaaaaaataataat

SEQ ID NO: 28891 - DNA, 1250 bp, Heterodera glycines
cggcatggaaaagtcggttcaacactttctgaatggcaatgcgataagaaaaaggcaacactgaatttggcttggccacggcaaatgccattcccaattcccacccccttttgtggccgtttctgctgagttggcactgctcaaaggcattctttttggtcttacgctgaaaatttacgtctttttggaccaaaatggccaaattgaaaaaacagaaggaatattattgggttgaatggaatggcattggcacttcctttcccactcagtccaacagaattcccttggcaaccgatggaagggaaagaggtgggcgaagaaaaaaaatgacaacgaaaaatgtggacgaagggggggggggaaatgggataacgaaacaaatttaaaaatgaaaaataattaaaatataattaaaattaaacattgtccattcccgtcgtatgagaaaggaaaggacgtaatgaacatgagcaggtccaaaaacatcacctttttcagtatttctaaattatccaaatggaattggtcaatctgaaaagtttaattttttaaataaatattttcttaaaaagttttcaataagggaaaagaacattcagattattgacacccgaatttcgcattcaaaaatttgaccattggcttttgttgtttccattttaggaaaatttttgaacatttaaaatgaccatgttttaattcgttcatctttttaaaaacggaagtcatctcctaactttttgtaaacttatttgttagttatattgtcttattaattccccattttggactctatgcaaatcttttaattaattacaaaatattaaccctacaattaatttttattaattgatggtaaaggaaatggtttaaatttttcttttttataagaggataaaaacaagttcaccgtgaaaaaaaaggaaaaaaagaaaagatactttttaaaaggcacatgagagagaaagagtgttagagagagaggagagaaagagagaggggagagagagggagagagagcgagagagagaggagagaaagagaaggggaatgggagggagagagaagggagagagagggagagagagcgagagagagaagagagagatagagagagaggagagaaaataaggggaatgcgaggaagatgagatgggagagagagcgagagagaggagagacagagagaggggagagaggagaggaagagagaaacatagtaactaaaaaaggactggcgaatacggtat

SEQ ID NO: 28892 - DNA, 1009 bp, Heterodera glycines
gcacgggtccggcacctccttcaacacgctgtgttttttcgccgttgggccatgaaatttgtttttgtaattccaaaacaatgggccaaatgcaaattcaaggctttgttcagagacttgattatttgctgtatcaactgccattttctttatgtctgcccatttagcaaaaatatatcgaacatttcgaacaaatggcgttccgtttacatacgtttgctcatattcttttccttcagcacatatttgggcgaaatctgaaaaaaaaaacttgcatgacgataaaatcacttgctgcgaaaaacgggtagccaattttaaaaaaatagactgtttgaatttggatttgaattttttcaaattctattttttcataatcatttaattagtatggttaaaaatttaagccatataaaattcagaaagtttgaaaattactgaaaatttgtagtggatccctctgataaaactttctaatttattttttgcctaaaaattttcatccttaataatttttgtcttaatacttgcctagtccaaaatcacgagccaaatcccacagcttcgcaaattttgcaaaaactactttcaaatattccacatcttttctttcctttttattttcctttagcactgtataatcgtacataaattgttcaattgcattaataaaattaattttaacagtatttttctctttattaattggaccactcggattaaatgttccaacaaatgcgcctttaagaaattaaaattaattgactaacagattacaaaaatggatttgaagaaattaatgaatttattcggaaatacctgaaataataactagctaaaagtctatataatagcctaattgttttttcattaatctaaaaatgatcataattttgtgatcaaaataattttttctcggctctcaaaccggcactccaaactccctcaaatatcatctaataacactctatgaacttaaaaaaaattcattaagtaaatcacgcctaaa

SEQ ID NO: 28893 - DNA, 1028 bp, Heterodera glycines
gttgcttagaaaggcacttatatggttctcaggggcgctgaacacgttatgacatctatttagaccaatttcgaaccccggaaacggattcgacctaaagccgaaatccccaaaaagtcggaaattcaaattttttcaacaatgcggcagtgaaattatcaattcgtccatgatttaagaaagaatgtttaagtgattaagaaaattatataccgtatttgctctaatgatcgccccggggggattattgttatcctcagaaagggggggattattagatacggggggataaatggagacggagggattattgttcaaactcctcagaaaggggggggggcaattggagacggcggattaatggagacggggtgataaaaagagcaaatacggtatgttagttgcagtattatatgaatgcgaaaattgattccccattattgttgtttctgtgcatttggttatattgttgaaaaaaatttttgagtgattttctaagcaacctaagatgatttaaaaaattttaaatttgtggcgtacgaaccatatacagtaataagttccttattttttcttgtttttctttcgttctctctttctcttccccctcgtcgacccttcactgagtactgtttttcggtgggcctgagtggtaagtgataagaagattaaattataaacattatgccataaaatatttagttgctttaaaatttgaaaccgtaggtttcttatagcaatggctgcatttaggttgaatctacaaaaatcacttttccaacaagacggcgaaaggttattgggactggcaaatgttaaaaaagactccaaacggaagaaagagctactattatgatatgtataaatgactgatgctccgatacatatttgttgatttgcacttattgttagcctgcgaaagtgatttttaggactttcccctcccccctttccactgtttcccccttcgttcccccctcccctgttttccctcccccttctccccctttttacattcatactgttcc

SEQ ID NO: 28894 - DNA, 1029 bp, Heterodera glycines
ggtattattttgtagtctttttttccacaataaacttgtcaaaccatcatttttcgcaccgtgaatgttatttttattgaattctgaaccggtttgagtagattagactagaaaaaattgaaaattttgaaatcatgtttcccagtagattagaatttgaaatcatcccttctcccaggggtattattttgtaaagtcttttttccccaataaacttttcaaaccccttttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttcccccaataaacttgtcaaaccccatttttcgcaccgtgaatgttatttttattgaattctgaaccgttttgagtagattagactagaaaaaattaaaaattttgaaatcatgtttcccactcccttctcccaggggtattattttgtaaagtctttttttcccccaataaacttttcaaaccccc

SEQ ID NO: 28895 - DNA, 1015 bp, Heterodera glycines
tcggggttccgatttctgacatttggggtcggggtcccgatttctgacaattggggtcggggttccgatatttgacatttgtggtcggggttccgatttatgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacatttggggtcggggttccgatttctgacattttggggtcggagttccgatttctgacatttggggtcgggggttccgatttctgacatttggggtcggggtccgatttctgacatttggggtcggggttcccatttctgacatttggggtcggggttccgatttctgacttttggggtcgggg

SEQ ID NO: 28896 - DNA, 1972 bp, Heterodera glycines
  misc_feature (1902)..(1902): n is a, c, g, or t
  misc_feature (1939)..(1940): n is a, c, g, or t
  misc_feature (1946)..(1946): n is a, c, g, or t
  misc_feature (1954)..(1954): n is a, c, g, or t
tgccattttttacacaaaaatagagaaataaggaaaaaatgaaatataaaattggcattttcattaatgaatttatttgaacggtaaaatcataacagcagctggtgaattgcgaaaacaagtgccttaaaaagaaacagagaattggcattttaattaattcattgttaattaatttttgtttggttgttcagaaatttgtttttatcaattttgtttttataattattttcaaaaataggacaaaaatggaagcggacgtcaaattagaaaataagttttcgtgtttttaaacaattatttattattcatctttttattaaattatttcattaatttatatgcatacccatatttattattttttttaattgcttttggttggaatgtgtaaaattttattttgtttttgtcttgagagaaaaaacacagttcatttaaaaaatgtcaattgtaaaaccttttactcaaacagaattttaatttagctgtatattttttttattgatatagaaaattttaattttaattttactttttattttaaataaaattttttttacatattttaaatcaaaaattgattttaattttaatataagcattaatgcatcttttattttattaacgaagaaatctgctatccaatgttaaataaaaagataaaattcatatgcgttaaattttcctttttttcttaaaatgaaatttctgggaaaatttttacaaatttatttttgcctttcgtttttcgttgaatttatttggtcaatgcattttctgcggctaaattccaatttgggagcattccgtcaaaacgcttacatcgatgatgttgtcattgctggactaattgaggcgaattttcgccaccagcagcagcagacgattaaagagcaattagcaaaaagaaaggcaaatttataaaattaattaatttttattataattaaagaaaatttaaaataattaatgcaatttataatttagaacgagactgaaagaggacagcggaaaaactgaagttgtcagcagaaggggaaaatgccggcaaaactcgaagatggaacgatgccaaaaaaggataggatttctgaaactttaaaatcaaccacatttatgcgatctttaacatatttcataaatacctcacattcatttttgtttatttattttattgtaaataaagaaaaggtccacaacagtgaaaatcatccgcttacattgaggacgtgaaaataaatttaaaaatgtcctcttacgaacgagaaaacaattaaaaacggagttaccacctaaccccgaagaaaattaatcgagtcaataaaaaagcaaaatgagtgaccaaatcgtggaaatttttccgtaaaattatcaagttttaaaaatgtttgaatttatgtaaaaaaaacttttaaatatatgaaatcttttgaaattcggcaggcacaaagctcatatttatttatatatatggtggggtgcttccaattgctatttgcttttgataaagttttcaaagtattttgaaaattttttagaattttctgtgtgcttgctttccaatttccaataagtttatggatttattcaatttaaactcaatatttaataagtcggaaaaatttaaaaaataccaggtcataataaattagcatagctgcttaaaaaaagtatttacacaaacttaaacagctattctttcattctgatttgtacaccccaattaagctctctgttttttgtgaatttagataatttatttttcatttcgaatgaagcttagcatgtttttgggggcttggtttcagttttattggctaatttaaacataattacaaatgtatttaatttaaaacgtcaatattattatgccaatattttcatcaaattgttttccangactttcctgccctatttccccgatcatatcgcgtgnntggaanttattcantatagtcccacgaggact

SEQ ID NO: 28897 - DNA, 1083 bp, Heterodera glycines
tttgggaataatagcgacgaccctaatttttctggatttctttctgggcgagttggcttctgaaattctggaaaaaacgtctatctctttttctgctcaacactcacatgaattccaaccacattttcggaataatagcgacgaccctaatttttctggattttctttctgggcgagtttggctctgaaaattttgaaaaaacgtctatctctttttctgctcaacactcacatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaatagtagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcaaatgtattccaaccacattttcggatattagcgacgaccctatttttgcggattttcttctgggcgagtttggctctgaacatcttgaaaaacgtctatctc

SEQ ID NO: 28898 - DNA, 1134 bp, Heterodera glycines
  misc_feature (34)..(34): n is a, c, g, or t
ggggaaaaaatttatttagaaaggttatcacacnaataatttagcaaaaaatttaatttatcttcattggcgttttaatcagttcaaaatgtccatcattaaactcggatgacacgtatttgcacagataaaaaataaaaattgccattgataaattatatattttatatattcattttatatgttatcaaaatcgaataaaatagttggcacttttacaaaacgaccacagtggcacctttacgaaacattcccaagttggcacttttacgaaacattcccaagttggcactttttacgaaacgacccagcacgacttaaaacaaataaattggatttaatttatttgattatttatattatacaaattaataaacccatattattaaagaaagaaaaaactaaaccccccctagaaactccaaaaaaaaaaagaaatatttaccttatggaaaaagaacaagtagaccttacaggggaaaccttctctaacattaggggaaataagccttaattccataaacattttttgaagaaatttcaattatcatataaaagaattttatattcaatattttttcttgttatttgaatgatttatatgtatttcttaatttcggatttctcatatttaatttaattaaaaattatttaaattttttatgctttaaactattgttaattgaataaaaaaatatattttaataaacaaagcggtgaattcgaatttatttgattttttgaattaactcaataaacaatttgtttaaagttttaaaaattccaaggtataaattaaaaatttatacaatttttttggaaaaaatgtgcgtttttttgcgcgatgccgctagacgccgccgggggaaattttttaaaataatttgaatgcaatttggctttgttttaaaaagaaagaaatatatttatatttattgctttttaatgtattgaaaatttataaacatttaaataactgaaataaatatattttattgagttcattatgcagttttatttgataagataatattttgactttcattaataaatatttgcttttcaattcattaagtgctgaattatttaattattatccgcacataaacttgctttgttcctttaaattcaaaa

SEQ ID NO: 28899 - DNA, 1477 bp, Heterodera glycines
  misc_feature (206)..(206): n is a, c, g, or t
ttttcccttttttttttgtgtattttttgggggttaattttttttttggggggggtttaaaatttgtttctttattttccaattactcattttttgttttgggtttttttcggggatttgttttacgtggatttgttttttaaattcttcatgactttttgtcgtatttttcttattttctttatgttttttgatagtattaattnaattattttcctttttctgggttttttcgtatttcatatttcatttttctaataggtattctattttttcacaggtcaaataccccggccatcccaaatttgtgttcgttactgccgccaacgatgcttatttcaaaacccttcgcgtattaattgcaaccataaaacagagatttggctgtaaagaaaaaataattgcgtacgatttgggaaatatcacacagaacaaatccatggtacggttatattacctaatccgattttcgtggataatagcttcgacggattccagctcctatgaaaattcctcaaaattttattaaatcattaaaataagcatagaaatttatgaaaaatttgtggcctgtcgtcaacacctaataaagattctagggcaaaatagtgatttaacccatttgggatttattcctaaaaatcagggtttgaattccgctaaacatatcctgtggcctttggcatcatttgaacgctcacaacttaaattagctattttaggaaaaaaaaataaaatagaagaaaataattttgctcaattataaaaatgacttttttgcatttaaattaaaattaatacctaaagacggatgagcttaattcggtgtgcaaattgacttggcgaacttttcaaatggatgttggtcgggtgcgccagctgagcagttacgcgtttaaactttttgtgattgcggtaattcaaatttatgaattttgaatttttcgttattttaaggatgtttttttggaacatgacactgtgttttgggtggacacatcaattgtttttcacaacaacaacactaagccaattttggcttcaattcaaacgggcaaaattggcccagtgcaaatgccgagcagtgagtgtgaacacatgcaaatattgtgctaaaatttttttaacttttagttacttggcatggtactaactttgcaactcatccgggtaaaattatattaatgaaactatgatcatacaacaaatatttattccatttaagaacttcgtataattcgttagttaaaaatcccactgaaaaaaatataatttatttaatatttattcttaaatccaattcaagatcaaatggttgctttaagaatttttcttatgttcggacaatccgtcagtgaaggacaatttgtcagtggacaattcctcatttgttttatcaatgatcaaaatttgcgaaaatcattgttaaatttataatgagaatttacattaaaacatttatagttacttaataact

SEQ ID NO: 28900 - DNA, 814 bp, Heterodera glycines
  misc_feature (741)..(741): n is a, c, g, or t
ataattgaagaaaatttgtttgaaaattttcattaattctttttattaaataaaaaaccaaataattttgtattattttcacttgatataaattaaaatttgattttttttttaaatttttaaaatttttttgaatttttaaaatttcccggtgggtcccggttcccggtttttcttgggtcccggtcccggtcccgaaaaaaaatcgaggtcccggtcccggcttctcaggtcccggcaagtcccggtcccggttttggcaaaaattcccggtcccgtggcactctagtcaaatgccaaaatcttacgaatcgtcatatctcggtcttaaaccactttcaggttaaaaaattaaattttaaatttcttcactctcccccacccctaaaaaaatcattacaacagattctaaggttagatttcatattccctgaaaatccaagactagttcatcataaatattttatatttatcatttttcttttgtaatggtttgcatatgttcctatattcgtaatactaatgcttataaaaaacatttattaatatttttaataaagcggtgatgtaaaaaaatctcataactaatcaggtaccggtactgaccgttactgctaaaaccggtaaaatccattgacgtttttatatagacaaaatctgaaatatagaaaccataggaaatccatctcgatttcatggtgtactccattttcggggtggtaaaaaaataatgttatcttnaaatgttagctatgtgctaataaaccgaaattttaaaaaaattcttaaacttaaaatgaattttatatctctg

SEQ ID NO: 28901 - DNA, 855 bp, Heterodera glycines
  misc_feature (809)..(809): n is a, c, g, or t
ttttttgaaacataacgaaatttttttgaaattttgtaaactgatagagaacacttaggactaccgaatgataacaagaattaaaaatttgactcattttgagcgaagttataaatatttttcatcaaatcatattgatggttttttaaataacgactccgcccccgaaaataggataaaaagtcaatcgggagtttgaagtttagaaattttttttgttcgaattcgtttcctgggcttggcattagtcgaatactgatcggcattcccgaaactttgatcaaccattcttgcctgtaacacgcatgtgagcagaaccaacgccgcctttgtgccgatgagacggtcgaacagtcggcccacggcaatggacaaaaagatggagatggcaaatggcaatgccaccacaacgccagtctgatgcatgtcgatgccaattgactgcaaaaaattaattagaaataattaggtggacaattaaaattggaataattaggtcggcaattaaaattggattgtttccgttttttgcctctcctgctgttggcgggcagttcgccccgattcaaagatagggtcaggccagccaaggttggactcgggatgcttaatctcgatatttcaaaaaatatcaagagctgcggtctgtttacccataccaggtggccaaatccggggattttcaaattacccagacacttttccgaattcttcaatgttgattcgggatttttcaaggacaaacaaaaaattttataagtagaaatttaaaaaaatacataaaagtattattattaatttaattttanatttaattttattatgaaaggctaagcaattacattgtgcaaatat

SEQ ID NO: 28902 - DNA, 554 bp, Heterodera glycines
tcttaggtttatgggcgcactctgtttatgtctcgatttatcatttattggaattgcttttcacttcatttcttcgctttttttaatttatataaattaatttaattgttaattttcaatatcaactattatttcttttttttcgaattagtttcaacgaatgcggcagctaatggcttacggtcgattggatattattatattttaaatttttaataattaaaattttatttatttgttattttaaaatttatttatataaatattaagaataaaaatattctttcctacttatttttaatttgttgatttttcatttctttaatattctcttttgcttcaacgcttatcagtctgttttagggaagccaagaatatcggtattggcctattgatatacgatatatagagaccgtatttttaggcacaaaaatttttaaatggcacctaaaatatgcatgaaatgtgaaaaaagcataaagagagcaaaaaaatggcaaaaaagtcacaaaaacatgaaaaagggtagtaaaagttctcacagtgatgtattc

SEQ ID NO: 28903 - DNA, 1030 bp, Heterodera glycines
gggggtttgacaaatttttttggggaaaaaaaaagacttttcaaaaataatacccctgggagaaagggagtgggaaacaagatttcaaaaattttcaattttttttagtttatttttctcaaaccggtttcagaattcaataaaaataacattcccggtgcgaaaaatggggttgaaaaagtttttgtggaaaaaaaagactttacaaaataatacccctgggagaagggagtgggaaacatgatttcaaaattttcaattttttttagtctaatctactcaaaccggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttatagtctaatctactcaaaacggttcagaattcaataaaaataacattcacggtgcgaacaatggggtttgacaagtttattggggaaagaaagtctttacaaaataatacccctgggagaaggga

SEQ ID NO: 28904 - DNA, 1420 bp, Heterodera glycines
taaaattctttataaaaaattttctaagatttttttcttgaaaatttctaagtgaaaaattttcatcttaaatttccgcggcctattttgtgtcggcgatctttcgggcggcgatattttggggtgtacccaacagtactgcctatttttagcataacaaatcatatgatttcatagatcgaaggtgcgcaccccatccggatgccgaactcgcacatctcttcctccacggtcgctcgcttcttggtccacaacgactcatgcggagcaacagttccgtcgtcgtttccgtccttcgggtcgtcctgtgccttcatcgccatgagcaaacgcgtcgactccgactgcggctgtttggcacacaaactgttcagtttgttgacatataacagcgggagaaaagtgctcagccatccgtgcagcgcttcacagtgttcattcttagtcccagcactgctcgccaatgcctgtgcatcatctccagcgttgcggtcattgtcagtcgccgcttgcttcagtcgcttcttctccaacggtgtgtcgtcgccaatgtggccaagaccaaacaactcggcctcgtgctgctcctgttttttgtaggggggattatacgagcagaacactcgttttggtcgatcagatttttgggtttcattttagtcgggggaaacattcccatccagggaaaacctgttccgtatatgacctatgacatggcccattcccgaattggctcacttccttggtgctgtcactggtgtactgctccaagtgcttttcgatgacggcgattatattctgttgctgtttgtgttgtttagcatcagtgctggccgactgatgaatcagtggtggtccgttgttcttgatgttcggcaagaatggcatttgatggtgaactttggccatgtgctcagccaacgcctttcaaaaaagattgacttttaaaatggatcccatgtaggttggggatcttgcttatcattgacaacccatatattacgcgaaccatccacacgaagcacgcgaaattatgatgtacaattgcgtcgtaatcgaaagtgttctaccacaccactttcggtgacctcttcctttttagttacctctgcatcattacgggtgcaagtcaacttagtatataaaccttttccaacgcagtaatcactgaataactcccaaatgctcatttcttcacaaccagctcaaataagttgaaaatcattaaaatatactacaaaaacttactacaaatgccttctccaacgaactattgttcattaccgccttggaggatactgcgaacctcagactgccgcggtgctgcaaatcgtatcctacatccttatattttattttgttgcgttttcttcaactctccacttacatccaatgatagactgaagtgaattcgggctgg

SEQ ID NO: 28905 - DNA, 817 bp, Heterodera glycines
cggaatttagtgaatttttattaaattgtttggacacatatccaaaatttttagtggtatgtttaacagaaaagcagaatttatcttttttggatattaaaaaaggcataccaataaaatgttccaactctcattatacatacaaagagtcataaaatgctataattacaatttatttggagttattattgtcaataaaaagcccagaaaactatcgcgtaatttaatgaatttttattaaattgtttggacacatatccaaatttttagtggtatgttaaacagaaaagcagaatttttcttttttggatattaaaaaaggcataccaataaaatgttcctactctcattatacatacaaagagtcataaaatgctataattacaatttatttggagttattattgtcaataaaaagcccagaaaactatcgcggaatttagtgaatttttattaaattgtttggacacatatccaaaatttttagtggtatgtttaacagaaaagcagaatttatcttttttggatattaaaaaaggcataccaataaaatgttccaactctcattatacatacaaagagtcataaaatgctataattacaatttatttggagttattattgtcaataaaaagcccagaaaactatcgcgtaatttagtgaatttttaataaattgtttggacacatatccaaaatttttagtggtatgttaaacagaaaagcagaatttttcttttttggatattaaaaaaggcataccaataaaatgttcctactctcattatacatacaaagagtcataaaatgctataatt

SEQ ID NO: 28906 - DNA, 2155 bp, Heterodera glycines
  misc_feature (2134)..(2134): n is a, c, g, or t
taagcgtcttacgcggcacggcatcggcgtcgccaatgacgcaacaattccttccgccatacttggcacatcatccgcaacaacacatgcagcacccacagccgttgctgcagcacaaccaccaccagaaccatcaacaacagcacagaacggtcatcccaacggcggtctccggggaacaacaacagctcatttaccagccgaacaacaacggaccaaccgccggtggcgacaaatactcacactttttatgaaatgcagctgaaatggcccgtttactcacccattcgcaaaaattttggttgacccccccccccccccttttccatgtatgctttgcattcatcatatttgttgtctactcaatttgtccattctttttttcttacatggctctgagatactcactcatcattgaacataagcgaatcgtagtcagcccctctttcggcgatattatagacttaattctttgtaccacatttaattcacccaattgtgccttttattcgcctccaataattcatttgtcactttttaaaaggcatttaggtgcttgctttcataattgaaaagcatcaataaatttgtgttccaatttccttaacaccaaatcacacacaattattttatcagatgagaaataaagaatgagggtacagcagagaactgagttcatttgtattgttggcagataaacaaaaagaattaacggaatgtttttccaaatgaggataatcaacgacgaataagaggagattttaagagacaaacggtaatccaaccaaaggcaaaaatgatcaatcatcatcgtaaccaaaagcccaaaattgacagcaaaaaacgaaccataggacaattactactaattattatttgtaagtgcgtgcgctgttttcttccctcgctctattcggatcgatcagtcagccttcgtttgctgctcctcttccgtctgatcgtgcccatttccgttttcaatcgtcgctggcacatcgcccacagtctctcctttcttcacttcttttccctcctctcccaaggattctcccatcgtctcgttgcccagcccattctctcccacatctctgccttccttttcgccgctctcttccactctctccatacccttcccactctcttcaaccactctcgctttcttcccactctcttcaaccactctcactttcttcccactctcttcctcctcccgctgatcattattcccttcgtcttcgttcaacttccgctttttcttcttcaccgtttcttcctcctccgagccgacaatgtccatcaaatggtttctgctcggtccgtcgttttgcgctgtcactaccaatttcgtggcgctcgctttgccaccgttttcaacaccgccgcctccaaacagtcgcttcagcatactcttcacgttgcgcatcgacggaatcagagactcccttttctgaaaaacgaaataaaaataaattacaataatcagtgaattaaagggcaattagcagacagaagaaagaagaccttcagttggtgcacattttgaagacattcgcgccacaatgggctcgacactcgtcctccaccaccgggcaactcgatagagaacaaaaaatattagcgatctcaatttgcattcgccaaattaatgggttcattacgttcccgctccccccaccgtaaaaattttaatttcttcaaatctagaatttttaaacgggggggggacaaattaatgtactttttacaaaccaagtttcattgtactataatataaagaaaaatgccaacggtatttaaattgcaaattttatacctttccaacttggtttggttacgaactttgtcaatcaacacacttactaatggctggtgttgttcgcgtgggtccagcggattgtcactggaaaacaccgatgcgcaaagatatcgtccacagaggggacagtgaaagttcggctgcggtttgttcatctccacgtcatttgtcgcttgtctaaaatcatttcctgtcgttgaattccatttttgggttttgtcaagcagttcaaactctttcaacttactttgatattggaagccatccaaaaatggccaaagccaagaaaaatcggctctgcacgcccaatttgtcggncaacgcttcgtcgagtacatt

SEQ ID NO: 28907 - DNA, 1157 bp, Heterodera glycines
ctcgatcagaaccccactctcgaataaagccccccttctgagaggggttgaacaataaagccaccgggggctctaatcgagtaaatacggtagttaaaaaataataatttttttttaaatttttgcaaaaaaggagaaaaccataatatttgcaaataatgaaaattcagtaggataaattattgcaaaagaggagaaatcataatgtttgccaataataaaaaatcagtaggataaattttttgcaaaaaaaaaatcaaaaaattaggcaatattattatgtaattttattttattttcagcaagataaatttttcattgtcataagggttggcataatcaacgtcaaaattaatgtcaaacaatgccagatggactgcataaatacggggtggcataagctgaagccatcctcatggcccgtatttcagcttttttccttttcatatagcatttttggagagatgaaagcaagaaaaataaaaaaatttctgacaaatatgaattagagcgagttattacatataaacatcctagaaatagtcaattttgtaggtttgacaataaaaaactatttagtttaagcatatatttccgcaatttaaaaaaataaaataattaatataaattttattttttaagacaaataacaaaaaaattgaactaatgcatttctctcttcctctggcgctgctcttcgcccttattttgacgttgtgtaacaatttctgtgacggaatgcgaaggaataacaataaatcattattgaataatttgtcaaaaaatggcaatacggtgccgcgaacgcaaatatccggaataatgaatcgtcaagctggtcaagagcttacgcttggtcaaccagcaggtacataaaagaagttcggtgaatccaaaaaatgggactcatcgttttaataccgcgaaaaaggaaattgaaaaactgcgctaattttttaagtaaaaactagagcccggtaaaaaagattttacgggagcgggagtccgaaatcgtacgggagggggaatctgtaaaactcccgctcctgtaaaaatcccgttcattttaaacggtagttccggacgggagagggagaaattcgaaaatttagttaaaaactcactttaatgcataaatttgaaagacaatcctttta

SEQ ID NO: 28908 - DNA, 1459 bp, Heterodera glycines
cctctgatcaatcgatcagaaactcattcccctcaaaagacggccgaggggggggggggggcgccgaagagatcggagagacgggcaaaaggcgtctcaaagcaaaacaaaggcaaaattcgccttcagttttacggagcgaaatatcagctcaggaggaggaggaagaggagaatatttcattgtcatctgctatctgtttcatcacttcttctcccttttaatttaaagcaaaaataaaaaaatgccattgtgcaatggcacaatggcattttactatgtataatggatttttcatatttttaattggtcatagccttggcatttttgataatgccgaagaggaaagttcgaccaataaataattttaggcaagaatctccccgtttattttgtcacgacaaaatgcagtcgatggatttgttgcgcgaactcagcgaatattcaggcggaacgcgaagaacaaagcgatgggaagaaaaagcgagagaaattgatcaaacggaggaaggaaaagcgaaaaacgcagcaaatgatcagcaaagtgatcagaacgaagggataccaatcgaagtgatcgtttacccgggaacagcttcacaagaagaagcggagaaaggatatgaaggagaacaaatggaagaggaggaggaagaagaggaggaggagccgaccccggagcaaatggcgcggtggcgtcgacggcgactgctgccgaacgaagtaagcgtgtcaatgaagtgccatctgagcagggctaatcagtgggtcggactcgacaaagtcgtcattctcacttaggtggtcagtgacatttgcgaatttatgagttttgccgagggaagccgactttacacgtcaagcggattatttgttgcgctgttggagccaaatcggaagttgtgcttggcaatggtaagagaagagaagcggaacaaagcggaaaaggaaaaacattttcagtttctgaaaagggtggaagaaactcggcagaaattggacaaaacaattgaggtgaagcgggccaaatggggggagggggacaaatggcacattggcattaaaaggaccttatgaaggggggggggacccaaagggcgaattggcatcagccgatcggcacattgccaaggatggcaccctcaggaaactttaaaggaagtgaatgaacgtcgtcgccatgtcgtacaactgacagaaaacattgggacaataaacgcgagattggctgaaatgggaaaccatgtgagaaagaaagaaagataaacaatttgggataaaatttgaatgttttgaaagttggccaatttggacacacaaattgtggtgaaccatttgaaattggacgaattacacaaacgaattgcggcgctgaaagaaccgatgggaaaattgagaagcgaaggaagggatgaaaagtgaaaaagagacgaacgaatggaagtgaacagtaatgcca

SEQ ID NO: 28909 - DNA, 1173 bp, Heterodera glycines
ttgcggctcgcgcggcggcgcctcgcgctcctcgtcgtcctgcgcatgcgccggcacgggcgccgcatgcgcctgttgttgttgctgcagaatcgccgattttgcgccggcactgtccaccgctggggaggacaatggcacgacgccgacggcaccaccaccgctgttggcttggatggtttggagcagagaagtggcatcggagaaggcactgaattggggggcaaacaattacaaattgtggggggttaaaaatttaaataataaataaatgagaaagttaatgagtcacatgccagtgtccaggccccgaaaaatgtaaaaattagaaccaataaaacgaaaaactaataattttttaaatttttcaaaaatttataaaaaatacaaaaaattttcccaattaaatcaaaaacaaaaagaagttttcatttagaaacacataaaattttcaatcaaaattaaacgaattaattttcgtttttagaaaagttttagaaaaaaaaactttttttccaatcaaaaccaaataatttttcatttttatgcacttacagcagttgaaataaacgacaccgattgcacccattcataatataaattaaattaacaatcaattttcgaaaattgattacataaaaaaccccccaaaaatacggggaatttttcgaaaaaatgctgaaaatttttcatttttttcttgaaattttcttagaaaaaatggtgcggctaaaatggtcaatttaaatattagaaatatattttttttgtttattcaatttttggaacaattctcccgccctttccatcctctccaattaatttggtatgtatcaaatttttgtttatacttttttgttaacgaacacttttatcggtaagcaaaaaaaaaaaaatttgcttttgctatttcaactgagtttactaaaaaaaaaaaaaaaattattttttaatttttcaagaaaaaaatcttataggggagtgaaacggcgtagccagggggaggccccgaggggtctaaagcctcccccactccgcccgaaacccaaaaatttttgaaaattgaaaccataatggcaaaaaaatattcattttggcgaaaaaacggctccaattcctgtaaaatacgccccataattcgggatttctaaacaatgaaaaaacgcccctaaa

SEQ ID NO: 28910 - DNA, 1179 bp, Heterodera glycines
  misc_feature (16)..(17): n is a, c, g, or t
  misc_feature (90)..(90): n is a, c, g, or t
ttctgtagaggatgannccaggggaaagaagaagggaaagtcaaggagactagccattagcccatttgcacacttgggcagtgtcacttntaaagaatatattaattattattttttatttttccctttgactccaattttcttcactaatttttcactcagaccccattcttaccagtgcttgtttttcccggttcccggttgccctaccgggaccgggaccgggacctgagcttttcaaaacccgggaccgggaaccgggaccgggacctcggatgaccgggaattcccggcccggtcccggtcccgtggcactctaatttaaaacattttattaccataatatcaattataattttataaattcgaaatattcatttctggtcaacaattttaatcttagttggctatgattgcccccgtggataaaaaaggcctggatgtttaattaataatttattaaaggactttgccaattgttgtttgtcttacattgacaaaaatgcggacactttgatcaaatctgaggcatttttgcaaattgaacaaagattgttgtgtgaaattttgtaacgtgacgagttacaaatccgcgaagagatttcaacttggaaagcagtaattagttcaaataatttatctaatcaatttatttgattgttccccattaaattttaattgtttttcggcactctgttgggccgatgcgaaatgccgtcaaaatggcattgagtgttcagcagagaatcgccgtcaaatgcttggcccggctcttttcacaattcgcttcccgctcttctcacaaaaggaaatttcagaaaaaattggtaaaaaaaacttagaatttctttgttgttccattaagtcatctcaatttttacagttccatccggcgtgctaacagcggacgaagtgattggagtggcacagtaccaacagtaccataatcatgcgaatgggattttcgaaatcataccgtatgcactaaaatttctgagccataggcgattttggtcatttggaacaattgcgatggatattgaaaaagtgtccgaatttgcacgagaaaaggtttagagcagtcggttcagtgaaaaagtgtacataaatggattgccatggacaatattggcgaaaataaaaacgaaagatgaaagcactgacaatgagaaatggttg

SEQ ID NO: 28911 - DNA, 1068 bp, Heterodera glycines
tatcatgctcgagagtatttgtaacgtataaatttctcaaaataagagatagtcatttttctgggatataagataaattaaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctctcacgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctatcacgctcgagagcatttgtaacgtataaaatttctcaaaataagagatagtcatttttcttggatataagataaatttaaaaattctctgtgaaattaaatggcgattgcgcaccgcactacctatcatgctcgagagcatttgtaacgtataaaatttctcaaaagaagagatagtcatttttcttggatataagataaattaaaaaattctctgagaaattaaatggcgattgcgcaccgccctccctctcacgctcgagagcttttgtaacgcataaaatttctcaaaaaaagagatagtcattttt

SEQ ID NO: 28912 - DNA, 1897 bp, Heterodera glycines
cccgggaaatttatgcaaatttttggaaattcaagacgcacttcagagttggacatgttagtggaataaagggtaaaactagatgataccactccctttttggaaaaagtttttttttcttttcaaaaatcatgaaaacatgtttccaaggggttttctggtccgcttatcacgaatctggcatccatttcaaccaattccaaccttggacccgaattcgaacaaaagtcgaaatttcagagttttcgaatttctcatttttagtctaaaattgtttaaacattttttaattgaagctttgatgacttttagattgtttccttattttaagccgatttagaaccaaaaatgagaaactcgaaaaatctaccatctaaagtattaccgaataaagcctaaataaataaatttgggagaattttatttccagaaattctgaaaatttgcgatttttcagaaaaaattcagaacgccgttttgaaaaggaattttcacaatgtaaatactagaaaatccgaaattttgattacaagaggtattttattttatttttttatcacttttttgaagaaagtttaaaaatgaaattcattgcgattcgggaacaaagggaggtgcacatattttcgaatggaaaatttttttcaccaaaatcttctaaaataggtctttaggggtattttaaggctatagaattgaagaatcattctgagggggggggggggagagttatttccggatccgggggaagtaaacgatttttctatattcttttttcatgtttattaaaacatttaaacggatttcaatttagaattaattaatttttattaaatagaaaaagaaattatttttcaaaaaaataaaaattctatttattaacaaaaattgataaagaaatgaattttttctgtcacattataatttgctcggttcgagaaagttaaaaaagtaaaaaatacagccttagaaggtttcttatgtttttttaaaaagatgctcaatcgagccaatgatcaattccttttgtggtaagtcgaaatgacagtgcgtgtaaatatttttccagatttgtgacaaaaaataattttttctttatgaaaaatgacaaaaatcaaaaaccctataatattttagacttgcaaagcttctattctgatcactttatttttcaccgatttttttatgaaatttttaataaaaatttaaaatttacgaattatggaaattatgcattttgggccccagtaattgcgggtttcagatttccgtaattcagaaaatcgccgtaattttaaaatccagttatccgatatgttcaagctacctgctaatgagtatagtgccgattcaaatttaatttctttgacaatttcatcggatttaaaatcggcatttaacaaattaacaaaactctttggtgcaggtacaaatgacagatcaacatccgtcaattttgtctcaaatttgatcaatttgacgcgacccgaaatgaatgtcacattggcactatgcaaattctaaagcggatttctcaaatataaaatgaaattaatttaaattaatttttttccacttatttaaataaccattttaaacgcgctcaacaaactgtccttattttctccataaaaattgtacacatttatatcatttggtacaaaacaaatcaaatccatgtcagaaccttctaactgggcccccaacaaatacgacccattgtccattaatgtataatctaaaaatattgtaataataaattataactaaaaaataaatatttatattctttcaaattattcaacgaaacaaaaaagcgtataatagtctgaaaaatagctaaatactttattttagattatttgaaatatatgcaaacaattttgcattgcttcat

SEQ ID NO: 28913 - DNA, 790 bp, Heterodera glycines
tgtcgagatgggtgtcagatacgtgatctgtaaccttccttaaccccccgaaaacacagggacccacaaaacgattttcccggtggcaggaaattgaaaaaattttattttcgtcggaattcgtgtttgttttttaaatacggtttttaaaattttgaaaatttaaaactcaatcttttctaaaaattattatacccccttttctttcagtgcttttcttcgagggcattgtcgaccttgcgttgacacgagcacagcgtgacgaccccaacgaattggcattggtggcatacaaagtaacggatggggaaaaaaaatattttttcaaaatttttttgcccttttcagaaacacattggttgcactgccgctgaattcgtcggtggttctgctggatcaactgctgctgttgctggtggtagcagcggtggcaccagcagtggaatttcgtcctcgtacatggcggcgccgggcgcaagcagttcaaccgcggtggcggacgcatggcgcaagcgccaggaggcgtacaactgtgtgctggagacgttgcgcttgctgcacacgctggccatctcatcacgtggtggcgccggtggtggcaccactgctgctggtggcgggcgtgctgctgaacttgcccaactccaactgggccaatgcgtgttcccgtccgcggacgcgtgccgaacgcaactgtcaccggcccaagcggagatggagcggaacaaggtgtggtggtggtgattatgtgctactatgttacttattaatagagacaaactaataatta

SEQ ID NO: 28914 - DNA, 1060 bp, Heterodera glycines
agctctgtccgttccatcctcatcggtttcacgtcctcttttactctctcttcaaagtgctttgcaactttcccctcaacggtactgttcgctatcggactcgtggccgtatttagtcttagatgaagtttaccacctgatttgggctgcgatcccaaacaacccgactccaagacacgtaaagatggataggcaccgccagttggacaggtcttgcaccttctctggagccccggtcaagggaaacttgaacaagcgggccaacccaagctcacggtctatacgctacacctcgcaacccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcccgagttacggtccgtaaaacgcgaattagaaccacaagttcgcgccagcacaccaaaaccccacagccgagctaagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaagaaaaagctggcggtgcccgagctgacactcattgagtcttaagccacgtgctaggccaagcacgggccctaccacgtcgtctcatcacggccacggacgtagcagcaagcacaaacacaccgctagttacggcacgtaagaccgggaacgaaacacattctccagtcagtggtgtatgtgccctgcacaaacacccgctcacgacgcacagac

SEQ ID NO: 28915 - DNA, 1462 bp, Heterodera glycines
  misc_feature (78)..(78): n is a, c, g, or t
ttcagaatacgcgcagatggagtgaaaactcccatatttttcgcgttacattataaaaagcgtctgtctctctgcttntaggatgaatcgcaccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagtgatttcaggatacgcgcagatggagtgaaaaactccatattcttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagcgatttcagaatacgcgcagatggagtgaaaaactccatattcttcgcgttacattataaaaagcgtctgtctctctgcttttaaggttgaatcgggccatttatgcatggggttatataaaacgaggaacgaaatgtgcaatgatatataaaattagtactgaaatatcgaattcaattaattattatacaaaattgctggtcattacgcttcataattctcgagcttccctctcatcgatttcctaaaaaagaagagaagtgatttcaggatacgcgcagatggagtgaaaaactccatattcttcgcgttacattataaaaagcgtctgtctctctgcttttaaggttgaatcggcccatttatgcatggggttatataaaacgaggaacgaaatgtgcaatgatatataaaattagtactgaaatatcgaattcaattaattattatacaaaattgctggtcattacgatcactttttgactggggtcactcttcgtcctcctctttttccgatcacttttagtctggcatttttcatccattttcttttcagcagcctccgtctaccaacagccctcagcaggcttttcctctacccttccgcgccgcaattacgcgaccattgccggcggctacggcaccggcggcgtcagtttcggctcacccattgaattggatttgccacccgcacacaatttggacgaccgcccgaattactttatgtaaaaatggatgtattcacccattttcccacataatttccttaatgttaacagtcagtttttatatttgttttaaatacgttgttcatttcattcgcccaaaagattttttctgatcattaaacaatttatattttatatgtacatttgatgaaaatgagtattgtttgtttcaatagaatatgtaaatgtgctttgttatgaattcattcaaaca

SEQ ID NO: 28916 - DNA, 1378 bp, Heterodera glycines
ttttttttgggggccgggaccgcaagaccccgggaaccgggcccaaccgggaaaattttaaaaattcaaaaaattttaaaaatttaaaaaaaagtcaaattttaattatatcaagtgaaataatacaaaattatttgttttttataataaattaaattaatgaaattttcaaacaaattttcttcaattatttcaaacaattaatcatttttggactaaatcatcgaatattaatagaaattcagatttgattttcacatcactttttttcggagcgcttatgggcaaatttgcatgatatgaatttcagctcttggtttgaccgtaagaggttggtgaagtcgcacataaaaatgagaaaatgtccgtgtaattgagaaatggacgattctacagtaaatcagtcagtatagtatgattaaatcagcaataatttttattcaatttgggtggaattattatatatttatgtcgtccgccaactttagcattatactggccgtgaaataaacaattctcgctcaactgtgaaattaatgacatttggtggattttttcttgcatgcgaatgttctcgctcctcaattaggaaattggaccgacggcaaaaagcaattagtaaattgattgtggtcttatcatttgggctgtcaattatggatagcagtgaaattacaaaacatgcacataaaatatggagcaaaaacccgaaatatggaaatcaaattcttaaaatatgggcttaactattccaaattaatacaaaatttaatcaaatccataaatttactaaaaaaaacacatttaattgacgaaatacggtatgaataaaaatcatttaaaattaacacaaaaataaaatttattattttttactgaaaatgccctaaaaagcgaaatttaccgttatattttcttaaagccgaactaagaaaaacaatcttgcagaacggaccgcccactttggcgcgggccattttggagcaaaacactatataattttatttttttataccggtttacctcagttgggcgcgcacggttggtcgtcagcatgtttttccactataactttctataacttttttctttgtcatccaaatcacataatctttgtatcattcaaaagcttaacatttttagtaactttttctaagatatctcttcgtgattagaccctaaccaagaaagttatacatgaaacttgcaaaaaagtcgaatttttgaaattttttcttaataaaattttttccaggcttgaaaatcttttcgctttttgaaggctaatagagcatgttaagagctttcgaatgataccaagattgttggatttggatgacaaataaaaaaatctatagtggaaaaacgtgctggcgcc

SEQ ID NO: 28917 - DNA, 1315 bp, Heterodera glycines
  misc_feature (24)..(24): n is a, c, g, or t
gcttgcggtgcagcacaaatgccncagcatctggcccgatgtgcgtgcttattgctcgcacatgccaaagccgtagcactcgtgtgccatgtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaagggaaggctctcttaagggagtcaaatgcctcgtcagtcaccatgaaattaggtagaataagttcttgactttgcttttttttccatttatttcaatcggctagtgctttagggttttgtgttttgactttgcttttttttccatttatttcaatcggctagtgctttaaggttttgtgttttgactttgcttttttttccatttatttcaatcggctagtgctttaaggttttgtctttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatatcaaatattacttttttaaatttgtataaagttcctattttgtctttgactttgcttttttttccatttattttcatcggctagtgctttaaggttttgtctttgactttgcttttttttcatttatttcaatc

SEQ ID NO: 28918 - DNA, 1481 bp, Heterodera glycines
tttatgtattagaaatataaattaaaatcccgtgtatattaaataaaatttttgaggatgttttgcatgaaatttgaaaaataagaacttgttaaacaagtttgtgaacgaattttaccaagctaagcgtccgaaaaatgggttgcatggcaaaacttacaatagcaactcgtacataagttagactaggcctaggcattaagccgaaactttaggctaggtctaggcttaaattttatttttacaattttatatattttgcgtttcgaattttttacattttgacatttatacgttatgccatttttgcttttggcgataatttaaagttaccatttttgaattttattaaaaaccgaagggggatccatttgtttttgtaaaatgttttcctatcctctaaacttgttgtttgaggttttaaggattgttacagatcacgaatttgacttctatttcgaccaaccaaaacctaaaaattaatttttattgaaaatttctagaaaacaaacaagtccgttaaattttaggaataaatttaatgtcggaccggaccaactctaattttcaaactttttacttttaaggctgttcctatcaattatggatctcaccaagcttgaaccctgtctcaaagaatattacttgaactgttacccgtacgatctcattttcaaatggctttcatattcgaatagtgagtgaatttggcatttacttttatggtttcgatgtaatgctttttgtacgtaatacccccaaaagtgtctgcatttattttcctctttcgtattgagtaaattttcagagaaccgtgactatttgtcgaagagggaatttgctttcatcaagggtcaatcccatctccgttttttttcctttgtcgaacccaaagaatttatggttcaattacgcaaaactcctccacaaaaaattgaccttggcgctgtgtacaatcgtccggtaaaaatgcgtacaaaatccggcaaaaaacgcttatttttatatcccaaatcagccgcgtgaccgcgagaaaattggtgatttttttcccgtggaacgggaactcgtctttgacatcgatttgaatgactacgacacaatacgacaatgttgcaagtacgtatttttttttcatggtttacctttgcacatacaacctaaaatgcaatagagccaaatttcttacaaatatttgttttttttcaggggcacaagtgtgtgcaaaaagtgttggcgttggatcacaattgcggttgatgtgatggagcatcttttacgaagtatgcacacattgcatgtttctaaaaaatcattttgttgaccaaaatgcccaagaatttggatgttgtaacagtgggttcaccctttaacgcctctggggaagtttttcaaaatttaacaaaaaaatttatttatttatttttgccattttatggtaaaacaatctctttagggtaatgtttaagtattgtgttgta

SEQ ID NO: 28919 - DNA, 1597 bp, Heterodera glycines
  misc_feature (1538)..(1538): n is a, c, g, or t
  misc_feature (1588)..(1588): n is a, c, g, or t
  misc_feature (1590)..(1590): n is a, c, g, or t
aatatgtacaaaaagtggtccaaatttgtaccttaattatgtaagaaaaatccccaaaatatgtccaaaaaaccccaaaatatgtaaataaaaattttttttaatggtattttttgggaaagaaattccccgtaaaataagaaatagccacaaaatgacataaaaaattactttttttggtatttttaggcaacattttcaaacttatttttttctttataaattttcaaaatatgtaaaaaaaatgaaaatatgtacaaaaatatttgtcgaaattttggattttttttgaggatttccaaaaatttccataaaaaatactagagtgccacgggaccgggaatttttgccaaaaccgggaccgggacttgccgggacctgagaagccggtaccgggacctcgattttttttcgggaccgggaccgggaccgcaagaaaaaccgggaaccgggaccaaccgggaaattttaaaaattcaaaaaaattttaaaaatttaaaaaaacattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgcttttcacatcacttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaagctcaattggtaggattttcatttaaaaaatgataaaaatgtgtcaattaaaataaaactatgagtaatcatattttctttataggaaacccacgagtatacaaaacaaaaaattgaaaataatctaatttctgtagagggattgaaccaggggaaaagaagaagggaacgtcaaggagactagccattaggccatttgcacacttgggcagtgttactttttaagaatatattaattattattttttatttttccctttgactccaattttcttcactaatttttcactcagaccccccattcttaccaatgcttgtttttcccggttcccggttgccctaccgggaccgggaccgggacctgagcttttcaaaacccgggaccgggacctcggatgaccgggaattcccggcccggtcccgtggcactctaattcatttccttctttaaatttgattgtgtttggcccttttaaaaggttaggagtgccctattttgttcattttttccgcattttaaactggttcaaaaataggtttaaatgcttttccgcgccgagttttaagctgttccgtcgttttcggagcctaagaaaacctataaaacttttatctaatttagtaccatactcgacaatttttcccttagattttcaaaaaatttctcacacggtcactgttggcaatgccggaccaaaaatttatgcttncaaattcttaagcaaattccattttccagaagccattaaatttatccttnanacataca

SEQ ID NO: 28920 - DNA, 1219 bp, Heterodera glycines
  misc_feature (41)..(41): n is a, c, g, or t
gaaaaagcgccggggggttaatgaaatgcaaaacgaaactnaataaggaataaagtaaattcacctttttgaccttctcctctgctcctttctcctcatttcctcctcctcggttgattacattggtgaccaatcgtcggaaaaattctgggtccaattgtgccaatgccgtcgtgtttgtccccctctccgttgccaattgtgccaatgccgtcgtgtttgtccccctctccgttgccaattgtgccaatgccgtcgtgtttgtccccctctccgttgccaattgtgccaatgccgtcgtgtttgtccccctctccgttgccaattgtgccaatgccgtcgtgtttgtccccctctccgttgccaattgtgccaatgccgtcgtgtttgtccccctctccgctgttttatgctgttcctcttcagtggtgttcgtcttgtcctcgtccctttttccgttgctctgttctgtttgccccccattttcgtctctttttgcgtttcgcatcgccgcgttgcgactgagtctttcgctgatggcactcagtcgattcgctcgttttgccttggcccgcatattttggaaccaaacctgtgaagtcgaaaaagcgattccaatggattaattaagcactcattatccgcccatgcctttcttcttcccgcgcccacctgcaccactcttttgttcactccgatctgttccgccatttccgacagttggtatttgctcggcaaggaattgcggcggaattgttccgccagaattttcacttgcgcatccgtaagaaaagcacgcggccgaagcgcggaaccgccgttggcggatggccgccactcggccaaaatgtcaaaagtttcgtcgtcgttctgtcgggcaaagtcgaagtgctcttccaacgtggtcaactcggtgtgctaaagatggcgtgagttttggtctaattggcatacgcatcctttcccgccattccctatatatatatgcctctaatcatgtctagcccactaattacttctatttgcaacatcccgctccccttcacaattacccttttctgtttgagtttcttatcactaattgcctataataatcccgcttgtttcacttatcctcactaattacactaattgtctctaattagcgacccttcctcctcccccgttgtcttaattaatccccccccccccgctttttctcactttcgcttcgtccttt

SEQ ID NO: 28921 - DNA, 1532 bp, Heterodera glycines
ttgtacctcttctaatcacttttgtacctctactaatcactgttgcacctcttctaatcactgttgtacctcttctgatcactgttgaacctcttctaatccttttgtaccacttctaatcactgttgtacctcttctgatcacttatgtacctctactaatcactgttgtacctcttctgatcactgttgtacctcttctgatcactgttgtacctcttctcatcactgttgcacctcttctaatcactgttgtacctcttctgatcactgttgaacctcttctaatcgcttttgtacctcttttaatcacagttgtacctcttctaatcacttttgtacctctactaatcactgttgcacctcttctaatcactgttgtacctcttctgatcactgttgtacctcttctaatcacttttgtacgtgttctaatcgctgttgtacctctaacgggcgcgaagcgcccgtctgagctcaacaaatttaaaaaacgggcgcgaagcgcccgtcagagcaaaacaacatttgaaacgggcgcgaagcgcccgtactatgccgcgaagcgggcgaaaaggcccaacaaaatttaaaaacgggcgcaaagcgcccgtcaaagcaaaacaaaatttaaaaacgggagcgaagcgcccgtctgagctcaacaaatttaaaaaacgggcgcgaagcgcccgtcagaggacgacaaaattttaaaaacgggcgcaaagcgccggtttgcggccacgaagcggcctaaaaatccctgaaaaaaccgtagttgtacctcttctgatcacaattgtaccttcccacccgtggttgtacctcttcccccgtaacagcctaggtagcgaagctccgaaagcgcgaagcgctttttcccagctaaatagccgacggttattactatatatgttatattgacaaggagtttcgtctgcaaaaacaaaatctcccggccgaaggccgggagcgccctgaaagtagtggaagggtcttacaactttttgaggcgcatccgggaaaaatataggttttccggtccaagggtcaactgagtaccagggactgatttctcattttttcgtgcgtttgacggcccataactttttttctaaatcccgaatcaaaaactttccgctggtaggaacctaagttgaagtgttgtctaaaagtcaaaaaaaattccaggcctctacctatagtaggaagggctgcagaaaataggagaaattcagtaccaactttgtccagttcagtccagggcgaataactcattggggtttgaactaagccagggggtgccagcgggactattgtagagttcaatgagctggatttttccagtttttaaaatttcgaaaattttcaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcgacct

SEQ ID NO: 28922 - DNA, 1200 bp, Heterodera glycines
  misc_feature (1082)..(1082): n is a, c, g, or t
aataatatcgtagtattgacggggaagattcgactttcagcccactctcgccgttgtctgggactttgaagatcaatccctgcaataatttcgcattttttcgactttggacgtggctcgccgtcatcataggcaatgttatccaaccaaaattcatcaatttcgtattcatcggaatgactcgccataaattctaaattattatgttaacaaggcaaatccgtagaaaaattaagagaggaaaagcaacaagaagaagtattctcgaagaaatcgctgtaaacgatcgaaatgattgtcaacggacggagagacggctgtaggcgatcggaaaataggagatgagtcaatgtttcaattgaaagacaacaaattgattgacaacataattttttgctttcatatttatttttatttccttcaattccttttatagctaatgagatatactaaataatggaattcattttttaatttttaaaaattacgttgatatttaagttgatggcgtaatgtttgttgatttaaataaatatcaacattgaggttgattctccgcaaaaaaaatatttctaagtgaaaaatgttgatttgccattctctagagtggatgcataaattcagtctctcaaaaacagtgatagataacgacgacgacgacgacattaattaacaaagtttttttcactttataatttatacaaagatattttacatttatattttaaaatattatgtattttattaaaaataaattgtaaaaaaagaagatcttttaaatatatgggattttaaaagaatattagagaaagtgaaataaattaaaatccaccaaaaaaaattttaaaaattttaaacattaattacactcaaaaatcatcaattcgaggaaatactgttcagtgaaaattattttgaaaaaataatattatttaacaagcatcaaaatgggaaaaataataatgaagtaattctttaatacaaattaattaagaagaaaattttgcaaataatgaagaaataccttaaacgtttgcatcaacggctcgtcttggaaaacgtcaggaattattttatttctnaattatataaattaaattatttattttcaaataatcagctttttaaagtagaaaaaatattcctttattacaaaataccagctaaaatattaattatgatatattatgcataaatctt

SEQ ID NO: 28923 - DNA, 1132 bp, Heterodera glycines
gtcgggatccccaaaagtcaggtacccaaatgtcgggtccccaaatgtcgggtccccaaatgtcgggatccccaaaagtcaggtccccaaatgtcgggtccccaaatgtcgggatccccaaaagtcaggtacccaaatgtcgggtccccaaatgtcgggtccccaaatgtcgggatccccaaaagtcaggtacccaaatgtcgggtccccaaatgtcgggtccccaaatgtcgggatccccaaaagtcaggtacccaaatgtcgggtccccaaatgtcgggtccccaaatgtcgggtccccaaatgtcgggatccccaaaagtcaggtccccaaatgtcgggtccccaaatgtcgggatccccaaatgtcaggtccccaaatgtcgggtccccaaatgtcgggtccccaaatgtcgggatccccaaatgtcaggtacccaaatgtcgggtccccaaatgtcgggtccccaaatgtcgggatccccaaaagtcaggtccccaaatgtcgggtccccaaatgtcgggtccccaaatgtcgggatccccaaatgtcgggtccccaaatgtcgggtccccaaatgtcgggaccccaagtgtcggaatccccaaaagttgcaccacgatccaatgataccaataattttaatttgtgttggtttgagaacagttatggccagctttttgatgaatatctatttggatagctactaatatgaattccgttttgttgagaaaagccgaaaaggataagaatttgccctctgtgtcgtctgcaaggatgatatcaatctgctgtacatcgataaaagtgcaatttctttgcaccaaaaaactggaaaacatcagatagcgataaaagcaataaacagatcaattccattgcaggaatttatgccaaacacttccgccccatcaactgaagaccgtaaagttctggcggccgaaggttaacaggcttttttctgatcaaaattttataattaataggcactatcgcttatcacactgcacaacattgccaatcttttcgctcggtggattgtttgtcctcggaaggattgttgcgcacaatttttcccgattcaaatattgcgaaaaaaataatgttccggacaaacaaaaacgggaaaaa

SEQ ID NO: 28924 - DNA, 968 bp, Heterodera glycines
  misc_feature (951)..(952): n is a, c, g, or t
taattgcctaataatcattttgctaattgtcttcccctttttttcatcagaaaatgaatgaatgaatgactgtaacttcttcgtttacgatgacccaattgttttgctccttcggcaagggaatcaatcgccgaaggaattgggttattatgacattgacaaatcgcctaaattatcaaataatgccattttccaaatgattctcctctgatttttgttcactcagtgatcggatattccttaaaaatgcgtttctcaacaccatttccccccctcccccttttttcccaatttcaaaattttccttttctgtccattggccaaccacacaaattgcctagtcatttgtttttcatttattagtcaaaatgccattctcgcaccttcgactttgcaatgattgcgtgtcgaattgtgccccgttgaattggctctgttgcgtttgttgttgtcgtgcgacaacaatcggtgactccgtcatttgatttcgttgcttttgctccgtccgattggcgttgtgtgtgcccatcgtttgcttctccgcttttctgttgcattttcggtgcttaaaaacgcaaaaataaaaaaaaataataaaataatcggttaaaaattaatttaaattttgcagcactaattgaaaatgattatgcgaatttaaaaatggaaaaggaaagaaacggaggaagaagagaccgatccgacaacaagtgctttttccgtgggtaccgttgagagaacggcggacgattcgcgtgaaacgccgtttccgccgctgtgtcctcttccgacgtccgtttttgggattacgccgttgccccccaccatttgctcgtccatttgactttgacccgtcccctcggggctgcttccgccctcctccgccattaaattggtgccattttgaagtcgcggtgaatgtacaacagaagcagtggtggaggaaggcgnnggactgatcattcaat

SEQ ID NO: 28925 - DNA, 1094 bp, Heterodera glycines
ccccggggggtcagtcatcccaacgggggcaccttggctgtctattctccttccaacaccttctttctctttctctcgctctctctctcgctctctctctctctctatttttgtttttttctcttccggcggcctctccattttctttactctctaaccttagcctctttctctccatttctctcccttttaacacactctctctctcccctccatttcccggcttttcctttcagtcccgagaggcttaaaagctttatcgaccgttgcgctctgctgctgtcattggaaatgcgaccccattgttcactctgttcacccaactatttctctgctccttttctctcttcctcattcttttcttgctctccttctcttccccatgcactctctcgcacattaagcggattgctctttttctcttccctctctctctctttttgttgttgcgctgaaagtttcacagcacgaccatcaccaacaatgaatgaattgaacgtgaatgcgaatgaatgaatgggccggaaacaattggttgttccgttccgtccgcttaactttcgctttttgttttccgcgagacttaccaaaataatccccgagcaaaagagagaaaataacgggacaaaactgaggaatggccctggccatgtccgtgactctcctcactttgccagctcaggctcactcattttcttcttgatttgacctaaccgtaataatttcaccgccaaaagcccccgatttttctatgcttttacaatcattagccaaagccatgattcccccgcaccatttgcgccgcctgtgccatcatcccccccccccctgccggctgtgccaacaaatgttcgttgatgccggcgtttgttcctcccattcattgctcattgcccccattcattgggtcaattaaagtcttaagtatcgcttccctaataagtactgccccgtccgtccatggccaccttctcgcccagccaatgaatgaccacaaataatgtcaaccaaaaagcccccgggggaaatgtgtcgagagcggggcaaagagtgccactgtgtccccgtgccaccaattttgccccagtgtgaaa

SEQ ID NO: 28926 - DNA, 909 bp, Heterodera glycines
gtgtgaacaatttaaacaaatgactgatgtcgacaatgggtgggttggcttcactctaaagggattcaggtgacatatgaaatcaataagaaattcattcattaaaattgtaaatttttcccaaggtcgagtcccatcttcgcttattcactgccgaggccgtccgctacatgaccgatgctgagttccaccgatttcggctcaaatacatcagtaattagagcatttttaattggaaatatgctttttaaataaggaaattggaattttttaattggagaacctgaaaaaaaaaattgtttaaaattgtgatttaacaaaaaaagcttagcaggggcattttgcttaaaacaaagtccatttgcaataaaaatgatattgctttcatctccccaatccgttggcgagaggacgcgcgcgagttggccaaccgttgagcagccgatcagcgaatggttggttcagtgctgggacagtgcggccgcctacggcgagcagtgccgtcgcgtgtccaaggcgcgcctcttcaatgtgtgtgtttgtaccgtccgtcgtcggcattttaaaccggaataaaatttatagttctagataaatgcttggtatgaaaagcatcctgctgtagtgctagttaattggtcaaaaagatgtcagatttgtgctcagggactcccaaaacttcgggaaagagtttttacaaattattatcataaaaaattgcaaaccaaaagggtttaataaaattcacaaactgtcactagtaatagcgctgaatttccgaaaaagtgccaacaaatttccagcatatttgcatgcattgccgcgactgtccggatgccatcgttgaaatgttccgtttggtggcccggtgtaaagacggtaggaatttgcaaatttgtttgtgctttt

SEQ ID NO: 28927 - DNA, 695 bp, Heterodera glycines
tgccgacgattcagtgccgacgattcagtgacgacgcttttttgtgaagacgattcagtgccgacgattcagtgccgatttttcggtgaacgttgataagccgacaattcagtgccagaaaatttggtaaaaaattttcagaaaaactagagtgccacgggaccggcaatttttgccaaaaccgggaccgggacttgccgggagctgagaagccgggacctgggacctgcgattttttttcgggaccgggaccgggaccgcaagaaaaaccgggaagcgggacgaaccgacaaattttaaaaattctgaaaaaattagaaatttataaaaaaattcaaatttaatttatatcaagtgaaaataatacaaaattatttggttttttataataaattaaattaatgaaaattttcaaacaaattttcttcaattatttcaaacaattaatcatttttggactaaatcatcgaatattaatagaaattttttaaagaatatattaattattattttttatttttccctttgactccaattttcttcactaatttttcactcagaccccattcttaccagtgcttgtttttcccggatcccggttgccctaccgggaccggagacctgagcttttcaaaatccggtctcggtaccgtgggactctactctaaatagtaggaaaaacactttcttttttg

SEQ ID NO: 28928 - DNA, 482 bp, Heterodera glycines
gggcgcaggaaaattattaaggaggagggttcattatttatttatttttgcaaaattaattcataatttttttttcagaaactgctctgaaacgcaccaaaatttatttacaagttgaataaggcactctgactcttatattatcaaaaagggagatgaataaatattttacaaatttttaattcctttttaaacatgccaaaaagtttaggcttaacttttttttcagaaactgatcagaagcgcaccaaactttgcagggatactgaaaggaaaagaattaacatgttttatcacattagcttgtcatcagttgttataaaaatttcaaaatcctgagtcttctatttttatttttgcaaaattaattcatattaattttttcagaacgtgctctgaaacgcacaaatattttatttacgtgttaaaggattttgaagggcgggggtggggacggggccgaaggcccccgcggggggggg

SEQ ID NO: 28929 - DNA, 970 bp, Heterodera glycines
gtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggctcggggggactgccccgaaaacaaaaaaatcgattttttcaagtgtccgtttggggtactcaaacaattaaggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaattagggcgcatcggttcggggggactgccccgaaaacaaaaa

SEQ ID NO: 28930 - DNA, 1034 bp, Heterodera glycines
gaaagtgtgagagtctcgccatccgatgaagaacctcctttctccgttctcggcgagaatgataatgtgtaaacgaagaaataaactttcaaaaaggagaattaccctttgcacattgtcttctaattgtaagccgatcgcctggacatagctaaagcgattgttgttgttgacagacataggcaaatataataaaaatataaaaacagactaataaattagtaaaaaatgtattaaagcaataaaaatttttaaatgtgaaattgtttttcttttttttggtgttctctttttgatgagaaaaacaggaaaagccaaaatgttaaaattcttctttattcttttggattctcttgaatttttatcaaatcattctttttttcaattctgatttttcctttcccttttaatgtttttagcataaatggaccaagaaatgagtgcgggaattcaacaaagccgtccttctggaaagatcaatcatgaaatcttgatggaggagacgcgtcgaattccaattttaggcgaagtcgttggccaattacgaaatatttatggttcttcgttagccgagcagttcaaaaagtacagaaaaaatatgaataaattatgattaccaacctatttagcgaactcattatcgccagccaacttaatcgtggaccgatgaataatgggatcagcaacccgcacatggacatgcttcttggtgttgatgagaaaattagcgatcttttgcaccaattgtaatcacacagctgatttactctcacaatgttgttgccgataaattgtatgaattcgaaccatttgaatttaacaattaatagcggatttctattgtctgtgtttcattatttattttatgagattattatttaacttaatttcaaatgcttttagaaatatggttttggacccgaaatcgaaagacaaggcgcgggaactcggttcctaccgcgatatgcggttcgaggtatgtgtgcgacgtttctatttttgtaaaaaggttgctctaactattacttttttct

SEQ ID NO: 28931 - DNA, 920 bp, Heterodera glycines
aatggcatttgatgagtctaatcaacaatcgaacccgtattttttggactgtaagctttttcatgtctgaacaaattgtacatttttggtatccgaaatcattaaatctgaggcagcaaataaatacgagaaaacataagaattctgccgtttaaagaaattcattcactcaattacttaattcatcatagcttttttgtctcaattgcttaaactctgatatttttatctagaatcgaaatttgatatttacaattttttaaagattttatataaactgatagagagagagagagagagcgagagagagagagcgagagagagagagagagcgagagagagagagagagagagagagagagagagcttttattaaatcagatttatttacaaattttacttaaaaaaaaaattcttaaacttcaaatcattatctacaaaaatttacggaaaacaattattctaatccgtgtacaagtcatttgcacctgagacaattaactatgcccaaattttcaattattcaggcacttgctttaattttcctaatttgcttgtgctatattcattttgtggtcaactttttctatgattaattttgttttaattattttaaatagcaaataacaattaattaattttttcccatctaccttaatgaccagttcgaacttgagctgatccacttcgtcagcgagcagtgccatctcattgtcgcgcttgcgcttccgttcaaaaagtgcactgaccagcttttggcttttcaattcggcacattctctttgcaatcgttgacgtcccgttgccaaaaacttttcaaactgatcagtcgcacaaaatttggcggtgtccatgatcaaaagataatcgatcagataaattggcgaaaatcgagtcacaggcgacaattagccctaaat

SEQ ID NO: 28932 - DNA, 1709 bp, Heterodera glycines
  misc_feature (28)..(28): n is a, c, g, or t
  misc_feature (141)..(141): n is a, c, g, or t
tcactttgggaggcacgtcaaatgtggnaattggcaattctctcccaactgaatgaccaatttgcatttccatccccatttgctccaattttgctttgaattcgcataaatttcagtgcccatttgcgcgtcttgaaattntcgtccacgtaatagtcataacggaggctgatcgtcgcaattcccagtccaagttgtgacggcggaagcaaatcgtacaccgccagccaacaatcgccggagatgaagctgaagaaacgggaaaaaaaaattgatattgaaattgggattttgcttttacattgcttttgcagtgatctatccttagtttcttaggccaaaacttttttctcatttggtcaatgcccacatttttgggtatcaattgaaagcttggagtttagccaagtttttgtatagctaaattcagggctaaagccaacagacaaaaaacaatttgtgaatgaatatactttaaaaaagcagaatttcggattttctcttttcaatcttttgttcaatgtcagcatttgttattttcgtgtatttcttaatcacaaagaattgtattaagctttcatttcaaccatgatgaatgccaattatggaaaaaagctatggcccaagaaactgaggatgatcactgactgattggatgcataggcactgaaaagtgccaggattcatttacaaaaattcaagcgggaaaatgatattcaaaagttaaatttaaatgagagagcagcgggaccgggaatttagtcttaaccgggaccgggaccttttcgggttgaaaaaccgggaatttttggctgggaaaaccggggaaaaaccgggactagtcccggtcaaaatcgggacttcggtactcagttgtccgtgttttggtcccggttccgctgtactctaatttaaatggaatagttttcgtcttttttgtgggtgtgaaacaaaaatcagttttaattcgttaaaacattttaagattttctgaaaccgtaattggtattattatctcttttcttttttgcccatctgtgcatgtgtcttacgctttctttgagggaaagaaaataaggacgacgtgtaaaaagagtgaagaatttcagccaactgacagacgatcatgggaaggaaatagtgcacagctaattggaaaagaaacgagtgtgcctgggaagagagtgtcctctctttccacaatcctctccatctcttcaccactttccaccccatctctcagttgttctttaatttgcctgtcaattggactgcttgctgcgttccaaacttacctggctggggagttcctgcgatcacaaaggcggggctcctgtggcgaggctccaccattgcactttcggtcggggctgacccgcagggcggtcccgaactgggataggcccacagctaaatttttgagtgcgggggacggcgttcgcgcctcccctttaaaagatttgcaaaagtattttggcgccgaaatggctgtgaggttctgaactgtccacgtggaacagggtgattgatttcctctaccaataattcatcaagttccataaaacccaactttccctagaaatggaaaactttcacgaagattcaatctcttaaattttattttttaaataaatttttactaagttgattgggtatttgattgggttgtacaaaaaccaaaaaacaattttctataaatcgaaacaaag

SEQ ID NO: 28933 - DNA, 1058 bp, Heterodera glycines
tgcccacctttcgcctgctgctccttggtgaaaagatccttgtccaccaagtgaagtgtgccatagtcaggatggcttgctaaatgggggaaaattcgtcaacaattgattgtgatgatcattattgatatagttcttacatggtacgagaccggggcttggtttttgaggagtgccaactgaaatggaaattaaaagcattaattgcccaatttctccccttgtcatcctactaattgaactggacggccttctctgggagaaaaattccttgaatttgtcggcatttgtctgttctgaaatggggaaagagaaaagtgtgtgtgccattcagtcataatcgtttaaattgatcactttgtttgttgcccatttgccgcggccttttcttcgctgaaatgggagcaaaaagtcactatacacatgaaaatttcaaatcaaaggatcaacaccgacatggtggctgcggcggcacttttttccctttctccggtggctttgtctttgacggcggtggctttttaacgacgggcggcgccggacctgaaaaacaaaaaacaattattccaatttccaaattgtccattttggtctctcgcctttctttccagtgccgcgttgcggtttcaacggcgatgctcctccaaaaaattgagtatcgaaattctgaaatgtcccacagtccatgttggcttctgaaaaaaggagggaaattctcgacataccacacaaaatgtggcatcacctgaagaaaaaacgtctgacggaagcgcattcgcccattctgcttttgccgtcgtcgatttggatgcgattgactgccgcgttttcgacgacttttcgggttttttcggctgaaaaaaatagtggtgtaaatgtcagtttttgctcgttgtgaggaaggaaagtaaaaactggccttttccttcttgaacatcacagcattggctgaggacgacgaaaacgcgccgaggacaccaaaagaaatcgaaagggcagcaaaaaacgacggaggaggggggaagagaaaggcattatttggacacgaaaatatgctg

SEQ ID NO: 28934 - DNA, 695 bp, Heterodera glycines
ttctatcttccaaaataaaaaagttattccataatttctggaaaaattcgatttttcagaaaaaaattcagaactctgttctgaaaaagtattttataaaaataatatactcaaaaaaatccgcaattttttgctctattttataaattttaatttagcttattatcacttttttgaaaaaagttatagaaataaaagtgattttggcattcgggaccaaaggggtgtgaccatgatttctgagtggaaaatttttttcaccaaaaatcttccaaaaatatgattttaggggttatttcgccgctgatcacgaatatgtaatcagattttactttagacatggttaagacctcagaatccctgtgtgattggggattctgaggagtgggagcgcccgtcctgaggacgcgaagcggccgaatatcccacaaaaaattaaaaaacgggcgcgaagcgcctgtcctgaggccgcgaagcggccgaatgtcccccaaaaaaattaaaaaacgggcgcgaagcgcccgtcctgaggccgcgaagcggccgaacgtctcccaaaaaattaaaaaacgggcgcgaagcgcccgtcctgaggccgcgaagcggccggatccctcccacaaaattaaaagacgggcgcttagcgccagtcctgagggcgggaaacggacgaatggcccccaaaaaattaaaaa

SEQ ID NO: 28935 - DNA, 1093 bp, Heterodera glycines
actttttatagtaacagcaaaagtgtccaaaactgaaatggatagtgcagatgatatggaaatggtcaattccaaaggaaaagcattaccaatccctcaaaatccgttgccgaacaaagtcatcggattcggaagcatttttatccagtaaaaactgaatttggaaatgatttgtgaccatcacactttcggaaaaatatagtgaacgctccgcttagaaaagggttaaatgatttaacaatcgcttcgtcgcgaggagttaagcacgaaatttggtatcatttgaaagctcttgacgagattacctaagtataaaaagcaggaggtgaagtcaaaccgacgccacctgagaaagaggtttttgaaccgattgtttccgcaagtcgagacttatttttcgttcttaactcctcgagacaaagcgacgattggtatacatatcatttaacccttttctaagcgggaccattcactacagttcccatcacacttttttctgattttcagcttcatcgaccaaaatgtgatcacttttcttggccattttcaccgtttcttctctaaatgtacaacaaaattgactgttgccactgaagatgtcctaactttggagttcgttttgctcaacatttggtcagcgttcaaggacaccatttatctgttgattttgaacatcatcgcttttcgtcaattggtcccgtcaatgctcaccgattgtccatcccttcgctctttcaatttgtgtgacggcatttcccttgaatttccgcccgacgacagtgccaatgcgtcggatggccaagcggtggccaaatggctgttctcacctcgtcccgacaatttgatgaggagctcagatgctatatgaattcaaccatggaagagaacaatggtcggcaatcatggaacagatcaaagcggtgatttctccaattaatttgtcttttttcccacttttttttgttgtatttttaggctttttccaatgcttcttctcctgtttcttttggcatttctgtttgttttacgccatcctcttcgctttcttccgttgtgccatttaaactgaccaacgaattttctggggagaaat

SEQ ID NO: 28936 - DNA, 864 bp, Heterodera glycines
  misc_feature (16)..(16): n is a, c, g, or t
aaagtttagcaatatnttatcatttcggtgtcgtatggacattcgggataaagcatatctatctcggggctcgactcgcttaagtcttccttcagtgtgtatcgattcccggatgaagtccaagtttcgagtctcgactagagaaactttctaggatttctgggtctatctactctagtggtgaagcgtctctcgagtcattactcgagaaaagtcccgtgttttttgtgactgtcgcttttagaataaagtctcggtctggagtctctacccgagaaaagtaaaatttaacatcaattaaaccgaataaatttaaaaaaaaacaaaattttgaatattttggattatttattcatcgtaaattttataagaatagtaataccttcttcaaatgtggtatgtttccgttggagtagcttatatttgaccatttcatctccaaacaatcgtccttaatatttgtatattaaaaaaaaatattggcgccaattaataaaatttattttacaccggcacattgcacatccgaatttaatccatattcgggttccattgtgccaacttttaacacataaaattttgtgccatgtaaatgaaaaggatgcagcatattcatgctcgttgccacagtaatctaaatttttttttaaattatatttatataataatttagtaatttttatttaaatttaaaattaaaatacatttatttgcaaatgattaaacaattcatttttacaatttaattaattatcgagactgatttacttgcacaatgttgtcaagaatgaatttgaagtggtgaaaacagtggcacctattctcggaccgattgctgcaaaaataattttatttaaataaatt

SEQ ID NO: 28937 - DNA, 969 bp, Heterodera glycines
  misc_feature (866)..(866): n is a, c, g, or t
aaaaatttccgggagcgggatcgggagttcacaattttccgggacgggagtcccgaacgggaatcccggaaaaatcccgttcccgttaaaatcccgcagaaattttacgggagtcccgggcgggagcgggagtaaatcgaaaatttaattaaatactcactaaaatatttttaatgcacaaatttgaatgactatccttttattaaatacagaaagatttaattagcagaaactaataaaaacagattttagggtctcagaaaattttttcaaattgcttcaaataaattattttttataattattcgaacaaaaagtttattaactttatattttcgaatccctttattaattttaacaactttttgcggcgtatttttttaagaaaattaaggattttaagcagggttcgcagatctgaggatttaccctcattttgtggttttttgataggtcatgtgcttttaaaataatcgatagtcatacacatttagaccttaaaaactctaaactttttttaatttgataaaacttttaaatgtaaaaacttatattaagcataaaactacaaaactgaacatttcattattaacagaacaatcaaaatatggaataatctaaattaagaattactctcctcattaattatacataatttcaaaaaaaaagtctacgaatgggttaaagccccaaaaaatcatatgaacaattacattgcatgagaagaacgatatttattttctagttaaaatcaaatttgcaatttgttctattttaattatgataagcatttactcatatcaaattgaattagaattaaatcatttaaacatagatttaaatatcaattttcattcaaacactanactttggaaaatttgtcttttattttgaagaaattttgcttagattattgcatttatgccccaaaatagggcgtgcactaataaaatgccttcagcgcgccct

SEQ ID NO: 28938 - DNA, 1649 bp, Heterodera glycines
  misc_feature (23)..(23): n is a, c, g, or t
caaaatggccaaaatgtgctcanagcgtcgctcctccgcaaggccattgtaatcctcccttaaacacaaacaattaactgactcatcaaaggccaattttttgttcttcggcatcatttaattttgctgtgcttttaaaggaaggcggtttgacagtgctaaaatgcgccgcgggaaaaattgtcaatttttaagcgaactttgttaatcgactgcaattcttacaagcaatgactaaaagaaagaaaaactcacgcaagggaatgaaaagccgggcccgcaatttgagcaggaaaattgagcatccgttcatttatgagaaaaccgacttttgacgacactcggccaacgcccaaaacattttcgaattttttgaaaatttcgtcggtcgcgtgtttttttgaacgttggagaaccaatgcggcaacttgcgattgaaaattctgaaatttcacataatttgatttttttttcgaattgccttcccaaatttgcctgagttccgttcaatggcacaatggaaaggacgccgtaagtgatcgcttcgctttcgtcgtcctcactttcttcggtcggtctgaacacacagcccatgggcgactggccgaccaccgcttttgccatttccctttcgtcgacctccgcttgtagaaatatctaaaatttaaacaatgtcggaaatgagtcttttgcgtgtccacttgaattagaagcctttcaatgtcatccaagtcgtcctccgccgggggcaaagcctcgaattcgaagtccaacttggccatttcctcagattggtcatttccgtcctcaatttctggcatcacttctccatcgtcagattcttctccttcttcactcaattggtcactttcttcctcctctttattttcattttcaatttgtccattctcagctatatttctcagttccaacttcctttcctttgttatgcttttaattgaatcttttttatttttctcaagtggtctttttgtcgagttcatttttattggctaaaatgtgtaaatgaaggaaaaatgaaacatccaataaaataacttttataaaatttgggtcaggggttcttggaattggccgaattggactttcccggcggcgcctatcgacaccattggatcgacattaatcctgtagaattgagtcaaaaagtgtgacatttggtcattttttggtcaaaatcagttaattaattgataaaaattttcaaaaaaaaaaatttcagacggcgcctatctgcatagacggacccctttgttcctagtttttgaaaaaattgcacagaaaaaaagcatttttgaaaagaaaaaaatagtcaaatttattgaccattaacagatttgatttccgatctctttttaccgtctgacccattcgaaaaatcttagtcgcccttttaatgcatcccgccaggccctaaaatttcttgtcaggtatttttttttggaaatttctttgaaattttttcaaaatttctaagaatccgcaatcctgcgcgggatcctgcaaatttaaaatgccggatttgcaggatgtgcaggattaatccagccggatccggtcctgcaaaaatttttgaattccaatcctgcaacaggatccgcaaatttgaaatttccgggctctagtta

SEQ ID NO: 28939 - DNA, 1209 bp, Heterodera glycines
atttgaattttcgagtttttgttcgaatacggctctttgggtcgaatctggtcgaaatggatgtcagattcatgatcagcaaccccgaaaccttcctaggaatctaaaatgattttaaaaacaattttattttttatggtctgtaaagtgcattagtaccaatttcctctgcatttccgaaggctcattatgcctctaaatgatagaaataatccaaatttcaaagaagcatccaaaacttttatggtccatggttagaatgtttgaaaacccttgactaaggagaaaaaagttgcccttggacaagggattttcctcaaatgttttgtacccacgccaaattgatcaaacatagtttattcggaccggcacagccggcggagtttgtcttccacgggttgtggattgaattacgaggcggaccatgcgtaggaatgcattgagcaaggcgaaagacggatgaaccatcaaaaaaggggaaaatgggcaaaaacaaaagatttgagtgacgtgatgggactggacgagtcgatggccgttgtgtccgtcgtcgaaaccgtgcggcaaaaactgaataaaattcggaaaccaaaagtcgaccttaagacgatcatttcaaaatattagtgacgaattttgtgccccaataagacacacaatttgacaataagtgctaattgtcagtttttccattcgtttcttaggttcttgtcactgtcaaatacatatccaatccggtaatcgttttcgccgccagaattaaaaaatctcgaaaaatttttgaaattatgttaaaaaaaaaccactaaattgtagtacgattgctgaatttgtttggagggctccctatcatttcgtcactgatcgtttcgtcactgcgaaaattttttaattgcttggcacatgccaaaactgaaaatttttttaaatttaacaaataaaatctgttttacatatgtatataaaagaaatgcatgcagcacaaaaattgcaattttggcaaagtttaataaaaatctttaaaattctgacttcaaaaagcagtgccgcgaagacgatgtgcggagaagtgcttgctcgagagtctcaggaaattttctgtttcaagcagaactagtgcgggcaaggacgggcgaagctcagcttagcactcgaaaccgaaagcgaacaccaatttttttcgaagctcgaagtttcgcccacccctgg

SEQ ID NO: 28940 - DNA, 1033 bp, Heterodera glycines
gtcccaacaaaaaataaatttaacatttttaatttatttttccctgggatggaaaaatatgccgagggtgtttaagaaatgacaacaaacaagagtcaatcaaaatgctatgaatgttgtgttgtgcaataaaaaatgccgtgcgaggccgcaaagcggccgagccatagtcgattttatggttcccggtgatttcgcacagtgagtgattaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaagccggagaaataaaaattaccagcctatttgaaatgcagtgggcaagcacagcgagtcccttaaatgcacacccctttgacacgtaaaattattccaaaaaaaaaaatagtgaattttttctggaattaggcc

SEQ ID NO: 28941 - DNA, 1181 bp, Heterodera glycines
  misc_feature (32)..(32): n is a, c, g, or t
agtttctttcatcaaaaaatttctgtgaaatnttgttgaaatacccgtaacttcaattacttttttggattttgaagtttccagtggtgtatcaatcacaagaaaccatggcttaacaatgggcatttctttggcaagttcgagattttcaccttaaaaactcaatttcatgataaattaaaaaatggataattataagttaagttctgagtccaaaaaatgttaattatataaaattattgatataaaaatcaattcttaagaaaatgaatctaatgattccttactttctgcaaatcaccaaaattaatttccattttcacgattcctcaaattaggtaaaaaattacaaatatttaaagtcaggatttattataagaatactcacgacgctttaaaaaatgaatcgaaatcgttaccttcgcgatttttttaagcatgttagcacagaataatgaggacaaaaagggaactgggtaaaaaatggataaaaaaattaaagtgattaaattaaattgttattttagtgtttttcctttccaaattattcaaatcgacggaaaagggaagcatttgtgggttgaattattaaaccaaatcaaatttcgaacaaaagaaatatattggttagtatataatttgaattgttttaataaatgaattaaatttattctattaattctttatatcttcagaaaattttaattttattctcaaattctccgaactcacattgacatatgaacaaatttacaaagtgcttgaaataattatgggcaaaagcaaagaaaaaacgaattcgcctccaatttacgaatttataaagaaagaattaaaatattttttaactaaatcggattcatcttcatcatcattaaggcatgtaattgcaagcatataaaaacaaaatatgagtttaatttgatgcttttcagccactaatttacgaaataaatctttgtctattaatttttaaaaattccagtacaaaattggactgcgcataaatcaattttggacgagagttgtcaaaacgtttaccatttaattttgaggaatataatgaatatgtcgagaaaaatagagaacattgcggcacagatgagcatgttgaaaattactattcaatagaaaatacaccggcaattgggtacggtaattatacaataaatgatatattt

SEQ ID NO: 28942 - DNA, 730 bp, Heterodera glycines
actaccgtatatactctttttatatgccatggtatattatttttcaacctcttcagaaaggggtatataattggaggccggcagattaatggagactgggagattatttttcaactgatttatttagtggaaaatttttgaaatttttttgaacatgtcgccaaaaatgtcatcgcgtcaaaaaaaaaatatttctattgcatttctgttaaacaacttctgagaattgaccccaaaatggcaaaaatgtgtcattttcttgcttccaatatggataaaaattgaaatttttaatggtgaaagatggacgaaacgatcacgaagaagccttttttatttttgtgcacagattttgttcgtaaaatgagtcaagaaattagagccataaaaaattggtctcgagtctcgggaaattttcggtctcgatagtgaaaatttactatttcgacatttttaggaaattccttaacaaaaatgcaataaaatcaaaaaatacacccctaagaaacgacctaaacattttggtaatactttggtttgtcccccctatttttcaaaaaaaataaaaaaattttaaaatcgcttaaaacatctctcctggggtttttggggccactgatcacgaatccggcatccgtttcgaaccccggacccaaattcgaacaaaaatcgaaattttatttttcaccaaaattcacactgcagcgactcgtgatcacaaaagacgttc

SEQ ID NO: 28943 - DNA, 1070 bp, Heterodera glycines
attgacgtcaaagtttcacatttagacaaacaaattgcaaatgatggacaacaattatcaaaaaacttttttgctcttttaaattaatattctttaattgtgtaattagtcttcgaacttcacgtttaatggaaccgatggaaacattttatatttttgaattggaaatcaaataataattcgccaaattgcttaatctcagtgcaatttgctctgcgttttctgtccaatagataaatgatttatcagcatattctcatacaattcaatcagatcctccgatatgattttattgaaaaaggtcactcatcagtccgatgtttttccagagaattctttaacatttttgctgctgatttcttcatgcaatccttccaaaattttgcctcccttttttcgcaccaaatgctttcacccttttggcaccaatgaatgaatcaaagccgatcccgaggtttttgtgggagggcatacagctttgtgatattaatttaattgagcattggattttcgattgtctcttttttcgacgtcgccttgcccttctttttggcaattcacattaaaataattctttctgagtgaaatcccccttaaaaatatccccattaaatccaactttgcttttgctttgtgtgtgttttgttggctgctttccatagcccattacaaattggcatcactttaatgcccccccccctctaatttggcataatcatccgtccttttcccttcccttctcctcttccgtcatccaatctcttcttcccccttcattttgccctttattatttgctttgccctcctcaatgcccccattccatggccaagtcgtggcactgtcccttcccttcccctggggaacttccgctgatgtgccgtggggaaggaatgtcaatgaggcgccggaagaatggacctacagacggagggggaaggggagaacaaattttgagtccccggggaatattgggccatccgcaagattggaaactgttgaatgaatgaatgagtgggagagagagagagagagagagaaataacaaaggaggcaatttttggttatggaa

SEQ ID NO: 28944 - DNA, 915 bp, Heterodera glycines
tctgtcggtgacttgcacagtttagccgacaccaattattatagggatgggcaaatggtggcataaatgggctattgttggccaagaagccgcaaacgacggcgtcaagcatccaaacgacggcaacgtcagaaacggagaacccttcagacctttcaaaaattgcgtgaccgtaatctcaattttcaaccccccttttttctacttttgtcattaccatgggtttttggtgtagcagatacaaaaacaattcgaccaattccaaacccatgactcggattcgaccaaacttaaacaaaaattgaggtgggtagagaaattttaacatggtaattacaaaaaggaagaatatcactttctgatggaccaatgtttccattttcacttttctttccgatttatctttggtaacactttatcagtttcaaaaatgagatgaattggcatttttaattttttgatgaattgaaacgtgttgataaaatcaaagtgagctcgaaagaatgcgaatgcaaaacgatctaatgaatgttcattttaatcaatctgagtcttctgaatcgctccgttgaacaattttttttctttttttaactgaagatccatcggatggctaaaaagattcaaaattttttaatttctgttaatgaagctaattactagtctgttagagtttgggtttgcttcacaactattttttggcccaaattccaatttttatgatagtatgacataaaacaacaaagaaggcttaataatttaattacccagaaacaaagcaaaccgacgaaaatagaaagaaaaccggcagagagagagaattttattaacaaacgaaattcacaataaaggagagattaatgagggattggccatttgggacgcctttttcagttaagagagtatcttagataa

SEQ ID NO: 28945 - DNA, 1098 bp, Heterodera glycines
  misc_feature (38)..(38): n is a, c, g, or t
ttaaatgactgaattttaaaaatgaagtcgaatgattnatgaaatgaatacgaggatgaacaatcgaaaagattgtttcttttgcacttccagattttttccaaagaaaaatgatataaacccaaaaatttgaagaaatggagaaaaatgagggtgacagacaaaataatcgagaataaagcaacacttattttaaatcgtgataaaaatgcaagtgacgaatattaaaagaaagtcttttatgtttggtatgcttatttcttctccaaaaatgttaaaattggcaatgggaggctgaaattttttttcacctgttttgacccttttcaccagccttttttcgaatgttttcatagctgccataaatcgtttcctatttcctattcatattaaattgagcaatgttctgtcttcttttcccatttttattgttttttacaatttttagtttttattttctttataaaattacaatttttttttaaatttgtttttttttttctattttatgtcgtttaagtaatatggcactgccggatcttagaaactcgaaatttcttttttgaaatttgaacaaaaacccttacccttatgttagacattttatgtcaacctgtaagaaatatataaaatttttgattttctccattcgtgctttccattacaaattttttgcctggtggtaaataaaaattacaacaaaactcatttcagaaacaagcataaaaagtttttgagactttttttttagctaaatcgattaaaaacgcataacattaaaaaaatatttatatttcacatttttaaacaaagaattcatggttaaatcgaatatttgggtatttaattaattttttttaaatgaggcgaaaaaacatagtcaaaaattggcattttgtaaaaaaaaataatgcaaaaacaataaaaaggggaacaaaaggggcacaacaaaatttttaacactaaaaaaaggttcatctcgtgccttaattacacttcagtaagcaattctattaatgaaattgtcgtgatttcaaaataataaaaattacaaattttgattctaataccaaaaactatttataatcactaaacttt

SEQ ID NO: 28946 - DNA, 1484 bp, Heterodera glycines
tttcgaatttttgccgaattcgggttaggggttcggaattttgcaaaacaaaggtcattttcgtaattaacgacacaaattaccctagaaatgactttttatttgaaaatttcaggggggggggtctcaaaacagaaaagtaccaatttcccctattaaattcattttactttaattgtttcgctttttacctatttattcccgcacattcatatgcctttacaattgcgttgaccttcactttttgttttgcacctctaatttgggctgtttcagtgctcaaaattgagccgaacgaaaacaacagtttcagaaattggcgctttttttgtgccgaatttaaaaacgacgcgtttaaatgcgaaagaatggcgccgttggggccgaaaattttcttctccatctcattatccgataagcatttgcacgtgtagagttccgcccgactctccgaagaagaagcaacaaattccatggcaatgaaggcaattgcgttgctgaacagtcgcactttgtccatgtccaatggcacaccgttcggctgattagtggagggccacagcattttttcctcagattttgacgacatggattttgtttgttgttttgaggtgccgccacggtgattatttgcttgatttgtctccctgctgaacttggcaaagttcgtttccaccagtcgattttgattatgcgtcattgggtctgatggttgggacatggaaccatcagtgccattggcagcagacaattggccaatgatgaacgagttgaacaagtcatgcatgggatcacactgaaattggcattattttacgaccagggatgacacggaattccgacttccaaaaaatttttggggcctcggaatgccatccctgtgctatatgtatcattcccacaaaaaatgttggcccatttaagtgcatttgtgctgattttttgttatctccaaaaggggatatgccaagccaaaacttttaaattaccgtatattctctaattaaggccctgtctccattaatcccgctgtctccaattatgcccccctttctgaagaggttgaaaaataatcctcccgtctctatttatccccccgggggataaatggaattattcttttttaaattcttatttttactaaaaattaattttaattaattctaaattgaaattcatttaaatgcttaataaacatgaaaaaataatacagcaaaaatcacttactttactcaagtccgaacataggtaacccagcccggtgctatgtcgttattagagctcggtattttgaaaaaagcctggacctggacctggatttcctgtacaaaaatccaggaaaatacaggtccaggaaaaatccaggcctggatccaggtccaggccgagctctagtcgttataaaaaagccatcaaaaagggggcaatcataataaattggtgtaccgacgaaaaaatatgataaaaattcgctggatattttt

SEQ ID NO: 28947 - DNA, 1138 bp, Heterodera glycines
  misc_feature (1128)..(1128): n is a, c, g, or t
gcatgaccggatggataatgaatggcacacccacctgccgggacattggaatcggactttggcctttgccgctgaacaaaatgagcgcggaatagccggagggctccgcattttgagcaaaaaatgcctaaaataaaaataaattagtgcgtgtaatgatcgggttggatcaaaaatttcgctaattttcggtcatgcgcccatagattcaatttttcagaatgcattaatttgaaatgcagacacacactgaaaaattccaaaatttcaacattttttcgaaggaaaacaaaattttgtagtaaataatttggtaaaacaatagcaaaattaattggttgcgtggcgccgcaggggaaaatttggcacaaaaagcctcaaattttagtaacaattttgagcgaattttctaagggcttgtgattgacccgatggacaaatttagctaacaataaatctttggtttaaattttccaattgccccaatttgagacgctcgagcacataaaaaagcgtttactttttctgaaaatgtgcaattgcctcgtggtacgacagcaaaatcgaagaaacaatgtgcgaccgtggagttcaattcgggtttctgaaaaatggaggaaattctcgcaaaagttcatttttattaattttattttcataatttgtatttgcgaaacaaaacatttgatgtaagacaaaaaaaagcattggtaaaaatcctgactttttcgggttatttttccgcacccagcaaatttatcaattcaaaaattggtggcataccgttatatttccgcatgcttccgctggttcggcaggcaaagcgcaaccgatggcactcatgccgaagctgaaaaggcaataaatgcattaatacgcctccaggcacctgacaaatcaaattgttattattttttaaattttatcgcatcttagcaaatattattgcaaatttttgcctgaaagagatgacatcgccgccaaaattggcgcccgtcgcttcgcatcggaccacgggacgatggccgcccaattgagcacgttccaacttttgttggaattaaatttagaaaaaaattcggcgacgaccgaccaccaaatggtggcgcaacttacaatttccaccanatattgcgca

SEQ ID NO: 28948 - DNA, 1390 bp, Heterodera glycines
gtttgacggtgaatccatagatcataaaactggaaaattaataaaggaatataacaatttattaataatcagcgaaaggatttatatgtttttacatattttttgtaaatatgggctatcgcatgaaaacctcaaaatagcatttttacttgttttcttacatatcaatcagagcaagtttttggcacattaaaaaacatattttggactttttgctctaaaaacatattttggggttttggtagtttttagcacaaaatttggctgttttttggaaaattttgatttattttaacaaaagtagctttttttcactcaagttattggcaaatttccaaaaacgttcaaaaaaattttttgcgctttttgactttttaatcactttttcacttttaagtagagttgagcggtaatcggtaattgtaaaaaaccggtaacgggactgaccggtaccagaaaagccgggataggggaacgggaccaacttttttcaccggtaccgggttgaattttctgagtcccaaaatttctggaatttttttaataaatttcaacaattttcgttaacataataaaagttggaatattttttaattaatacaaaattttaatcacagttttttcttgaccagtttttttccaattttttggcacatattttggggtttttagcacatattttgagggttttttggcacatataaatccgttcctataataattgaaaagattgggtatttatacataaaatataattcttatttatctttttcacccgcaaattgcaaatcaaagacattttgatgcgttcggtggtgaaattggtctttttatgacaaatttgttctgtaaattgaaaagctctcatttgtcagttgaacaaatccttcgaaatccaatgacgaattaatgaataattcgactcgagaatggctgaaacaagtcgggaaagattaaaccatccatttgggcttctcgagattctacggaaaaaaatttctcggctattagtggctttcgtcacggttttagacgtcaattcttggagtttggtcgggtcacgagtctttgaaaactctacctcgagcatacttaacaataattgataacctgcgaaatactcacgaatcagtgaaaatgcttaattttttttaatattataaaaattcttttttaaatcgattaccatcttaatcagttcctataaattttttcttttctcaatcaaaaaacgattaatgatgtcctaataactcctaatttcccgacttgtttcaggcattctcgccttgctcttctctgctactctgtgttctcagcaaacacttcgtctgcactctctgatgaccgatctttctgcctctctgagacaactctgcatgcccaccaa

SEQ ID NO: 28949 - DNA, 1608 bp, Heterodera glycines
  misc_feature (107)..(107): n is a, c, g, or t
cataagtattttttcagaaagtgctctgaaacgcaccaaatgttaattaaaagttaaataaggctctctgatgctttttctatcaaaagggagatgaataaatattntaaaaatttttaattcctttttaaacaggccaaaaagtttaggcttatattttaaaaagtttcatcgaacctagcgacgttagataagatatgacactttcaaattcctccgtcattgcactttgtgaggagggagaagcaatggaatgaatcaatggagaggcataatgaatgaatggatgaattatgcataaatcttgtagagaagaccatttgggaaggttcaaaagaaagaggaaaagcgaacggataatttgcgtagtttaatttgaataaataatccaaaggaaaggcaaaataaaaaaggcaaaagcaaatattatattggcaattttcaaaaatgaaaaatcttttaaaagaaagacgaagcaaataaaaaggaaaaacaccaagcaaaagcaaaggagggggggggggggggagaagggggaagacatggccagcaggccatccatgacggccccaccgcgggggcaacgtaattctccctcctttctaccttcccaaatcatttatataaattgctgcctcagttttaaaggaatatttataatttaatttataatatttcatattttattaataaattgtccatttttattagaactaattgataaaatccaattttaaaattaataaatcgtgtttaaataaataaactttcctaattaaacataatcacttaacaacgagtcatatataaatatcaaattttaatcgattaaaatttaatgtatgagttaatgctaatcgtgaatgtccgtccaattcaattaacatagcctattaaatgttcgtttgctatggtttggttttaatacttttccatcaatcgactggtgtgttcatgagaaaaacagaggattttaaataaaaaaacaattattaaaaaataaagcagcaataatctatgcaaagacaatagtcaaaatatttttcaagcaaaataagcataataagaagctgagagaaagtactctcgaatttacaactaggtatattaacccgcaaataataaaaaaatgaactaaaaattattaataataaaaaagtagattttattttaataaatcgagcggtctgctggctcgatataacgaataaagtctgaaacatggagaatttcaaaaatttataaaacaaaaatctgaattaaatattttttaaatataaatattcgtttgctaaggtttggttttaacacttttatcaatcgactggtgtgttcatgagaaaaacagaggattttaaataaaaaaaacaattattaaaaaataaagcagcaataaatgtacgcaaagacaaaaacatgtaaaaattataaatttctaattataaatgaattttaaaatattttcaatttaggattaaaactcattaaattccttttaattaaaaacataatacaatataaaatgggaaaagtacccaatatgaatctgagaaaagaaagcaaaaagaataatatttattaaaagataagtaacaaaattattgtcgg

SEQ ID NO: 28950 - DNA, 1277 bp, Heterodera glycines
attttaaaaatatctttctcttaaaatgtaacgtaagaatacgacttccccagtgaaatttaacaaattcaccaaatggtgtgtgaatttcaattgtaatttctgaaattcgtttcgactgtaggcgatgaaagtactcggtgctatatataacttcactaatcgatcctgggtcattgacgacgttaactattcttaagagtggagccatctggttcccgataattgtgttttctattaaatttggtgcataaatgtatagctgccttacacctcccgtcaaatctggcatataattcgcctcttccgcgtgaaatagccttgtgttcttaaaaccaagcacataggcgaggtgttttgacaaatctatgtgggagacagcagcggaaagatagacaataaatttttgatcaatgctgtcatattgaaattgaacatcctcattggctagtctctctcttttttgtggtcctttctcagcttcagatacttgtctattttcaatatctttacgtttaatatgctcaccgagcgcctcattaagcctattcactatcccgctaaaacccttttccgatttatcattatatccctcgagagttgatgtatatttggtctttgcctgtctggcgattccctttgcgacgtcggctgatttctttgcttttttcaagtcattcttttccacatgctccaatgttgtgtttttggctttatctacttcttcttgaaaagacttaagttcatttcgagatgtttgaatttcggttcccatctcaaccattttgtcaaaccaaatttttatatcaggctcttctaaaatgtgaggatttgtttctcttagtgtgtttagttgggtttggatggaattcgagatattgttgatctgattaaaatgtctttctacgtctctcccggcgcgttctgcggccctctttgcgacatcaatttttgagtctttggtatcttcagccttggcttctctctttccacgttgttttttgattttgtaatgatggctgaatgcttcgttaattttatttcccaatcccccggcggttttaaaattcatgtccggtaaataaacttgagtcgggacactgctgtcgttttcccatactttaataaactcttgaccgtttataccgagtgcggtgaatgagtaggggtaaataattgatgagagagctactgaccagcttgtgcccaattccagagtctcggtgagtcataactgtgaattttgatgcactgctccctgctcacgttgtgttcga

SEQ ID NO: 28951 - DNA, 1316 bp, Heterodera glycines
aaaaattcccggggttttcaacccgaaaaaggttcctggccccgggtttgcccaaaatttcccggtcccgctcaactctaacctaaaagcattgataaaatgttttcaattttctaattatttattattattgcctttcccggccttccccaccgcgtgcataacattagcatccatccgctttaccaaattgtgcacagcgcttacgacgccgcactgattaggtgatttggcattgaatctttttttcgttttaccgaaatgattttaggatttcgcccgtctcaaaattcggggacagtgtttggccaatttgcttgccaacttttcccgcatctgtgaaccgtacggaatgcaaatttaaaaaaatgcatttgatttgtattttttgcatttatttttttatttaaaatgattttttgcctttttatcggcacagaaattaaaatttgctgaaaataaaccctaatcactgctcaaattagggatgtgtgtggtcaccgggtggggtcgactggcggagggcggcaaaagaccccaaaatctgcgcgaaattcacgtgccaataatgcgatcgacgacatgcaacggagttagtcattatgcgggtactgtaacacagcaattgaactaatttgattacccctaattgatacggtaataggccgattgcactacccatcgatgctttgtgccggtttcaatgccggaaaggccgacgcgtgccaaggggacagcggcggtccgctgcaatgccaaaatgcaaaaaatatttgggaacttcaggcattttttgagaaaaaaattaattaattattcaaaatattatttttgcaaaaatgttaatttaattttaatatatttctaaagaatcacatgggttttatattattcaattaaaatttttaaaaataattttcatcatttaattttagtgataattatctgaaaagtgttcattccttccttctctttggcagggcatcgtcagttggggcatcggttgcgcaaatccgaaattccccggcgtttacacaaagtgaaccatttacaaataagtagagtgccacgggaccgggaattttgggcaaacccgggaccttttcgggttgaaaacccgggaatttttggctgggaaaaccgggaaaaaaccgggactaggtccggtccaaaccgggaccttggtactcagtaaacaattcacgagcatatttttcacagaacgtttgtcatttccccgtggattcgggcggaaatgctccgtctgaaaacgctttatccgacgccggcggaggaagaaaaaggaggaaaatgaa

SEQ ID NO: 28952 - DNA, 1413 bp, Heterodera glycines
acaggccaaaaagtttaggcttaacttttttttctccccctgatcagaagcgcaccaaactttgcagggatactgacaggaagagaaataacctattttaaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgtttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatgttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttaaagttcgattgctctagtcaatttttaaaaattttcgctgaagatgattgtcgtgctctgaagggcggggggggg

SEQ ID NO: 28953 - DNA, 1114 bp, Heterodera glycines
  misc_feature (1076)..(1076): n is a, c, g, or t
attttccataaattgatcattggaatccgcggccccaaaattttccgttaatcgaaatctcggtgccaaaaatttccataaattgatcattggaatccgaagtccccaaaatttccgtaaatcgaaatccgatgccaaaaattttccataaattgatcattggaatccgaggccccgaaattgccgtaaatcgaaatccggtgccaaaaagtttccataaattgatcattggaatccgaggccccgaaatttccgtaaatcgaaatccggtgccaaaaagtttccataaattgttaattggaatccgaagtccccaaaatttccgtaaatcgaaatccgatgccaaaaattttccataaattgatcattggaatccgaggccccgaaatttccgtaaatcgaaatccggtgccaaaaagtttccataaattgttcattggaatccgaggccccaaaatttccgtaaatctaaatcctgttccaaaaattttccataaattgatcattggaatcccaggcccccaaatttccgtaaatcgaaatcccgttccaaaaattttccataaattgatcattggaatccgcggccccaaaatttccgttaatcgaaatctggtgccaaaaatttccataaattgatcattggaatccgaagtccccaaaatttccgtaaatcgaaatccgatgccaaaaattttccataaattgatcattggaatccgaggccccgaaattgccgtaaatcgaaatccggtgccaaaaagtttccataaattgatcattggaatccgaggccccgaaattgccgtaaatcgaaatccggtgccaaaaagtttccataaattgatcattggaatccgaggccccgaaatttccgtaaatcgaaatccggtgccaaaaagtttccataaattgatcattggaatccgaggcccccaaatttccgtatcctgtgccaaaaattttccataaattgatcattggaatccgaggccccgaaatttccgtaaatcgaaatccgatgccacaaattttccataaattgttaattgggatccgaagtccccaaaattccngtatatcgaaatcccgatgcaaaattttccataaattg

SEQ ID NO: 28954 - DNA, 1524 bp, Heterodera glycines
agaccggataagagggtcggtcgaacgggttcggttaaaaaaccgaaaaaaccgaagaaaaattttcggtataccgtttcggtttcggtttttttgaatttttttatcaactaatatatttttctagaatctcgcaggctattagagaacacttagacctattttgcggcgccaaaatcgtcccgcgccaaagtgaccccgacccaaaaaattttggtagaaaaaaaataaaaacacgccgatgcacggtgggggtcggtttagtctggccggtttagtctggccgttttagtctggccgttttagtctggccggtttagtcagagggtcggtttagtcagaggtgccattggccgctgtgccaaaactaaaaaagaggggggggggggaggtgcaaaaaaagacattttgagcatttagagggcatttaatttaaacagattttggtattttgtgcccaaattgggccaatggatgtgctgaattgctgtcccactttgttcttctgctgctgctcccaaagttcgttctccgcccgtcgccccctccgccgatttgtccatttccattttctgttctcttcccggccctattttttgtgtccgatgagtgcattcagcgccaatttttatgagccacataaacaaccgcaaatgacgagcgatggcggcccctcgggcgacattctctgtgggctctgagatcgacgacagttggaaattggaaaaagctgctggggagggaggggcaatgagaacggaaggaagggagaaaagtgagggatgttcgtgaaaatatgaagtgatcacggaggaaaataataagcgattgccaattgagaaacgacgaaatgcccggggaaggcgtcgaaaaatccgtatttgagggcattggacgacggatttggaggaagggcgagggaaaatcggagcgtggggcgggggggggggggtgctcatttcgcggggggattaagtcaattcgattcgatcattcgccgacaaaatcttttcgacacaataaaagtgcaactcaaaatttggagctttgcaattgtttctcccaaaatggttggattctttccattggaattccgtcgatgagtccgtttttcaatcgaatgaatgcgaatggccaattctgtgcactcaaaaatgctttttaaattaagtgctgaaattggtcagcaggtcgaatttattgtgacaaattggccataattaaagtcaattaattaattaacagacgcaattaaactaaaaaataattagttaacaagcgaaatatcaaaattcgagggacggaaagaaagggaaaatccacaaaattctgcgggtccttttagtcaaaatccaagcttaataaataaaaggaaggcgacgagacagaagcaaagcccattttgatgagcagtcactgcaaaactttggaggaggacgaagaatggatggccaatttgcacttcgtccgctcggacattgacccggcgacggtctgttcttcgattggaacaaaaatggaaaa

SEQ ID NO: 28955 - DNA, 789 bp, Heterodera glycines
tgaagagtcgtctgcttcggctaatgaagaagtatcaacatccgatgacccagcatcaaccactgaagagtcgtcagcatcggctaatgaagaagcatcaacatccgatgacccagcatcaaccactgaagagtcgtctgcttcggctaatgaggatgacccagcatcaaccactgaagagtcgtcagcatcggctaatgaagaagtgtcaatatccgatgacccagcatcaaccactgaagagtcgtctgcttcggctaatgaagaagcatcaacatccgatgaagagtcgtctgcttcggctaatgaagaagcatcaacatccgatgaagagtcgtctgcttcggctaatgaagaagtatcaacatccgatgacccagcatcaaccactgaagagtcgtcagcatcggctaatgaagaagcatcaacatccgatgacccagcatcaaccactgaagagtcgtctgcttcggctaatgaggatgacccagcatcaaccactgaagagtcgtcagcatcggctaatgaagaagtgtcaatatccgatgacccagcatcaaccactgaagagtcgtcagcatcggctaatgaagaagcatcaacatccgatgacccagcatcaaccactgaagagtcgtctgcttcggctaatgaggatgacccagcatcaaccactgaagagtcgtcagcatcggctaatgaagaagtgtcaatatccgatgacccagcatcaaccactgaagagtcgtcagcatcggctaatgaagaagtgtcaatatccgatgaccc

SEQ ID NO: 28956 - DNA, 1185 bp, Heterodera glycines
aaatattccaaaaaaagagatagtgatttttctggattagcccgcagaaataaaaattaccagctattgaaatgcagtgggcaagcacagcgagtcgcttaaatgcacaccctttgacacgtaaaatattccaaaaaaagagatagtgattttttctggattaggccggagaaataaaaattaccagctattttaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccccttgacacgtaaaatattccaaaaaagagatagtgattttttctggatttaggccgagaataaaaattacc

SEQ ID NO: 28957 - DNA, 1704 bp, Heterodera glycines
tcccgatccgtatcttgattttttttttgaaaaatgcccggatctgatcccgagaccaggatggaaatcccggaagcctgtcctaatcaaaatcccaaaaaaaacccgaaattgatgccatatggaatgatcatcataagctggggccgggattagagggatgggcaaaaaaaaagaaatgaacaaactacccgaaccaaaactcggaaaattccccacaatcccagagcgtaaaaatttcacactttcccgggggaaacaacaagaggggcccccataaaaaggcattataatgggaaaaatgcaaaaagaaaatgttttaattcaagtaaggtcttggtaagggaatttttgaaattaccatcatcctattttgcggctattttactattttcccacaaaagttggactatgccttccagaggtgaagcgcgacagcctctcggattattttgcgcgatccgtgaccgcggcaagttgagtgcgcgactgttctgtccgcgttccatccctgggggtcttcgcttttcggcctcatctttgtcacccaaagacagacgcaaccaaatgccacacccagggacatcaaccgaatgccattgcacttgcttggtgcacgttgggcaacgatccgccctggcgaccgtggaagctgtccaacaccgggtgggacccctccggcgacagtttggagcagtgcgactccaccgactgttgctgatggtacggatggtggtggtggggcgaatggtgtctctgctgctgttgctgatgatgataatgttgttgctgttggttttggcgccggtgctgaacactgttattgctgttgttggcattggcactgttcgcgttggtcccattgctgcagttgttggcgttttgattgttgctgttgctgctattgctgggaccgacggtggacgactaaaaaaaaaatgttaaaatttttcccgtaaaaatgaataattaatatcctgtcagcttttggcacatgtttaaaaatcatcattccattaaataaaacttgaaattaatttaagccatccaaaacacaagtttaggaccaaaatgggcacccttttttcaaatagagagcctaaaccgttgggttttttaatcaagcaaagactcaaaaatgcgcaaaaaatgggttacgttgagaaactgaaacctatttaaacatattttgggcgctgacattatggcaattgtgccaattggtcgtatgattttatgcggcatttttgtgctacaggcatataaaaacccgacattccgggacccatgccggccaggattcggattcgctcgctattccgttcctatccactccaggtttcttttttcaatttgctttatattccctattagagtttcggccttttgaaaaaagcctggacctgaatttccgaacaaatcctggaaaatccagtcctgagcccaggtccatgtcaagcagttctatcccctaaacctgtggtgaattacttgctgctgaaaatactgttgttgctgctgctgttgctggtcactgctgcccaccgaggagggcgccgtgtacggcgaattggcggccgacgacgtgcgactcgttgagctggtgatggcgcgcacgtcgcgcatcacgttgcagaactgctcctgctcctcattttgtttacgctcctgtgcggggaaattgttgtaaaacaaaattaaaat

SEQ ID NO: 28958 - DNA, 1049 bp, Heterodera glycines
ggaatagtagcgacgaccctaatttttctggatttctttctgggcgagtttggctctgaaaattttgaaaaaacgtctatctcttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaactatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaatagtagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggatgtctttctgggcgag

SEQ ID NO: 28959 - DNA, 1228 bp, Heterodera glycines
  misc_feature (1211)..(1211): n is a, c, g, or t
ataaagaaagggaatgtgccaggcccgaataattaaataatgtccttcccgaatttaggattccacgggattattgcgattttccccaatttcctattccacttttaattgctcaattccctttaagtaattctccgctctttatatttccatgtccttttctttaacttctccattatccaattaatacgatcgatttatttatttaaaaatggaaaatggttgtgattgaaatgtgagaatggaattgcgaatttaatatgaaatcggtaaaaacggaattatgagtttaatgtgaaatcggtgagaacgaaaaagatttgagttccaaatgtattttagtgaaaaatagccaaaaaggaaaatcctgagggacggcctgggatgggagtgggaaggaaaaccaaaggggaattttatccgggatcgaaaaagggactcgggataacgagaaaaggggacggagaagaattccttctccggagttgctcgggaaatgtccggggagagccaactgattttccacttccacggggaaaaggatcagcgaaatgctgatccttaaccccgcctttttgttattgtaagggggaaagagaggggtactgtacgttacaataatgtgcaaaatgttaggcctcgggtgggaatcgaacccactaatccacccaatcaatgggcagctcttataccattgagctaccgtagtttcaagggacggctaatactgtagcaacaaactttcataccatataccaaatttgtaacccatacacaattctatgtatggacaacaggtggaacagcgtcgtttccggctggcacccaacaaagtggtgtttcggccacgactgcgcatccgtcggcctggccagccggcgccggcactcgaagcaccggctccgccgtcgcccatcacggcactggcacacggcgcggaccagcaaccgcagccggcacaacccattgcactgcccgcgttggcaccgctgaagccggaaccggaggagacgcgtcagtgaactttgattgagacaaaaacggcggaaacccgtctatctttttgttttagcagcgcctgtgccacttccgcccgctcctccggagccgccaccaacagcacctcctacgccaccaccaccgcctccggaaacaccggctccgccaccaccatcaccggaaacgccggcaccacctccacaccgcttccngcaatggaatcggttcg

SEQ ID NO: 28960 - DNA, 1617 bp, Heterodera glycines
  misc_feature (12)..(13): n is a, c, g, or t
ttgatttttcgnnccaatgaaaaaattattactgatgtactgtaaagaggcatatttcatcggatcattaacacaatttttcacattattactcctaaacacaccccaaaaaaccaaaatctaaactttgttggttttgtccatcgaatgtgttacattttaataatagtcaatagcatcaaaggctaaatgccttgtcaatatgaatggtttagcataaatcaaaaaatattccgcctttaaccagtatgttgttagaaattttaaatgagtgtattcccaataaagcgtttaacaaagaaagatttgactcctaaatacccaaacatttattagcgatccgattaaaagaaaaaggctgaaattattcgaggcgaagctaaaactgacccatttaaaaagagcactatacgaatagcgattttctttacgatgatgaaaaaatacgaaaccgaaattaaaataccgtaaccgaaattgagaaaaaaggctgatttcgaaagggaaagaaaattcttgatttgataagatgatgatacgaaaactttgagatgtcgaatccctattgagagatactctaattctggatttgatgagagaataagatgctgatcgataaccgagtgctagagagagatgtgaggatatttgccaacttatttgccgaattcgatttaataataaggaaacgagacccgagcgatacgatacttgggtaatattgatgagaaaatgatcgaatgctttgatatcggatgataaattttaacgtcgtcgagacccgaaattcttgatgaaaaaacttccgaacgaaaatggcacttctccgaggatgagatgattagctatgaaaattttgaaaaatttgccgtttcttctctttcaactgttattactgacttgtttaggatctcattagacattggttcacttccagacatctggaaagaatcaattgtttttccgctttttaaaaagggtgacaaaaataatcccgaaaactataggccaatttcattaacctgctcactctgcagggtaatggaaagaattttaagcaaaaatatttacaattttctattaaaaaacaaaaaaatttcggaatttcaatttggttttgttagaaataggtctacaacgagtcaactaataacagttgtggaagattggtacgaggcaataataaatggaaaaaatgttgtgtatttatattgattttcaaaaagcatttgactcagtgccccatgaattacttttatacaaattggaaaaaataggtataaggggcaaacttttgatgtggataaaggactttttgagtaataggacttttcgtgttaaaattgtggaggatttatcctccagtaaaaaagttggctctggcgtcccccagggctctgtccttggacctttattatttttgatttatattaacgatcttcctgatgctttgtcatcaggagtaagaattaaattatatgctgatgatgttaaattgtatatttgttataaagcaagaaccgaaacagaaattatgcataaagcattgcataatttatcagaataggcaaataaatggcagatcataatctcaattaaaaaaacttttgtacttca

SEQ ID NO: 28961 - DNA, 1014 bp, Heterodera glycines
atatattttccattagtcaattttttaaagcattctctatcagttaggcaatgatttttacgaatccatcacacgacgcacttggactgcgcggtgaagcggagtgttcccatcactgccaacattatttgggtccgccaaacgcaagtaaattcagggccgagttaaaatatttaaatgaaggatagttcaaaaaaagggcgttaatcaatgtcgtctgctgatgaatccggtcacatggctcctattcggcgatttcttcgtctggcgcttgttcattttggataaaaagattggcaaagaattcgtatggcaaagtaattttgaaatctaaatttttttgaaagaattttgataatttttttttattttaaagagcaaatttaaaagcagatttttaatttttaattccaggaattaatggccccgtttgggcaatggtaaagaattactgtacacaccgtttcaaaaaacgatacatgtgccaataaatagagagtgaagagaaaaaacatctctctttttggcgtactattcctttatctctgttaatagagaaaaactgaatttattcgctctatagaactttttttccgccttacagattttctttaaattttgcatatcgacagagaaaaaaattcttcatttttctatgctgatttattattggctatgctcaagttcaaaagttacaagtttagaacacccatatattttttctaactcaccaaactgttcaacatttgcttagaaaaagcttctcctcatcaagagcttttgaatgataccaagatctttcaatttagttggcaaaaagcttcaaataatttccgaaaatctattttttaaattttttggacaaaaataaataaaaatattcatgttgcacaacggactcgaacctccgccctcctcctccctttgtccctttactatcttacaaaaaccacttcgccacacatgcaaatctttttggaactgggaggcaaaaactgaaacggtgtgtgtacg

SEQ ID NO: 28962 - DNA, 1746 bp, Heterodera glycines
aaaaagaaagaagtttaatgtaatttgttaagagaattgttaaaattttcaaaaaatttgcccaaattctttataaatttaacttttttggattttgaggcggctttagcccactcacaaatcagccccttcccccctggcaacgcccttgggctaaacaatttttttttttttttttgctgtgccccacaaccaacagcaaaaagatgatgaattctgggtggtgatcatggtcaagatgatgctgatttgatgataataaaatgcaggattaatgatcaaaaaaagccggttcattttccacatttttttttatttgcttcgccgctgtcgccgcactttttgcgataatccgccaccaccacccacgcggaagcaaaaagggtttaacacaaacgcatctgtgtgtgatgcgcatttatatgtatgcaaaaaccaaaagcgatccagtcatcaagtcttgacaaaaaaaaaaatgcatgcgtctgcaaaaaagttcgaaaaggcgtaatttgtaggttttttacgagaatttagaaaaaaaaaattttttacgaattttataggctaaaaaacacttgtcaggcgctttcaaagtctgatagcaaatttataaaaattagtttaacaattgccgtatttcctaacctcccccccccccccccctcctaaattagagcccccccccctcccacgaaataaaattcccctttcgagggggattgaaaaatagatcctcctgctgctgggcttgatttatatagaatatacagttaggtatacatatagctcgcaactgcaataaaagccaaatggattttttcccacaaatttctgaaaaattttttttgtaaaattgccaaaaaaaaaatgaaattcgcggttccgacctactctagcatttacacaatgctcaaaatgaatgttttctcgccctttatgtacgcctcgcgcgcccgccactaaaattctggcaaataaaacccaatttttgccttaattacttaattgattaaaaattctattatcatacatacagtttataaaaaatgatgctgcggcattcttcattattgtccattagcattgccattctgttgctgctgatgcccaccatgttacagagttgccatccgacagataatacggccgccgctggaacgacaggtgttcatcgacagttgttttttttaatttaatcaattaggggctacagtaatggaaaatattttttgctactgtatttccttccacactatgtttttaattaaagtgaattgataaattaattgaatcaaaatagaaatggcaaaaatttgttaggatagattagaattattttaaaattaattggttttaattctatttttaattgtggaatttttttttttaaatctcgattcccgagaaatttgtccccagtttttcggggggggggggggggggtttcggcttcgatttactactggctcatttctcgtgtctcggttttcggtaaaaaaattaagaaatttctcgccacacatacccaagggaatacggtagtcatgaaatacggtaactaagtgttttttgtattcagaaataaattttctaagcggtgattattttaattattaaaaattgggttagaaactgttaaataaataattttttttttataattatttcttccatcaacagccaccacaaatgtcccaacgttaacggctgcttcaactgctgcaacaaccggtggaggtggca

SEQ ID NO: 28963 - DNA, 858 bp, Heterodera glycines
  misc_feature (12)..(13): n is a, c, g, or t
aaaaagagatanngtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaagggcgtccatttattttgggattatttcgtattaccccgaaaaaagagatagttcgttttttgaaaaaaaattataacgagcaaaaccaatccagggattcgttagggagtcagcaattattttttccaaggacgtccatttattttgggattatttcgtattaccccgaaaaaagagatagtcgttttttgaaaaaaaattataacgagcaaaaccaatccagggattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttt

SEQ ID NO: 28964 - DNA, 1597 bp, Heterodera glycines
  misc_feature (1551)..(1551): n is a, c, g, or t
  misc_feature (1578)..(1578): n is a, c, g, or t
  misc_feature (1586)..(1586): n is a, c, g, or t
gagcatttgcctaccatttaaaagtgccaaaggcaaggagaaagactgatcagttgaaagatcactctaatcggttgagctgatcagttgaattaatcaactgatcagtctcttaacattgatttattgggatcagtgattggattggtcatcagcttggattgcttttccattgttttctgtctgttccacctgttctcttgtccatctcgtctgtcgtagctgccgccactgttcccagaccaagtcaatgaatgagtcttaatcaatgggtttagtcgttttttatcaatggcttttcgtccataaaatattaaattacgatggacgtagaaaatggggtcgttcgctgccaaagttggcggtttcatatcgccgccgacgaacaaatggacttgggaatgtgaatattcaagcgcaccgaagttgggctggtagggacaatctgaggaagtgatcaatcggttgagggagaagcgggtggtgatcgggagaatggtgaaagggaacgaacggatcaatggtttttttcggttttccactgatcggtcggccattctttgccgttcgattcgtccggcggtgccctccccccggcccgatgctttcactttgttgtggtgccgtataagccaacacttgttcgatttgggtctgtcccgaacacgctgttcacgtcgttctccgtcgatcacacgtccttccgccccgggccatcttcaaatgattgctcaattttttcaatttttgccaattccaaccgcaaaatattcgcccgcccctccaaagtgcgccatcccgcaaaaggtccgctcacaacgtttcccagctgatcagtttcccccataaactgtggagtgaaaatgaccgaatcggccgggttgggcaaatacgagtcgagcacagaatcccaataaggcagtgacaacgacgggtcgaccagacgaagcgcaatttcaaaccgtttgatgaactcgcgatggaacggcaaaaagccggggcccgaatgagcgccggaggaaacgccgacctgagaaatgacagaccaattagcaaatgcacacactttgcttcagataggagcctatataacgattaattgttagtgcttagagttatcgattgatcaacttttggccaattatcgattggtcaacttttggcctatggatggcaatttctcagtgaatgtttggatcagttcagtcactcaattccattgtttgcctgtctgtgctggtcgttgaatctgtcaaactctccgctcctcttcagctcgcccatcgcctggtgcagcttccgtctctccccgtcgctcattgtccgatattccctcctcacggccatttccaagggctttcccccgggcaaaacgcactgtcccccagggccagaaattccctgggtaattagcaaaaaattgagggacaatggaggggggaaatgcctggaaatagggacaaagacaagccaaatccatgcaggagtgggcactggggttgaacggacgcggcacggcccgggataacgacggctgatcaggcacaccgngtgcactgaccggcaactgattgcctntctgctgngcgatggagcg

SEQ ID NO: 28965 - DNA, 1588 bp, Heterodera glycines
ctcttcacactctctgatcaattctctctaaaatttgcatctcaatttctctctctctctttgtctttctctctctaccccactctctctctctctctctctgatcaatttactctttaaatgttcgtctcttttcccaatctgtctctttcttcctctcccactctctttctgttcccatcatttctcttaccatttccattgtttttgttccatcattttgttgattatgataataataatgatcctctttctccccttcttccatctgcttttcctcatcttctgctgtaatcctttcctccttttgctttttcattttcccggcactttcgctgcgtaaaattcggtgagcacagtcaaaggaccgtcgtgagaagaaataagagacgaacgaatattcgagcagtacaaggaaaatcagtgcctaaaaagggcaaattggggagaattggcacttcaaaggcagtcacttgggagaacgtttgccaaatgtccattgctttgatgtaactgacttgtggcaagtcttgtctggcctaatttaaaaaattaattaatttattttacaaaatatttaaaaataaaataaaaaaaaggcactccgttagacattgtggtcaaagtcagcagactaaaaatgctttattatgtaataaatatcattaaaaatagaacaatgaatgccttgtgattgtaagggtaatgcgcgcgggcgatgcccgggggtccaaccaaaaagtcatccacgaaacggagactaacatggctgaacatgaagaggacaaccaacaaaaggggacggacaccgtaatgcgagcatgggaatacggtggtactgtaccgcttgggatgtacgtttggatgaggtggaagaggacgagccgtttcattacgatgtaaccgcgcaggcacgaccaaaccccttgaggggagggaaagggggggggatgaaatgccgacgaacgacgcgcactgactgaccaatgcccctgaaaagagtgtacggactcgtgcaccgctcgaagcgcatccccgtgatgaccatgtcgttaagtttcagctccggattggtcgtgatctgttcttatgattaaatgttacgtaggaaatccaaaactgaaagcaaagccaccgtaccgggtagtacggtgggtccacgtgccaactgaggttcaccaaattttcgatgtaagcgaacggttggatgaccattggacactcctgacgatcgaatgggaacagctgaatggcggcggaatgtgccgttcagttttggtgcttgccttttgctcccaacctgcaagtccatgttgcaggagagagtcacgtcgatccttaattattagggtaataaaagaagcaaaaatggattaataaacaccttaacgttttaaatacaaggccatccgggtaaattacgagcatctgtaagggaggaactcattaagggtaattagcaaagaaacgaacgcacaaagtttggcattgtcacttcctgaagataggcaaatttggcatctagaaagtataaatctgaaattataaaacgcctgattgtccgaacacgctctgcttttcttgacct

SEQ ID NO: 28966 - DNA, 2157 bp, Heterodera glycines
aaatgcaaaaaaaaaaattatttaaggccatttttaacatttattgggaaaattaatgcttttttttgccatttgttaaaaaccagaagacaaattagggccggtggagtgccttccattaattattttaaattaaaaattggaggcaaataaaacaagtaaatattattttcaataattaataattaaataaattattaattaaagtaaagtaccaccaaatttacctgcatgacgtggtcattgatcatcaaattgttctcaaatttgtcgatgaccggaaggtgaaggctgatctaaaacgtgatttgaaacataaatattaatttgtttttccaacaaaaaaattttcataaaaataaatggataaaaggaaccaattaaaatttttgacaaaaaattctttgatatactttatttatgccgaccattttttaatgaaatgaaatttcttcaaaaaaaagaaacttttcattgaaatctaaaatttccgagcgcaaacgacgaaaataaatttccaaaaagtcgaaaatagctcaaaggaaaataggggaaaaagattaaaaatctttcataatctttaattcgagaaaattaattaaagatttgctaaaaatatttaggtatagcgatttgatccctaaaaaggatacaccaatggaaattttggaatttatttttcagtctaagatcatccattagtgcgagtgattttttggattaatctggatggatcagtccattaaaattagcgttgggaaaaaaacaaatatttatataaaatttaattttccaaaaaaaagaaacaaatgcacttttcttggctctcctccggcgcagctgtgcatgatgtccatgcgcacattctcgaatttgtatctaaatgaaaaataaaacaaaaaaatcaattcaaaataatttttaaatgacagaaatcattgaaattttcccctaatttgcttgtaaaacttatgttgcattaaatttaaaaataacagaattgagcagccaattttagtaataaattaattatattattaaaatttttaaaaccaaacgaattaaaatttaacaaagtttcggtaattgacattgatttcataaaaacaaaatgatttttttgtttccaattttgtaaaaatgtgtaaaattttaaaatctataggtttcgagaaaatttattggctatgaatgctgccaagataatatttattatcttatactaaatttaattaaaaatatatcaaaaattgttttaaaccacacacactaaagtattctctaagcaatatttaaggatttagattttaaataagatttactcaagtggctgcatgatcaggttgcttttgtttgcagctactcccattttattgaccattggacaaagactggaaaatggacattaaattttatgaaaaattattggcaaataaatgaaatataatttgaaaaaatagttaatcattaaattaaattttctttttggtattttcaaaaaataaaaattcaaatttaccgttccatcaacaaaacattgtaggcaaagttgctttcaccatccgtcaatttcacgttcaattgtctataaaaaaaaattatgaaaaatatttttaaaaacaacgaatttttttggtaaaaaatggaaaatgatttaaaaaaaatcattttttatttgaatgatcaagatttttgtaaaatcgtgatcaaacccagcaagatctacgtagactgtgattttaaatgacttaaaatgagcatgaatttccataaaaaaggggttcgaaaatttggtagattaaacagcagggatttctgtaacaatatggtcgatgttacggtaatggaaaggaataatattttacttatagtttccgaaaaatattcattttaatagttgcaaaagcatatggccaaagactgcgaaaaaataaattttggtaacaaattttttgaaaatttcgaggctaataccatcggatgataccataaaataaatgattcccaaaattttaaagtaatttaactggataaaaaaaaattttcatacataaattagggaactcacttgtattggtgccaataaccgctgcaattggagttgggaaggaaaccctaacaaatacaaattaataaattttaattatatttaatttc

SEQ ID NO: 28967 - DNA, 1178 bp, Heterodera glycines
tttttgaaaaaaattataacgagcaaaaccaattcagtattcgttagggagtcagcaattatttttccaagggacgtccatttattttggattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtcatttattttggcattatttcgtattaccccgaaaaagagatagtcgttttttggaaaaaattataacgagcaaaaccaatcccggtatccgttagggagtcagcaattattttttccaaggacggccttttattttgggtttattttgaatttcccccgaaaaaagaaaaagcgtttttttaaaaaaaatataacgaggaaaacc

SEQ ID NO: 28968 - DNA, 1507 bp, Heterodera glycines
ttattaatgattaattgtttttctcttccatcggaaattctactttttttatctacaattttccatttattattattcagaaaccaaaaattgagatttaaatttaaaatcatagacttgcaaaaatttctgaatcttcatacatcttatttttagtgaggaaatttttaagtaattaatcaaatccatttttgcaaaataatttagaaatatcattatttatttatttataaattattatttttctttcattcaaaattttttacatctttatctgtaaattccatattttcaatttttaatttattttttatctataaaccataaactgagattatataccaaaatcaaagactctcctaaatttttctaaattcttttttgtggtaggtttattttatcgggaaattttcggtgaatattcaaaacattttttaaatggcttaaaaaaaagtcatttttaatatatttttcgtattaattactgtttttaattaatttttattatttaataaccatcagtttaccatgtcatttcctaccaaagaagctgcaattaatgaaattggccaactgtcgactgaccagcagaaaagttagaaaacaattaattaaataatttaaatgaaatggggggatttgacttttgccatttcggttctgctcatttgaaactgaattttttttttctttttttaaattattttgaaaattttatttttcgatgctattcaattatgtttcagcttctgcatcaaaacgtccccgaagccaaaacgacgccggggccgagacggcggtgccgaaacgtcctcggggccaaaacgatttggccgaaaactcagttgctacagaaacagaaacaaataatggagttgaccatttgctggcgactgatcagcaccaaagttggaaattaattcaaaatttgaggattaattttaaattatctgtgccaatttggcgttgaaaatggcattttaaacaaatcctaagtttcaaaaattgtaactacaaaagcccacaaaaagtctaattgttcaaatgttgtgaaaattactaaaaaaatcaattaagttttgcatgctaatagagagcaaccaaggctttcgaacaataaaaagttttgctaattttgttgtttcttggaaagttgtgaaaaaatttattcaaaaaatcaaaggtggtggtggatttactaaatacgccagcatcacttgaaaaaaatactatctattattatataaaatagatattttttaataataattattttttatgttttctaacaaatgcttttaaaaatgccacaaaatttcaaatagataattagttgtttgagatttaatttaaaaagtaattaaatccaagaaatatttcattaccttaaaagccctttaatttaaatagtttatttgtttttgcacagttgacgaaaacgctaccggacaaattggagcaaaaaagaagccgtttcgtgtgctaattgtttaattgaaaaggcaaa

SEQ ID NO: 28969 - DNA, 1517 bp, Heterodera glycines
  misc_feature (35)..(35): n is a, c, g, or t
  misc_feature (44)..(44): n is a, c, g, or t
  misc_feature (71)..(71): n is a, c, g, or t
  misc_feature (1287)..(1287): n is a, c, g, or t
  misc_feature (1425)..(1425): n is a, c, g, or t
  misc_feature (1487)..(1487): n is a, c, g, or t
aatgacagattgcggattgtgatcccgcaaatcanttcatgatntatgccatgacataataaaagttattnaagctttttattttttactttgttttaccaaggatacaattaattaatggaatcgaattttgttgcatttaacaacaatattactgatcagaacaacgaagataacgatgataaagctgacaatcatgcaaagcaatcaaaggaaatgctgaaagagagccaaagtgaagcagaaacatcgtcgaaagaagaagcgaaaaatgaattggaggaaacggagaaggaagaaagaaagcaaaagtcagttggaagtgaatgtgagcagcaaaaagcgatgagtgactcctccgaagagtccggccgtgaacactttcctctggtcgaacatttggactgttccccgctttaccgcgacccgaccttcgctgaactgtgttccttcttcaacatgttcactccgatgttcggctttaagcccctttccttttcaaaattagagaatatgttctgcactttggtagaaggcgatggtttgttgtaattgcatttttttatttgttaaaacattgcttcagcaactcgcgagctgattgatcttcacataacgctaatgcgaaaaatctatttgaagtcggctcgggcggataaatgggaacaatcgctgctgaaattttgtgcaattgccccgggattggacgcagaattccggcagctgcagcgaaacacttacggaaacattccgatgggctcaaaactcgctgtaatgaaagccctttgtgacagccaattcgattacaatctgaagttcaaagaaaatgtgcggccattcattcagttgttgctgcttttctacaacattttttcagattgccaattcttttcggcacaacgaacttcgtctggcgccgattggcactgacaaacgcggccaaatgtactattttcaggtcgattatgacctcgagttccgagtttactctgaggaaaccgatgacatggctggtgtcagttggtcattgagagcgcgtactgaagctgaactggccgaactcattgagaccctccgaaatccggattatgggctggtcacaaaggaacagcaggaagaagaggaggcggacatcgacgaggaacagcttttggaccagccgaatgaaggttaagccaagcaaaggaagcgcatggaaatggattcaaatttagcgaggaaagatgccactcagacgaggccctcctcggcttcgtccgcctcaaagccttttcagccaaacttaangtgacgaagagcgacagaaagtgcaattggagggaacattttcagtgctttgggaccattacaaaaagggcggagattctgaacaaagtaaacgaatcatgcaataatttttcatcataaattttaatttgaagcgcnaaaatgaaaagagaaaaagcgtggccaatccgccgaaatttcgtcaacaaatgccacccaancaaagcaaaaggaagaacaaagggagagca

SEQ ID NO: 28970 - DNA, 1622 bp, Heterodera glycines
acaaaatactggcgaaaattttacattttctctctcaacacaaatgcgatttttcactgatttttgcagaaatttttttaatttaataaaaacataattaatacgttttgttaattgagtcgaaaaacaaaaaagaaatttttaagtatttttttcgaaaattaagttaagttgaaaaataaatgtaaaaaaatccgacaatattttagcaaatgcaaaagaactagaaaaaacatctttaaattctaataaaataattaattttaatttgataaaaaaaatattctaaaaatattttaaaggaaaatttttttttctaaatatatgccttatttgcttaccaattcaaatggtattttttgctggtctttaaactttatttcttatgtatgtgaatgaataataccttttggtcttcgccaattcgaggaacggcaaaaaatgtttttttccaaccaataaaccaattaattaattaattaattccagaaattaattaatcaatccccaccatttaatgcggcagccagaattaattgcgttttgtgttcacgcggaaacattgtgatggtgaccttcaaaaatgatggtgctgcaatttttcgctttaaaaacgcgcgtcacagtcactgatcaaattgggatgtgcgcggcgccgaatgatcacgcattgtgatcagtcagtcatttacggcaattgcatgcacgcccactgcgcgcttttttggggggcctttgatcaatgacaatcatttttggccctccgatcactgcctgctgttgtaagaaaatttttcatctaacatcattgctgtcggtttagcagcatgtagtgaatatctctcagaaatttttgtccggtcaccacgaccagcgattaggagatatttttttttttgtagagaatttaatctgatcattcaatgatcaattgaagagcaattttattgcgatccatcatttacaaatgctaaatttagtggttattttgaagaatttagatggattcaattcgcttctttataaataacaaataattagctccgaccaataagtccaaaacatcgtttcctgtgttccttgaagtaaccagtatttaatagccaatcaaagtctgaataaattttctatcatggaacaaacttccgtagcgaaaagcatttagaaacatatgctatgacgaatttcttagatccgtaaggtaaaggtgggggggggggggggtaattaaacggacaatacaataatacttgcataaaatatgttctaggcatcacgggagtagccaggtccccccggtttataagaatatggattatccacgatgttgataatcatgaccatgatgaaaatttccataaatttgaattttggcgtagaatctatttttaaataaactcaaagtataaattgttcgacggacttttcctgaaaataatgacgaaaaaatgaatgcttattttttcgaatttcactctcttcaaaattatgaaaatcatcggtctttaatgatacaaaaaaaataacttcatttggttgcttgtcaacaaatttaggaatttaatttttcattttcaaaacttttagtgattttttttttaaataggcccccagtttttttt

SEQ ID NO: 28971 - DNA, 1263 bp, Heterodera glycines
ttttttcaaaacaaaggttttctttaaaaaattgccaataataaaaaattaatgtaataattgccatacaaaatctaagtgatccgctttaaaacgatggatatcttattttttcaattccttttataaaaaataattccacaaaaacaaaaaaataataaaaagttttttgaaaattgttttttttgatatttcccaaaaagtgcagtatataaaaaagattccaaaccttgaacattcgcggctcccacaggcgaatttcgccgtcccgtgtgccgaccagcaaccgttcccgctgctcatccccgccaagcatggccatgccaacgacgggcgcatttgagtcgcgcaggtgcaacacctcgcagcccttggcaggcactcggatgtcgaacagtgcgacagtgccgtcagaaaagcctaaaattttgggcttctgcaagcttttacgggataaattttgtcaaaaattaagattaatttattcaatgggttagttttgtggaataagtttaagaaatcctaaaagtctgcgtttcatatgataaatggcgaataaacattttttctcttcaaaaaaagcggttaagttcaaaaaatgctaatttttaattgcacttttttgcatcaaactgtaaattgttttttagcccttgggttactagataaataaataaatataagtgaatttcctcaaatctatgagaatgggctaaacaaaaattccattctttttattaaaattcccagaaaatgattaattgccccctggcggtgggcctgggtttacctaaaaatttcttattttttcccaaaatttctttcactaaacgaaggacgtaccgcagctgaccaaatcaaagcgcagctccgacccaaccgccacaacggcgcccttcgcgtgcttcagcgtcacgtcgaacaccgcgcgttcggcccacgcgtcccacacgcgacagatgcgcacattgccggcacagacgaggcgccccccgcgctggtcccaactgaaaaatggcacaaaatcaaataaacgccccttttgttcgatgtatggtaaaaattaaatttttttaaacgaagtttaacattcctttgtaaatttgggccaaattttcacgacgaatttaattaaaaattcgaagattttttccaaccgtgtgcagacatttgcgcctatatcgaaaatcggatttaaatttgagtttttccaatcctatagctaataaaaagcattaaagttttttaatttgctgacgataa

SEQ ID NO: 28972 - DNA, 1308 bp, Heterodera glycines
atgctttgcttttttgctccttaatttatgctttctttttgttagttattaatttattgctgtgagctttcttatttggtttgtctacggaagggccgaaacacttagtttttttaatttgtaatacggaagggatcgtactgactaggcccacccttccagttaatttttttggcaattgtcgtccgcaattgtacggtccgcaattgtcgtaacacctataaaattcgaatgtcatcattaaccactttttaatcaacaaaggacgaattcgcgtcatttcgacgtaagatattttgtttaaataaaaaatataaaaaacaatcaaaatattttaattacaatttatttatttttcatttttttagcaattttccaaatctgagcacattggaagaaatgagtcttttgtttgccagaattggtgagccgaatcgagcgaaaacaatggaatcatcaatcgcaagcagctcaggtgtgtttggacaaggtggaaacggtagtaaaatatttaatttttgggatactgtatatatcaaaattaaatttaaacattcagaagtggatgatgatgggaccagcagcagcttttctgacggtaatagcagaaaatcagcaatcgctggtgagaaatttctttttttgcataattttccaatttctgaattacaacaaaatacacttttgaggaagactgatattgcttcataaattatagcttttaaaaagacaaaacgatctgataaagaaaggagaaatcttttgatttatgttaaatttagacttctttttattttcagacagaagaaaaataaataagttgttcattttgactgtagtgaacattacggtaacagtggcagtgatcattttctttacggtggtttaaatttaaaatattattataaattatttttttaaatttacggttattttcgattgtcagattgagaatgcgcggatcacttctgagttggaatttttgaagaaatttgttggaaaaatggaacaacaatattggaatggttggaattaatattaacttttgtaatttcggaaatcggaattccgtgccatccctgtctctgactataaatttggattaaataatttaaattaattaattttcatttgataattgttaggtggtcaacagactgaattttgtaccaaaatggacaccgacaaagacatgatcaaagccattgaaacaaaactcatcgaattggtggaacatcaaaagaaggaagaaatttttattggcgttttgaaagaccgatttggaaagggtaaaaaaagaaaaaataa

SEQ ID NO: 28973 - DNA, 2065 bp, Heterodera glycines
  misc_feature (23)..(23): n is a, c, g, or t
  misc_feature (1524)..(1524): n is a, c, g, or t
  misc_feature (1533)..(1533): n is a, c, g, or t
  misc_feature (1567)..(1568): n is a, c, g, or t
aaatcacttttatttctataacnttttttcaaaaacgtgataaaaagctaaaataaaatttataaaatagagcaaaaaattgcggatttttgtattattttacttttccaaaataacttttcagaaccgtgttcagaatttttttctgaaaattcgaatttttccagaacttctggaataactttttttatattcatgatagagaatctaaataaaagccataaaattctcctgattttttgctatttttaaagctttgttgtatgaaaattgacttaccctgaggttagttatgaattttcaaatattaggccaaaatcccgagggccaaaaaattgccaaaaaataaagaatttttaaaaaattccaaaaattctgaaacgaaaaatgaacttcatattcgtgctcagcacatcaaaataccccagaaaaatatttttgaccccaattttcaacccaaaaaaaattttcgaaaatttctagggggcctagctcgaaaatttttgaaaatttccgaacatgttgcacatcatccgatagagcttaaaaagctctacaattttgctcttaggccatttttggctaaaaccaacccctaacgagttatgagcccgggactcaaatgtcccgctcaggccaaaatttttttctatttccgggaaaaaatcgaaatttttccgaaaaaaataccagtcgatagagctcgaaaaactatgttttggaagtggtctccgtttttctgggaaaattcgttaaaaaatcataaaattaaaaaacccgaaaaccgttttttaggcctaactcgaaaaattttgaaaattttcgaaattttaaaatctggaaaaatcgagcttattgaactctacaataagtctgctggccaccctgcgctcaggtcaaaccctaatgagttattcggctggtactgaagtgggaaaaaaaaattaactgagtctccgtgtctgtacaggtccgggatttggtctgatcaaaaaataaaaaatactggattatagaggacacttctgcggagtgccctcacagcgggaattttttgatccgagtttcagaaaaaaagttatgggccgtcaaacgcacgaaaaaatgagaaatccgtccctgggactcagtcgtccgcgctgaatttttttctatagttttcccagatgcgcctcaaaaagttgtaagacccttccaccactttcagggcgctcccggccttcggccgggagaaaatggttttagcaacgaaactccttgtcaatataacgtatatattaactagcgggtgcgtgaaccgtcggctatttagctgggaaaaagcgcttcgcgctttgggagcttcgctacctaggctgtgaagcgattcaaattgatcgaattggttggagagatttttttgaatttttaaaaaattattatgggtttttagtcaacatcgaggctcaagacgggcgcttcgcgcccgtttttttaggctattaggccgctttcgcgggcctcagtcggggcgcttcgcgcccngtttttcanaattttgttggccttggacgggcgcttcgcgccnngtttctaaaaatttgttgggctttgacggccgcttcgcggccgttattaaattttgatcgactcagacgggcgcttcacgcccgtttctaatttttgttgttcttttcggccgcttcgcggccgttttttaaattttagaacagatacaaaagtgattttaagaggtacaacattggtcagaagaggtacaacggtgattagaagaggtacaacggtgattaaaagaggtacaaaagtaaatggaagaggtacaactttgatcagaagaggtacaacagtgattagaagaggtacaactgtgattgattagaagaggtacaactgtgattagaagaggtataactgtgattgattggaagaggtacaactgtgattagaagaggtacaacagtgattagaagaggtacaatagtgattaaaagaggaagaacagtgattagaagaggtacaaaaaatgatgagaaaaggcacaacagtgatgagaagaagtacaaaa

SEQ ID NO: 28974 - DNA, 1038 bp, Heterodera glycines
aactggggatacaactagaggggtaccgaaacggtagaaaaataatataccatcggtatataaaaagagcaaatacggtacgtacatacataagacataaccaatcgcttcgaatttaaaacgaaaattcataatgcttattttcgtgaatttttattcagccgtgttgttcaaaagcggcgaaatttgcttgttttttcaacaaaacacattgaaaatgagtcgagagccttcaaaagaggaaattgaaaacatcggaaaaataatccaacgaaatttggcgacacaacaatatttaaatggctaagcccagggatgggatccgtccttgaatggcaaggacgtccttgaaaatgagcatttggaaaagtttaaaaaaaatcaaaaaaatttgagaaatctttgtaattttcaacaatattttgattaaattatggcattatgtcatttaaaaatgtaatttttgagaatttttgagaattttatggcattaagtcactagtcactatttttcttaaaaaattagccaaaaatcgcaaattttggtaatttttggacaaaaatctgtaaacaactcgcattaaaaattaaatttttccggacccccctatcctcaaaaaattttttaaaaagcgcgccgtaaaaaaacccattttataaacaaaaaaagtcgtcgcatggcttaaaatcgcaaaaattaggcagtttttggtgaaaatctgttaacaaattgcattcaaattttcaaaatttttccccggcggcgcctaccggcaccgccggaccccccccccccctctgtcccacaaaatttttggaaaaagcgcgccacaaaaaaagcgtttttaaagcagaaaaaagtcgtcgtaaatgaagaaaatgataagtgaaaacaaaaaaatgttggaaaaaaacaattccggtgaaaaatacaagccatttgaataaatattaaccatttttcattgcatataataaaaattttaaatgtccttgaatttcatgaattttccccactatgtccttgcaaatcggcat

SEQ ID NO: 28975 - DNA, 1172 bp, Heterodera glycines
acctcttctaatcactgttgcacctcttctaatcacttttgtacctcttttatcacttttgtacctcttcatcaaatttgtacctcttctaatctctggtgtacctcttctgatcactgttgtacctcttctaatcacttttgtacctcttttaatcatttttgtacctcttttaatcaccgttgtacctcttctaatcaccgttgtacctcttctgaccaatgttgtacctcttctaatcacttttgtatctgttctaaaattaaataacggccttgaagcggccgtcaaagcccaacaaagtttaaaaacgggcgcgaagcgcccgtccaaggccaacaaaatttgaaaaacgggcgcgaagcgcccgtccaaggccaacaaaatttgaaaaacgggcgcgaagcgcccgtccaaggccagctaaaaaacgggcgctaagcgcccgtataagttcaacagatttaaaaaacgggcgcgaagcgcccgtccaaggccaacaaaaattgaaaaacgggcgcgaagcgcctaacaagctaaaaaacgggcgcgaaacgcccgtatgagttcaacaaatttaaaaaacgggcgcgaagcgcccgtcttgagcctcaatgtggactaaaaacctctaataatttttttaaaaattcaaaaaaatctctccaaccaattcgatcaatttgaatcgcttcacagtctaggtagcgaagctcccaaagcgcgaagcgcttttccccagctaaatagccgacggttcacgcacccgctagttaatatatacgttatattgacaaggagtttcgtttcaaaaaacaaaatctcccggccgaaggccgggagcgccctgaaagtggtggaagggtcttacaactttttgaggcgcatctgggaaaactatagaaaaaaattcagcgcggacgactgagtcccgagaagcgatttctcactttttcttgcagtttttcttctacgaaattttttctttggaccgggatcgcttagctcttgctggtaggattttaagtcagactatccccgacaactttgccagcaaaacctaagccctacgttgggcgcccaaggctgtagccttggctaattttttttacccaaaagtgtacacttcagtaccaggcgaataactcgccaggggttgctttgaccgaaaa

SEQ ID NO: 28976 - DNA, 1901 bp, Heterodera glycines
aaaagttacagtattcttaaaaacgtccctattttattaaatgcattattttactaccagttgtaaaatggtgcatattttcggaaagttattaaaacgcgctggcaaaaaaataataatattctttaattatttatccgttttttctgtttaattaattattattattttttatttagataatatttttgcagattttttaaattatttatcatttttaaatattattaaaaatttctacaatttcaaaaaaaaaatcttaaagtaataaataacttttcgttctcgcaatgacaaacattagaatttctttgatagttttgatttgttttttttgtgattttgttgtcttatcacatttatataatttaaattgtttttaaaaatattttttcgtaaagaaataaaattaaaactcaatgaatggacaatccaataattttaaattacttataattattaaaaacaatgtattaccagattttttaatttattaaaactatttctttctgacttcaattctttatgttcacatttgtcaataaagtcaattaaccatcaaaattaataattttttttatgaattatacatttaattttaataatttgtttctttcattaattttgacttaagtattatcatagatttattttttttaccatgctgaaaattcattttatgtagttgatttctgactctttttcataaattattaatttccatattaaataataatttaaatgaatttatttttatacatatattttcgtacacatttatttactttttattgtaaagtttctttaaaacgaacttaattacatttcaaaattttaaaacaatcaatgttagttcttgtacttttcttattcaaattctcaaattgtgaaaattggattagattaattcaaatttcatcattaattttaataaaaattattactttttcgttttaaattgaaataaattaatgaaacttttaaaaaattatatttaatttaaattttgatattagacataaaataatttattattttcgtttgaattgtttttatttttaattcgaacctgtcacttaaaaaaggtttgaataactcactaacactacaccaagtttgattcagttttttattttttttctatttgtcttccgatacatgttaataatcgaattttatttaaattacaattttggtcttaaatttaaatatatattctgtttaaattattaatttatatttaatgattttcaccaaaaattggcaatttttcagttaaattttgtaaatttaaaagaattttgggggtctgtgatgccgataagcgccgccgagaaaaattttagaattttcaaggcaaaatttcgctataaatttgaaaaatttggaattatggttagcagtgttaaaaaatgcccatttttgatgatttttttcaaaacaccatctcaaaaaaatcatcattgacctgaacaataatagtgcagttcgagaccgaaaatttccggagactcgagaccgagactgagacttgtccccgagacccgagaccgaaactgagaccaaaaaaacccgagacttttccccagtcgagactcaagaccgagagtctcaaacagcactaaacaatagatacattttatataattaaaaaatatctaatgtataaataattatattgaaaatttgttaactttttaaaatgctaatttttagcagagtatataattgcaagtcattattactcattgctgttgaagcagacgcagtttcattcttgtaattaaatttatgcttgcttaaattttttattatttttaatttgcttatttacatagtcgtaaataaatttttctttaatattttcaatcttgttgactcaaaggattttaattgagttg

SEQ ID NO: 28977 - DNA, 1685 bp, Heterodera glycines
  misc_feature (1385)..(1385): n is a, c, g, or t
  misc_feature (1436)..(1437): n is a, c, g, or t
  misc_feature (1461)..(1461): n is a, c, g, or t
  misc_feature (1466)..(1466): n is a, c, g, or t
  misc_feature (1521)..(1521): n is a, c, g, or t
  misc_feature (1631)..(1631): n is a, c, g, or t
tttttaaaaaattccaaaaattccgaaacaaaaaacaatggtcaaattcgtgctcagcacctcaaaataccccagaaaaaattttttcaccacccttttcaaccaaaaaaaaaattccgaaaatttctagggggcctagctcgaaaatttttgaaaattttcccatcatatagtacaccattcaatagagctttaaaagctctacaatttttgtctaaggcaatttttggctaaaaccaacccctgacgagttatgggcccgggactcaaatgtcccgcttaggccaaaaaaattttctatttccgggaaaaaatcgaaaattttctaaaaacatcaccaatcgatagagctcgaaaaacgatgttttggaagtggtctccgttttccccggaaaaatcgctaaaaaatcctaaaattcaaaaactgaaaaaccgaattttaggcctagctcgaaaatttttgaaaatttttaaaatttttaaagatggatagatagagcttcgaaagctctacaaaaagtccgctggcgccccctcgctcgcatcaaacccggacgcggtattcgcctggtactgaagtgtccaaaatgagatgacctcggtctgccatttttccaggccaggcctttggtctgatcaaaaaacttttgctggcaaagttgtagagcacagttggggggtgtgccttttggggtccgctaagctctgaaagcaaaagcaaaaaatttcgtaacactgagactgtcggcaaagtcagttttcgagccgctggtactcagttggcccttggaccggaaaacctatagttttcccagatgccccgtctcgagttaccccttggtgcaaaatttcagcccggtgtgcttagccgttcccgagattttgtttttgaagatgagttgccttatcattctaacgtatatataataatatttttgaattatttctctttttttctaaattttcttcttctttcccatttttctccaaatatttcgcaaaatgacttttgctgcaatttttcttttctgatttaatttgacagttaaaaacataatttaaaataatatcgaaaataatttcattttgtcgtctcaaaatgggttttggaattttttaaaaaataaaaccgtaatatattgtttgcgacatataaatgaataaaaatgaattttttctgattaaaaaactgacaggaaatcatgactctactggtttaacgaaaaataataaatcctactcaatcgcaaataataatagttttcattaataattttatcctactgaccaaaataattgctaattcgtaaaatgatttaataaaaattttccattaattaaaattccaatcctattatgtttcaatagaaatcatagagagattntaatttaaaaaaatcatattaataattaataattaaaacttgactccacgnnatggttacgaatagggcttatatnttcangctctaaaacccgctaaaataggcaggctttaagctctaaaaaacccatacatangcattaaaaaagaaaatatgctctaaagtctctggtgaaaatgatctaatttatgcaaaaacacaaattattcgtcaaaaattcaatattaagttataaaagactctaanaaagaccaaacgaattaatataaaaaattaactaatttttagaaaaaatgagca

SEQ ID NO: 28978 - DNA, 1394 bp, Heterodera glycines
  misc_feature (12)..(12): n is a, c, g, or t
  misc_feature (14)..(14): n is a, c, g, or t
  misc_feature (16)..(16): n is a, c, g, or t
  misc_feature (43)..(44): n is a, c, g, or t
  misc_feature (58)..(58): n is a, c, g, or t
  misc_feature (146)..(146): n is a, c, g, or t
  misc_feature (149)..(149): n is a, c, g, or t
  misc_feature (152)..(152): n is a, c, g, or t
  misc_feature (1317)..(1317): n is a, c, g, or t
gcaatgaagtgncnantgcgaagaatgaatgactcaccaactnntcggcatgatcacnaaattcgcgcatctctccgtttaccataagacgacgcacagaataaaggagaagagcgcagtcgtagctgaactgttcttctcgcccncanaanagtcggcattctgatcgagcaaaatcgccagagcgaccaatgcaactcacgacgcgtctctttacactcgctgaaatgaaaccattttcgaacaaagtttgaaaattcgaatttctcttttttcaaaacactcactcattctgtggtccttgtgccaattcacgcgtttctagttggccttctctgccctttttcatttgatattctcccacaaaacgaagttcgtgctggtacaccatgtcaggtgcgcccttcagattaagttcaaatgcattgatgagcacgtcaaccggcgcgatgccacgaactccatggtcgttgttgagtttctctgaaaggaaaaagcatattgtattcaaactcgaggtgtttgcttattgttagacttacgtggcaattggattccattttcatttttggctgccatgagcgatgaaattcagactaaacgaagaaagaaatgaagacaaaaccacacaataatactacgtctaggtaagcaaggaaaatgtaaagcaaaaacgaatgaaaaataaaaggtcagaggacattagaaaataatacaatgcaaatggacagaaggaaagtaacggaaacacacaaagaatggagcgggtgaaaatggaaagcgaaacgcaggaaagtcgaacattcgaattctctttaaaaagcatttaaacccaaagtcgattcacaagaaatggctctattgcactttaggcatccactcaatgaccataccctgtttcttaggccatgttgatcaggggtttgaaattggtcgaaatgttaatgtcatattcatactcatcgaccctgaaaacgcccaagaaatgttttcatgactatgaaattctacaaactgcagaactacatattaccccacattcttggtatccaacgacataaagcttgaagtttatagaaattttacataccggctaaatgcaaaatcaaaaaattcttgaagttactcgagaaagctttttccttgaattctttctactgtaagtgctaattttctgaggatggtcattgatagggacgcgacttttagtgacgaaaaatcccgaaatagttaactaaaataatgacgaaaaagtgccaaaaaagtgacaaaatagtgaaaaaaagtccgaaatagtgacgaatagcgacctaattnttagccaaaaattgagcaaaaaataatttttattcactgattgcagttgcaaatgagctacatttcctttatacatt

SEQ ID NO: 28979 - DNA, 790 bp, Heterodera glycines
tggaagacagtgagtgatcagatcgaccagacggcaggagtagccgaactcgttgtcgtaccaactgaccagcttgacaaagtgcgggttcaacgaaatgcaactgaaccaaatggggggggggggggggaagagggataaatttaatggaattattaacggcaaaactcacgcgccagcgtcgaaaatggacgagtgcgagtctccaagaaagtcctgaaaaacattattgatatatgaagcacaaggcaagggaaaggaacaaaaacatggtattatcaaaaaatgaaatgttggattgaaaacggaacacaaaacccattgtaaaatgagtccgtttgagtattgacgtaccgcaccagccaaggaaatcactcaccgtggacaccacttggtcctccgtgtacgccaaaatgcccttcagcttcccattggccgccttcttcaccgcctctttgatggcgtccaacggggccggcttctccagacgagcggtcaggtcgacgacggacacgttcggagtgggcacacggaacgccatgccggtcagattgccgttcaactccgggatgactttgcccaccgccttggcgttcccggtgctggccggaatgatgttctgcgccgcaccacgtccgtctcgccactgtttgccgctgggcccgtccaccgtcttctgagtggcggtcacctgaacaaaattgatggtttacaaagtgcatttattaatggccatggtatggttttaaatgtaaacccatcattttatataattaaatcacataccaaa

SEQ ID NO: 28980 - DNA, 1416 bp, Heterodera glycines
aagtgatccgccccctttcagcacgtgttggttgggctgtaattttagtttgagacattgtagaaccctgaaattggcaacaatcgctgaaacacatgtgatgccaggtcatatctttctacaatcattgttaaaattctatgatgaaatcatcgaccaaatcataaatttatttgatgcaatatactaaatcagtgcctaaaactactcggggagggcatagcggaaaagaaccttaatcattaaaataaaatttaatttttttaaattttaaatttaactcaatttaccattccaaaaattgtgagcgaatggaagagaagcagctgccgtgccattcaaaaggtttcccatcgaaaattggttcggcgtcacagtgtttggaagtgttaaatttgtcggttccgttgcctaaaatttggaaaaatattaaataattaatttaaataaaaattataaaaattatttcactaaattaccaaatgcgccttttgctgttggatattcgcttttgttccatcaaaagtgaaaaatttttccaatttttggctcggaatttgcttctcgcgttcgccgcgaatgtccagctatttgaaaaaaatattaaaatagacatttgttttcattaattttctttttttcacctttgtgccgtcattttgcttcatcaaaaagttctgtactcccccgtccaattttttacgtttggaattactttttggcattattttcttttgcttatttttttctgaaaaaaataatttattcaatttgaattgtgaataaaaatgtcggaataacaatttttaaaaaatggacattgtgattaaatttgagttagttttaaaaataattaaattgaaaattaagctaaaacggaggacggcgctgtcttttcgaggcgacaggaagtttctagtcgaaacagcttttatgattgtgacaaatttaacacaactgtaaccattttaacgaaaaactcatcaatgctttgttaatatatatgttggaacaaaaaaaaatagcaagtttttaaaaagttattaatcagggctcggattcgtacttggatgccgagtttacgtgcttggatttcggctttcatgcttggaaaattttaactgttcttatttccaagattgtacttggcaatcggtattttgcatacgaaagtgaaaaatgtccatttggtgaaacaagtttaagattcattaattttgctacatatttttgtatcaggtgtgtttttatactaaatctgttaacaaattgcctaaaattttcaaaatttttccggaccccgcccccctcccggttacccgagattttttgaaaaaacgcgccgcaaaaaagcgtacatacagcgaaatgaggaaaatgatcagcgtaaaaaatattggaaaatctatcctggcg

SEQ ID NO: 28981 - DNA, 2519 bp, Heterodera glycines
  misc_feature (71)..(72): n is a, c, g, or t
  misc_feature (101)..(101): n is a, c, g, or t
  misc_feature (127)..(127): n is a, c, g, or t
  misc_feature (702)..(703): n is a, c, g, or t
  misc_feature (711)..(711): n is a, c, g, or t
  misc_feature (2130)..(2130): n is a, c, g, or t
  misc_feature (2150)..(2150): n is a, c, g, or t
aaaacccaaaaaaaagcgagagagaagagagatgaataaaaaaacaaataaacataaatcaaattgacacnnaataattacccgcgaaatgtaatcgtttnaaaattagtcaaattaatgcaattcncagcacgttccacgctccaccgagacagtgtcctcactgtcgaagaatttcgaaccttattaacttctcattatgatgaatgttaatttttttattatatatttttatctgattagatttttttttaactttactcattttattcttaaaacataactcccttataaattcgttcacatttgtattttcttttccgtatccgtttttcaatctcaatttaattcattttttgttatataagaaaattgttaggtcaacaatcagcttttttttgcttttgatatttatatttttaaaattttagttaatcaacaatgtgataaagctattgtttatttatgatatacaaatcttttgaagattgcttatatttatattgattaatttaaataattacattccattatttattaaatatatcagatatagaattatgttatttgtcgtattatacacataaacatttttctagtcatcgtcatttgctttaatatgagatttatacaaatttttaattttgctgatttataaatattaaaaaaaaaatattgaattctacattacaaattcccatnngtctcggncaaagtgacccgaaaaaatttcagaaattgcacccctaaaaaaaaattgattccctattcgtaaattttaaaaaaataattggctatttttggggcctgtttaatccctattttgaaattttcttgccttttcagggcccattcccccaatttttgttccttataatggaattcctaacaactacaacccaaaaattttaaaactttcgggggtttttttttttattcttaaacccctgaaaacaaattttaaaaggggccttcccaatttcaaaaatttaattttaaaaaatttccaaaaatttttaagaaagggtaaaccgccaatttttttccctttttgcccaaaaaaaaaaccccccttttaaaagggccctttttcaataatttttttttttaagaaaatttattttttaaaaaaaaaattcccccaattttaaaacaatttgggcgggttttaaaaaaaaaaaaccccaaattttggtttataattttttcccacaaccccgctcccccggcggaaaaagggggctcccccccccccccccccccaattttctccccaaaaaatttttggggtgtgggggggggggggcggtggggcccccccttcttttttttttttttttacccacaaacccccccctttattttatttttttttttttttttttggggcccccccctttttttttttttataaaaaaaaaaaaaaaaaaaagttggttggggagaaaaaaccccccaccccccaaaaaaaattttgtgttgggggggggggctccttctttccccccccccccccccaaaaaaaaaaaaaaaaaaaaaaaaaaaaaaatgggggggggggggggggggggggggggggggttttttcttctttttggggggggggggaaaaaaaaaagttgtttccaaaaaaaaaaaaaaaaccttttttaaaaaaaaaaaaaaaaaaaaaaaatttttttttttttttttggttaaaaaaaagggggggccccaaaaaaaaaaaaaaaaattttttttttttttttttttttctcttttttttcaaaaaaaaaggattttggggaaaaaaaaaaaaaacgctaaaaaaaacccccccccccaaaaatttttttttcttttttcccaaataaattttttttttttccaaaattaaaatccccccccttaaacaaaccctttttttaaaaaaaggatttttcccccgtttaaaagccccccctggaacctttggccacaatttccctgaaaagggatgggcaatcaattcttttgaaatgaatggaccggcatttgaataagtttaattaatttgatggggcggtggttcagggaacatcccaggcggacgtttttttgttttcaacaaaccattttttttttgcgacgtgtttcaaaatttttggtgancgaaaaaatttttgaaattngagtgacatactttaaatgagcattttacaatatgatggcttgacctgagtatgtaaagtccacgggggctgtagcgcagctgtgtgaaatacataatgctcaacaccaccgtatggccgctgaaaatgcaaatcataaatttctgtatttggatcccatggcctaattagaattttttttttttatttaaaaatgaaatcgaaaattgcaggggtttcgaaaaattttttgaggggggagatgggtaaatgaaaatgcatttaattttcatgaaatgttttgtttgcgtacctgaacatcagatcgccacacaaaatttcaggctgtccggaggtctaaaatatgtctttttttcataattttcatga

SEQ ID NO: 28982 - DNA, 1382 bp, Heterodera glycines
tcagaagatctaaacagcgtaaaatgttttgaaacaacttcccatatttccagtgtttgtttgcctgtgaacacttgctccgttgtggaaattgcattttgcagtgccgaattcgggtcgctttcgcaaaaatcctccaaagtcgcggaaagattttgtagtaaagtttccttcagcggcgccaatgcctcgcccatgtcaaagtgtgcgtcgttttgcgcaaaccccgcctttatccttgcaacgagcgaacaccgttcgtatatccatccgcttttctcgcgaaacctttgttagttcgtcatttgaaaagaatttcgttcaattgtcccaccacattcggaatccgctgggccatcccctctcgacaattcgtaatttgcgagcaaaatgctcaaaactgagcagagaattgagcaacccgtcctcggagcgaaaaagatcgccctcaactttgcattgaaattcttcctcattcagcgaagtgattttgtcatgcaaaatttgtttgatttggccaatgggaatcaggcgaacgcaagggtaagcgaagagaggggaggcggtcgaattgaccaagtcgaagtcgtcgcagtcggaggacagcacggatctttgagttgagcaacaatattcttatcatttttctcaaaattattttccgtcacatagaaagtagtcataaaagcaaacggacttgtttaatcatatattttttttgcgcgagtttgtatagttatctttaataaaagcccaccgacaaatgcctttagaatcatcggcagaaatttcgctgctgaaacggttgaccagaaattgctgatcgtcgggttgaacccttgacgaaatcagagcggcgacggggtgaatgagagggcaattgttcgagtcgagaaaagtgccatttcgaaaccacagcacagtgaagtacagattttccgcgaggaaaggtgaatccaccttaaaagcagcaaaattgcacaaatgattgctaattagaatactaatagtgccaatttatgactaatgaataatggtcgaccgaccaataagcatcctccgatgaccgcttctttcccctcagaaattgcatttccatcagacacttcttcttcgttcgaaggttcttgttcatttttgaccaattgttgctcatctttgacaacgaattggtcgtccaatttgtccaacaattgggccaattcctccctaacacagaggcaattctttcggaaattttccaacaatccttcggtggtgaaaaattgacgaaaatgagtggacgactcgttggcactgctgacacagccactgttataaaaacaattgttagttgaatataagcctgactgaaaactggaattaatcagttattcaccctg

SEQ ID NO: 28983 - DNA, 913 bp, Heterodera glycines
cccccccccatccttccttcccacaacacaaattccttcccgtgggtgtcgttctgtcgtccatcccatgtcgtgtccagtcagtccaccacactccctctgcttccctcccccccctttatccctcctatcgatcgcttcgctgagatttatttagcttattcctcttttctcttccttagcacgtcaatttgcatcagtcgattgggtgggcatagtttttggagggattaattgggaacgcaaatgaaaatgaatggcaaaacgaaagtgaatggcacttgacggcggaagggcggaaggactatcaagcatttgaatctttcccgattcttgctgttttttcaaaaatcgtcaacgggatgaaattataaaaaattcctgaactgggaacagactgaaaacccgcaaaaagatatgcgagacagcaatgcgatatccgcggaaattcgacacaaaattggaaagttatacacgacatcgcatccaaaattaaataattccaaattttaaataaaattaaataaaaattgtttttaaaattatattttgccaattaagtaccgataataatgacatgaagtttgggaatctgtttgacatttgtctattcaactcaagttatgggacagaaaatgtgcagttggtgggtccagcaggggcctttcagaattacgaacgacaaaagataaacgacaaacgccaaatctgtcgtaatatacatcgtttgtcgttatctccaatcacaattaagaaaatttgtcgtttatcgtttgtctcccaaatatttggcgtttgactaaagtattttgatcaagaattttaatttaatattaaaagcatgtttctaggtgtaaatgagttcgttgatcatgaatccgatctcagattttcatttctatacttttatcta

SEQ ID NO: 28984 - DNA, 1107 bp, Heterodera glycines
  misc_feature (1075)..(1075): n is a, c, g, or t
attaatagggatgggaattttacgtaagaatcattacaaaatatgtaaataaaatatgtgtaaaaaatactaaaatatgtatgaaatatgtacaaaaactcccaaaaatgtactaaaatatgtaaataaatttttttaaaaagttattttttcgaaaaaaaaatcttcgtaaaatgtgaaataagatcaaaatggcataaaaatgtcttaagtaggcttagaatcaccttttaatattttaaaattaatttttgatatctcatttttgaaaaacaacgatttttagagatacattaaaaaaaaattgtttttaaatttttcacaagaaattttataaattttcaaaaattcttcctactttttagagcatggagaatccaggaaaaaatatgcctttgcataaaattcccatccctagtcattacaattaaaaaagaaaaagctaaatataaccgattgacaatgcatttggccatgagaggaccaaagtcaaaaagctgaccttaaaagaaaattaaattttaaataattatgcaccaatggtaattttttttttgtaccaagttcacaatttgtgccatttgaaatgtgccaaatttatcacaaaatttttgattcaaaacatcatcacaattgaaaaccacaagaatatgttaagaccagggctgccagattaaaattttcaaaagcctcatttggcatgcaaaaaaacctcattttgggtcaaaaaacctcatttttacgaaatttaagcattttgtgaaaagctgagcacgaaaaatcgaagctgattttttgcggcgctttttccaaagaacttttggggcgcaaggggggccggcggtgccgataggcgccgctggaaaaaattttgtaatttttaatgcgatttgttaacagatttgtccttaaaaatgaccaaattttgcgactttgagaaaatttttaagaaaataaaggatttttatggtttccggcggtgccgataggcggcgtcgggggaaaaattaagaatttttaccatatttttagcatattttcattaaaaaattctttattttgcagtttttctcanaaaccacaaaaagggctcaaatttctcaaaaa

SEQ ID NO: 28985 - DNA, 1909 bp, Heterodera glycines
  misc_feature (65)..(65): n is a, c, g, or t
atccatattaccgaagaggagagtttaaccaggacatttactatgaaatccgtaattaaagaggncttcttcaattaacataaatgagtaactcgcaattgcggtgtacaaaaatgtaataaacatttgtgtaatcacatctaacccaggagtaaatgacacccgaaaaatttgaccagaaaaattatgcaatttgatgtactagtaacagatttcgttctgcagttgacatttttaaaactttcttcggtgccgtccgtttttgccggcaccgccggactcctttttttgaacatttcgttcatcaattaattgattgttgtcgctcttttcatttcagcgacaacagcggggtgttcaaaaattgtcgtcgcatttgtgacgagttggaggtgccaagccacgggagcaacgactacctgatcatgcgcgaggtgtgccacgtggtctcattacgttcagcagccattgttgccgcaggtatcagagagtcgaatttttccaaaaatttgatgaattactaggtacgttttttcaaaaatttatccaaaaatcgctgaaaatttttcttttttttttgaaaattttcataatttaaatttttcggggggggggggggaggaacgccgagggaggaggagtggaaagtgcacacttcatgtcccctatttgtttaccatttccagcaatcaccgccctcctgcgccatgtcggcaaacggaaggtgaaggtgggcgtcggcggtgcactcatccaattccatcccacataccacgagctgttggagtcgcagctgcactcgttggccccgctcaacattgaggcacaaaaattttcattttttaaaacaaattgccaattttctgaaaatttgcaccgtttacagtgggaattggtgcccgccgacgagggcagcgtcaaaggtgccgcactgattgcagcagttgcggaaaagttgaaactttgacaccatatggcgtcacgtcacgtgttggaccgagcgtgcggatgggagtgatggtgacgctaattaggaggcatttatttggctgatggctggctggcacactcactcttcgattatggcacattttggtgccaaaattttcacacgaaaatcataccttttacattttgcatttgtttgtgtctgtttttggtggtgcataaccatgcttccttcatctgctgcttctgttgtttttcaattttctgccctcctccattcttttttgttgttgtccaattttttggtccattttttatttttttaaatcaatttatatgattcctccaaattttgttttgcgcttggcgatgcactgccttttttcttctccttttgtttctctgatcagaccgttgatctgcggcatcaaattgtacacgacgaaaatggtcatttgtttggtccatttttgcgagtggcctcctccacgttgtgttgttaactcctcctcattctccgcctcctcccaccatatatttaattataattatcacaatcgtttttttttatcacactcttaacatgttttttgtggttgaccagcaaataaatttttaatctgcgtaactccttttttaacatccattttttcggtactccttaagaattgcggtaccggcgtatccttaacttttttctgagctaatcactcttacatatgagcacttcagagaattcgagcaaaaaattgaaaatattaaatgtaaatatttgtgatcaaggaactgaaaaggctcattgtcaggagcaaaagagtacaacttaattaaagctctgaaaattaatgaatttccaaattctgagctcatttgtcagaatgaccccctaattagcctttttttgtcccagaaaagtgatttatttcgccgagatcgcaattctaaagggattacggattgc

SEQ ID NO: 28986 - DNA, 1574 bp, Heterodera glycines
attgttctttctcaaccgtcagccattctttcctcacagcctaatgacgatcggctgctgctggctgagattcttttcatccgatcaatcatttttcaagcacttctttttgctttattaataatgatgatgatgacgacgacgatcactctcgtcatcacatcgaccgggcgcggttgagggggggggggtaatttggtgaccttgctcccggcggcacaccgtcgctattgccgtcatccaacgcctactaattaaccgtccggtccagtttttgtcgacaactttattttatttttttgcaattttggggccggtcggacggaactcgacaaaaccatccccacccccaccggcctcattaatttttgatcggagtttgccatgcatgagatgatcatcagcatcatagtcataagatcaccaccaccaccaccaccatcaccaccacttccaccgagtaaacacaccgtcctcattaggccgccaattagcggacgtaatgaatgatgatgcgatttgctgttgatgatgggtgaaggtcgagaagattctttgaaattactctctccgtgttgaacttggtccctataaaaagtgaacagggttcccccaaggggatataatcaaattacattggaatgctgaattaatttttaatgctcaagaatgcacattttgccgaatttggcagaaaaaatgcaaagacataaaaatatttattttttaaattaaatttttatttgaatttaaatagaggaccttttatataaacaattttaataaaaatattttacaattttatagcgtgaatttgtctactcaaaatgtcgccaaacacactttgtagcattgtttgcctgcttttggtctgcaacttcatctgggctgatgatgaacacagaagcttcgcagaggaattagtgaggtatcaatttaccatccaatttaattttttttaatttttaaataattaaataaatttacctttttaatttataatgaaatttttaataattgattgcctttaattaatagacgcctgcgacgttcccatggttactcagttggttatggaggcaattgtgcttggtaaatttttgaaaatttcttttttttttttttgcatttttttaccacaaaaataatttggaaaaatttacgactaaatttaaaatttattattaattttaaatttttaaaatcaagttcttcctccgcctacccggcgaccgcttcacacacttcatacacggcacctaaacaaaccagttactcatcttactcttgctccggttccggctgtggtcatcaagtaagcaattttgaaattctaattttaaaattttaaaaaatttaggcctaccagccaccccaaaaaaacagctaccattggtgcactgggactgccctgcacaaagcgcaggtaaaacatgatgctttaagactaaatacataatattttcatcataaattttcatatataccggtataaatttccatttaatttatattttttaattttctttaaataattcattttttaaaattttcatttattaatttgacttttt

SEQ ID NO: 28987 - DNA, 1504 bp, Heterodera glycines
gtctaattttttttacacataatgatgatgaatgccttttggttttcgaggtcgggatcccggccccgaacttgaacttaaagtcgaatttagaattctcgtttttttgttcgaatttgggttcgggattcggaatagccccaaataattgtcatattcgtgatcaacgacctcgaaaacaatcgggtacttagattcaggacttttaagccgaaaaaaaaatttaaaaaaaaatagaccaaaaaagtgcaaaaaaattttcaaaatgtaccttcttttaattattgccaaaaattcaaattttttgactctgaaatttcactttctaaacaaaaaacatcaatttcatccctttgttttacgaatttactattttttaattttaggtcggctcaacgtgcacaactttatggaccacaaggatggtaacaaaatttgattttcatatcgaattggaattgcacttcgcttcggtttaggataaggccgagagttctgaacacaaacaaagcatttttggccaggactctcaaatcagtggaaattcatcggagagaccaacagacggagaaagaagcgaagagagcgcggaaagtgagggaacagacgggggaatgacagagacgaacaaaaacaacagcaaagataggatcgggagaaagaacatatcatcgcctttttgtatatttttggtaaaaaagaacttcagaacgtacactgaaatctgtattttgatattgtgtcgtattaaaacgaattaatttttaaacaacagagatgacggatattagagaattataaaaaaaatagaatcctagaaaaaatttatcatcaaaccaagataaaaaaattcattggaaaaaggaggacagcaatggaaaataattttattttgtctgtacaatatacattttgctatacgttttgtctgaagactgttcattgagtgcaaaaatggtcaatttgtttattgggtcttctattattcgttctgctgattgtgagacgaccatcggtcacagaatgaccctttcgttgttgttgttctctccgctgctggccacggaagatcttttcgactgatcaaagcctaatagattagatttggtagattaattagggacttatggaggaggatcaacaaggataattgtaagttaaccatccccttcaactgaccggacggtggcaattcgtctttcgaggagtgaattgcccgcccgtagccctgcgttcgacttttgatttttgagttctgcacaagggacaacatctttgaaattgcttggggactctccactcctgaatttggaggagttttaaattatttgatttgagtgcagatttctcaccaaattttgggtaatttgatcatgcctcgatgcctttcgtgggaatgcactatatttgattgggtggactgtgaagaaagactggtccggcgaaagaagagggcaaccgacggcggggaaagaacattttgagttgctggtgatggaattgc

SEQ ID NO: 28988 - DNA, 1610 bp, Heterodera glycines
  misc_feature (43)..(43): n is a, c, g, or t
  misc_feature (114)..(114): n is a, c, g, or t
  misc_feature (162)..(162): n is a, c, g, or t
  misc_feature (1383)..(1383): n is a, c, g, or t
  misc_feature (1486)..(1486): n is a, c, g, or t
  misc_feature (1531)..(1531): n is a, c, g, or t
cgttactttgtccgcgtccatttcattgtgcgcctttttcacngcttttgctgattcgcctatcactccaagcacatcagagttcatggacgcgttctccagcgcggtctttgngtggtggatggtgttcagcactcctgcaatgtgttccaattgctttcnatagcccttttttcgcctcagtgcctgcaacgcgacccttttatttgccgcttgcgcacgtgccgtggcaatttcctaaaaggaggaatttaacccaggggaattcaatctcgaacaattactgtttcgattttcttttccagaaattcctgcttcttttgaaacatgtcttccctctcttgcagcttctgcaatacttcttgtgtcgatggagctgcctcttgtttttttccaccaaaaattttgccgaatagactcattttttgtctttttgtcggaagaaattaaaatgctgcaatttaaatgatgaaatatcttttaaaaacaattaggtaggtaataaaaaatcaaaaacaaagctttaggcatttcaaaattatatgcagtgaatactgacaccaaagcggaatgattcacgttatcattacattggttagcagttagcctaaatgggttcagcaatttttattctttttttactttatggcgttttatattcctataaaaagaatgagaatttggagtgatcgctttttatgtttgccgcgtccgcggcgtttgaaccaataacagttgtatttttgtgatgacagctccaacttcggcagttgtgcgtgagcaacatttggcccttcggggtctgtcaatgtatattacaaaatgttaccgaaatatttttgttttaagtgatgcgactgtccaatcccaaatttcatgagaccatttgcttgggccgcgatccggccgatcctttctcaatggctatttgtgattcgattggcaaattgagtggtcaaagttctgtcgatttgccgcttgattcctacttaattgcaccacatgcgatgagatgagtttattaattaaatttatttttaaatgctttcaagttttagtgatgtttatctcggggaaatgttcactctttacatttcaatcatcaacattagctctgtcatttgcaaagaaatagccattaaggtcagcgaaactccaaagtaggaaaactcgttttgttattttacaaccaaattcagcttaggtcgacattcaaactcagaatcagcgcgtctctctcggagaactggccttcgccggaattgcccttgagccgaaccaacaaattggccaaatttttaaacatgacatccgggaactaggccaacacatgtgagttttgttttgttttttactagatcgttcataacctaaatatcttgnttttgtttttttaatttcaaaaaaaaaatcaatgaaccgttcgaaagctctgatgattcgctataaaattaaaaaagtgatattccgttcttaaccagtctanaaaataatgaattttaatcgaatgataccatacgtaagcaactanaaattattgttttgaatttgtaacgtatatatataaatgagtcattttatgataatatttatatctaaacataaatcta

SEQ ID NO: 28989 - DNA, 946 bp, Heterodera glycines
gccataactcgcttccattcccaactaaactgaacaaatctccttatctaaaaaaaagattttgaaaaggggaatctttttctaagagaaaactaagcaatttgattttttagaaaaaagttgtgggagtttcaaatctttattacgttataactcaagtcttaaactgctgatttcaccaaaaatgctaaaatttattctttttttatttattctatatgtccaaggtgatcttgtagcctataaaccaaaattgttagaatttgagagtttcatgttttttatgtgttagagacatgaaaatagtacgccaaaacgagagaaaaagaaatgcaaaattttcatcacactataacttaagcaccgagcgtaaaaaattaaaaacctagcgttaaaaatgttcaaaatatttttctctatctatatgctaaatttggtgttaattgtatgcataggaaaaaagttatatggagagaagtaaatgttgttttttacataattaaaatgaagagatagtacgccaaagtaagagaaattacaaagaaaaagagaaacgacgagttagtactaggcttttctctgcacagtggggcgtacccatagtgcaggctaatagagaatctcaagagctaccaaatgataacaaaaatttaatttggttgataatgaaaaaagttgttagcaacggcgccgaactgggcggttcccgtcgatggtaccccccctttttttgaaaaaatttttttttgttttaaaaagacatgaaagcatgtttcctaggttttcggggtcgctgatcacgaatccggcacctgactaatttcgaaccccccgacctgaattcgaataaaaatttagaaaattcaaatttttcgaatttcagatttttgatccaaaatggtttaaataattttttattgaagtattaatgagttcctgtttgatt

SEQ ID NO: 28990 - DNA, 1207 bp, Heterodera glycines
  misc_feature (100)..(100): n is a, c, g, or t
  misc_feature (108)..(108): n is a, c, g, or t
  misc_feature (171)..(171): n is a, c, g, or t
  misc_feature (204)..(204): n is a, c, g, or t
  misc_feature (226)..(226): n is a, c, g, or t
  misc_feature (254)..(254): n is a, c, g, or t
  misc_feature (256)..(256): n is a, c, g, or t
  misc_feature (263)..(263): n is a, c, g, or t
gattgactgccaaaatgccataagctaataatgcctcccacaacaggaaataaatgaagggagacatttttcgaaaacttaaatttatatcgttttgggnatttatgnatttattatttaatttttaaggttttttttacgtttaataatatgtttaagtatgaatatgtnaatataatattgattatgtaatatagaatatgnattatgaaaaaatttgtttggnttaaatgataatattatttaggaattgngnatttagnatttatagaagtatcgagtcgagaaatgacggcttatggtctcgggattatgtcaaatatacctgggttcacaaatcagccttttagcgataaaaaattttgagtaattcaaattaaatcacataaattcaaacatcatacggaaatagcataacaattaattaaaataaaaaaaacaatatatattaaaatgcatatacattataacataatcaatatcaatacatttaattgctcttgaatgatggtgttttgccataaaacggattttcatcccatcctaattttgagtagggattttcttcaccatttccgggatgttcatgcagaaaaaaattgttatttttgtggtcatcaaccaaattcctgggcaattttgtgttcttaacacaatgcatccgcaattgcatgtccatcttcatttttaactgccaatgtcggaatttttcgcccaaatttggcaattttggcattatgccacatttttgagtagtatagtcggctgatgatgagtgtgatctgtccagtccgtccgcacggctatcattgattcgatcagaaaccacagtaattgctctaccgtaatgcatttgaccattttcgttatgtgaaaaatgggcagaaacagaaccatcattttggcttttctcgataggaacaatttcattgtttgtttcattgaattggcggcgattgaaatgatccgttgcattgccttcgttgctatgatcatttgcaacttcgacaatttctgtcccaatttgatagcttcttgggctttcgtatgaaaagtgatcattttgatcactaagcgaagactgtgataattggtcaaattctcgttgcaaataaatgctgccaagagtactttttgccttttgtttgtgcctttgcctttaaattaatataaaaaagtaaaaaagattttattcgggttttaaagt

SEQ ID NO: 28991 - DNA, 945 bp, Heterodera glycines
taagagaggatgggagctgggagagagagggggggcttcgagagatagagagacaggaaaagaaagaaagagagagagagagagagaaaacgagagagggtgggagctgggagagagaaaacaaaataaagagaggaagagagagcggaagagagagagaaaataagagaggatgggagctgggagagagaggggggggggggggagagagagagagacaggaaaagaaagaaagagagagagaaatagagaaagagaaaacgagagagggtgggagctgggagagagaaaacaaaataaagagaggaagagagagaggaagggagagagaaaataagagaggatgggagctgggagagagagagagagagagagacaggaaaataaagagaggaccagagacataaaataatagaggctggaagctgtgaactttggttctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaatttttgttgaaatatttgtcgtgctctgaagggcggggggg

SEQ ID NO: 28992 - DNA, 1823 bp, Heterodera glycines
atatatatcagtttcaaaaataacttcaagagatagacaattaaaaaagttctaacaaaattcgagaatctgctttttcagctgtgaatatcgcttcaatatatttccaaaattaagaatttataaaataaattttaaattaaataacgaaaatggaaaagatattctctaataaaaaggaaaagattaattgtaatgaatgttgcttattaaggcaatattcaccgacacaaaaaatttttacacaccgaagtttatttatatatttactaaatttctaaatattaaaagaaagtgtttaaaggctattaattaaaatttcaattaatacaaaaagaattttaaaaattaaataaaagctaaatataaaatgaaaaaaacagaaacctaattgaaaaagaatgaaaaattctaaaaattaataaaaacaaattgaaaataaaagtgcccagtgagcgaatgacacgaatgacacaatagctgtagtaaagaacaagatacacgagagaatattattaaaataacattacatttaatcaaaatataaatttaaaataccaaatttaaactaataattattattattatctaatttaaaagtcagagcttagaagataaataataacaagaagctcgttttgatgggacaaattttggcaaatgtttatataaattcttaacaaaaattttgaaaatctgtttaaaagtcggaagatttactagaagcttttgaattttacttgatatttttgtacatttttgaaaagtaaaatcctattaccactgaaattaaaggtcaaagaatgtttgagagcaatataataggaaaatattaagcaacaataataatacaaaatttaattattttcccactatttaaattaaattattggcgttttgcccaaaatttattaacaaaaatgcattaatgataaaaatttaataaaaaaattcataataatttggtttatgacacgaagaaaattacatttaattaatgtaacaaaatctcgaatgacgattttcaaatttttaaacattcatatatttataacaatatttaaaagaataagaagctaaatcagaaaatgcaaaacgcactatttaataaattataaaaaatatattttaattcgaaaatacaaaaatgagaaaaaaaacaccatttaatgaagctgacacaatcaattttcctatataataaagttgagtgtgtgtatgtattagagatcggcctgtacctggatccaggcctgtatttttcctggatccaggtacaggtacaggcaaatttttggcaacctgtatttttcctgtactcatttcctcgaaattgccaacataaaaaaaattttttaaatacatttttattatgtaatttattttccaacattaaaataatgtaaagctgcataaaattaaatataaaataagctgaatgagcaacatattttatatttaatatttttactacaatttcttatgaacaaatttccccattttaaaatgaaaaaaaaattcaaagattttatgtataacggtgctttgtcatttcataaattccgtcaaggaaataataaaatgaaaacgatatcaccaagttactttaaaatatacattatatatatgttgtttcctagcagaattttaagtccaaaaatttaataatcaaaaaatccgaaaattgaaataaaaaaaagccaagccgacgacctttttttgccttcgaaaacgctttttttgtggcgaattttttaaaaattttgggggttggacaggggcgtccggcggtgccgataggcgccgccggaaattttttaaaa

SEQ ID NO: 28993 - DNA, 1077 bp, Heterodera glycines
  misc_feature (874)..(874): n is a, c, g, or t
  misc_feature (924)..(924): n is a, c, g, or t
  misc_feature (1010)..(1010): n is a, c, g, or t
gttatattttgggggtttttattataaaacgccattttttttcttgaatacatttttttgaaatttaactttaaaattttaaacggacaaatcttttgaaaattttaaattcagaaacttcatgatatatcaattattaaatacttatataattaatttaataattaaatattattttcaaagttaattacctatattttaaaatgaagtcatttttaaaatgactatttttcggattttttaaaatgtttcttttttggaatttttttttaatttctaaaacaaaattttttattactttttttatatttcgtccagctaccgctcaactcataatcatcatccctttttccgttcgggaatttatgtttttgttttaatcccgacagtgcggggattaaatgtggactgaaattcgggaggcattggatataaaattggatggattttctgtgctcctacccatttttaaatttgtccaaaagctctctctccccaaataattttatgagttgaatgagtccatttatcgtattttaatccaaaaattaaaaaaaaaggatcaaatataaaaaaacttttgaatttgctttttttggcattacgttcttttattttgttttaaaattaaatgcttttgtaatttctgatcattatcatcctgaagctgctctttaattatatttggcttttctcaattattaatgccttatagtttgatctaataaatttatattttttaaaatttttcgaattacagtacccaaaattcgaaaattaatcacataaattgattttccaatatttccattcattgctgtaatcgacctaaattttaactttcctaatctgattacttcatacttattttttncaatttttatgtccattttcccaacaattttttttgaacgataaaaattncaatcacttttacacacaaaaaattcattttcccattaaaaataccgtactcaaatacaaccactaccgttcactttttcccattntttctcgataacacgacagtagatacaaaatacacaattcattcttacacactgtcctcataatgcc

SEQ ID NO: 28994 - DNA, 913 bp, Heterodera glycines
  misc_feature (5)..(6): n is a, c, g, or t
  misc_feature (605)..(605): n is a, c, g, or t
  misc_feature (613)..(613): n is a, c, g, or t
  misc_feature (621)..(621): n is a, c, g, or t
  misc_feature (662)..(662): n is a, c, g, or t
  misc_feature (837)..(837): n is a, c, g, or t
ataannttttttgaattaaccaatggaagaataacaattacttcctctgaattactaatatttactttggctttatcatttactataattcatttaatttaatgagagaaaatgagaaaatttcaatggtaattgaggtggaggtgccgcgaatgaaatcacttttccattgctggggattaggggaagaaaggaagtgggggagtgaattagcgaacaatcgccaggggggacggtgggcgaagaatgaaattaaatgccgtttagggtggcattatgtgggattatgccgagaatgggcggataaaacgagtgacatcagcggaacagtgaacgatcacaattaaacaaacgcccacagatgaagaaaagttaattttagtagaaatggaaaagtaattaaaaaataaaaattaaaaaaacgatggaaaaaaagggggcggaaattggaaacatttatatgtatgtacaataatgtgtttatagggatgggctaaataatgaagacgaagacgaggaaagagtgaaacgaatgcattgggaaaaggcaaaagagaggggcaaaaggggggaattcagtggagagacagacagtcacaacagcnaatgccanattatganaggaaagggcaagcgcaaacagacaaatgccaatcgcatgngcatttcggcagaatgatcggctgatttgtggagaagtacaaagggagaagcttttaaagaagcggagggggagggcaaaatgtgtgggaagagaaggggcgggcggaaagaaagttgatccgtttttgtgacaaaacaatcgcagaaagcggcggtgatcggaggaggaaaggncgtccgggcgggcggaaggatgacatgcgaaggttgggtagtgggggggtttttgggcccctcccccccccccccc

SEQ ID NO: 28995 - DNA, 1120 bp, Heterodera glycines
  misc_feature (6)..(6): n is a, c, g, or t
ataatnagtgcgaaaaatgaaaaatttcagaattttagccccccataaaaatccatatgaaaaactttttttttaaaattactaaattgaagcgaaaaatcggtaaaatcggcgccaaaaaggcaaccgattcactcttaaccagggctcggatctgttctgataaaacaaaaatgttcttattttggggtagcgaccaaattttgttctgatttcttaaaattccttaaaaattggtaattttatggcgtaatgtcactcagatttccaaaaaatttttcatggctgtgcctagcggcaccgccggaccctaaaaatcctttggtttcttataaattggctcaaaatcacaaaatttggacaatttttggacaaaatctgtttgttaacaaaatatactcaaattttcaaaatttttcccggcggagcctgtcggcaccgccgaccttccgtcccgcttgttcccaaaaggtctttgaaaaaatgcgccgcaaaaaaaattcgtaaaaatctgattttttgagccgttgtatttattgaatattaaccatttttcattgcatataataaaaattttaaatatccttggatttcattaattttccccattatgttcttgaaaatcggcatactcgtaattggaagccgcccttggacgatacgggccctggattaaattgttacacaagcaattttaagctattttgcaaaatgttctgatttttgaccccaaaatctgatttttcgggctcgatgttctgactttgaaaattttttgatccgagccctgctcttaacacactaaaaaacagaagcccttgttttatagtctaatttgaattaattccgtccttcaaaataaggactctaaaaagtgcagaaaatcgaatttctgttcaaagaaaaacaaaaaaaaagtgcctaaatttcatttaaattaaaaaaacagtcaatcgggacagactcatgacaaaggtattattatagagaccgactttttaggcacacgcctttttttcttcgcactagttccgatgagtattaagcatttgacagaactgctagataccaaccaaccccctttcgacaaaataaatataatgaaactttttgatcaatg

SEQ ID NO: 28996 - DNA, 1540 bp, Heterodera glycines
  misc_feature (10)..(10): n is a, c, g, or t
cccccccccnccccccgctatttcccaccagcagatcagccctccccccccgaaaatctgtttttaaaggcttgaaaattttgaaaaactaaataattcatgaaaattgtattttttgaaaaaactagaaaaaattaaaaaaaaaattcttgaaatttcttataaaaaaagttttatgtttttcttgaaaattttctaagttaaaaaaaaacccttttataaattgaagaaaagacctctagtcaaaaactttagaaccaagaacgcttaatatttgcctaagaaactaataattaattatagtaccaatttaatttaatgtgttaattgctacactcactctgttgttccttttgaatgacgcttgatttggccactaacgtctgcacattcgtggacaatgaatcaattctttcctgcgaaaggttcgaatttctgttttttaaaggaaaatagagccaaactcgagaactttgaatgatccctaatttacttttttgattccttctgaggaaagttatgagacttaagcacggcatttggaaaaaatgttcttgaaaaaaattcaggtcgagtaaaaacacaggttgtaatgaaatgaaaatggccaattactaaaaggcttttgcaacggtttataaacgtcccatcgcgctaaaaaaaagtgggacggtatgggattgtacacatatgcaaagaatccataaactgaaatgcaaattctcgaagtttcattttgccccgatttgagtgtcattttgtttacctgaaaattgtccatcagtgagcaaactgagccggtcaatgtggcacttttttccaaaatgccctggaaactggaaagccattcttcgtcctgaacatgtttgttcatttatttttttaatttatgcattttcttcactttgcttaacagttgattcaactcttcaacagatgcaccaccaccaccaccaatttttgcagctgatgacgtcattcccttaaatttttaaaaaacaatttcgtaatttttgttcgagtccaagccgaatcggatcgaatttgaggatttttaaatattttgtgataaactaatatttttccaaaaatacttttttattggtttcaaaagcccttcaaaaattaatgggaaattaattttcgataatcttaaaatttcaaataagcccctaagccaaacactcgaaaatctaagcattttttaggtgttactcaaattgagaattaatatttaaattaagtgtaaataatattttaaattccattattattccacacctttttgttgggtcgtcgatcgatgtttgtgtgtgcttattgctttttgtataatgcactttaaaatggaatttcaatcaataaagggtcagtggcaaaaaataaaaaatattttattggccatttaaacaattccaaattgaaaaatgtccatttttataaatcaatatttattatatttgacagcattagacaaatagaattataatttaatactagaatttcttttaaatttatttttttggaaaaaattgactct

SEQ ID NO: 28997 - DNA, 1145 bp, Heterodera glycines
aaaaaattatctcaacaatcagtcgtgaaacagttcaataattcggaagcagtgccatattgggaaaagatgcacaagtagagtaggctcgaaataaaggcaactgccgaagattaacaaaaattcaaatttacgggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttg

SEQ ID NO: 28998 - DNA, 1130 bp, Heterodera glycines
ttccgccgttattaggtgttattatatcactattgtaatttatgcggtgttgatattagttttttaatgtaattattgtaatttttgtgttgaaacagcaaaactgtccggtgccgatcggcctaggccgagggtacgcgagcagtggcgctgttccaatgttgttaattctaatttttgctctattgttaccatattttgtccattttatgtgctataataatctaataatatgtatggctttatgaatccaataagaattaaattaatggacatacgcgagagggggtgggtgggagaaggacttaaacgcagcggttagtaccggaatcgcaaataagtaagggaagaagtctttgtgtgccacctgcaaataaacctaaggtttcttaattatatctacaacaatttttttttgctactccattgttttgctaggcttatatccaccatgcgtttttaaatgggatgcattgtttttgttgtcaaagtcccaaaaatccatgaaaattgttgttgttaatatcaaagtggcaaagttcgagttaaaattaaaaatcaatgaagggtagggacagatggggattttaattgtatttttgaggccggggttgaatactataaaaataaaattattttttaaattatatagaaaatttctaggctggttttaaggttcgctgattacggatctgacatccatttagaccaaatgctaatcccgacccgtattcaaacaaaaacttgaaaattctaaattttaaaaaatcattttatggtgcgaaaatagctcgaatacggattcggggttcgaattggatgttagattcgtaatcagcgacccctaaaacccactagaaacttttttatatgatttaaaaaataatttattttttatggtctgtaaaatgcataggtaccaaaattcaagtttccaaaccaccggcccggaatttaaattttcgttttttgtcagataattggcagcttaaccaaagtgcataaaagtaccattttaaatgaagagatagaaaaattttgactagcatttgtgcaagttttagtcaatcaaacataaagccttaattatgaagagaatattgaaaaataaccacagctttttttaagaa

SEQ ID NO: 28999 - DNA, 832 bp, Heterodera glycines
caaccaacacctatcatcgacctgtcgtctcaacaacgccccctcgccccgaaatggaagagcattgggaaagtggaggagctagaggaggggggggggggggggaggtggaacagaggggagagggaaacagtgatgatgaccaacacaaaatatgcgatggttgaaggcaaacactggacgaggagggaagagatggaatggaatggttttataaggggggaggggcaggacagtgtttaatgtggacatcggaggaggtggatcatcaccaatccgatcagatcagcagcattggtctgacaatgagatggaatggaaatgttcggaaggggggggggggggaattggacgcttttggcgagagatccaatcgaaaaggtgggaataatgtgaagaaccaaccgcacacaataactaatgatgatgaatggatgaattgattctggaaagagttctcccttctcccccctttcattttcattctcgcctagatgctccgccgatgggaaaaaaggggactctaaatgcgtaaatatcatgactgaccattttaatgcattatttcatcaattcatccatcattcaatgcttacattgacacaaatagaaacgcctcaaaaaacataaaccattttgattgatttgatgagaaatgtgaaatagacagaaggacgatgaccatggaagtcggaatccgctaaggagtgtgtaacaactcacctgccgaatcaactagccctgaaaatggatggcgctggagcgggccacctatactccaccgtcatttggcttgtacacgtgcttgtcgcgtagtctggccatgacgtgt

SEQ ID NO: 29000 - DNA, 966 bp, Heterodera glycines
  misc_feature (65)..(65): n is a, c, g, or t
  misc_feature (67)..(67): n is a, c, g, or t
  misc_feature (827)..(827): n is a, c, g, or t
ccccccccggctagaccattcattcgcccattgttcaccttcttaggcctctaagaatgggaggncnattgacccatcccctcgagaattgtgcaacgaaagtgacggtcaattggagggagagagagagagagagagagatgctcttggcaatgaatgggaagacaaataaacggtggcaaaaaacaattggcaaattgtggagaagggcaattcgaaatcaaaagcaatgccaaactgacagaaatatttaaatgcgaaatttatgaccaaattttgcgtctttgagctagtgaaggatttcgaatggatatttaattaaaaattggtctaattatcataaatatgacattttaactttgtgagcccaatccattcattccctttcttcgccatttgttctttctcatcggctgactgttctgtttttatttggcaattccctaattattgttgctctgttagccgttaattgcacttttattccatccccctcccttcccccaaggcattctttgattgcctttgccccattttcggcaatttcttcgcgcaaagtcacaaaagtgctgagcgaagtatccctttgcccttatcggatcttttgtagaaaagccgcctaattgacaagcaaaaggaagcgacaccgaaagacggggggaggaaaaaggggaagggggggggggaagacccccggggggaaaatggagggacggcattggcaaagggacggagtaaacaaattattcttttttttggggggaagagaatacgagacaagtgaacactattcacttcatggatttgctcttccttccgcattttanaatactttttttttgtcaattttaaattttgtcgtttttccctccgtcggcggactgagagaaaacgaattaatttattcattcgccaccaacggaaggaagtcgaatgaaatgggaggtcatcgcgcggaatttgcat

SEQ ID NO: 29001 - DNA, 1190 bp, Heterodera glycines
  misc_feature (1182)..(1182): n is a, c, g, or t
tttactcatttttgtaaagacatgaaatttcctttttcgttacgcgatttacttcctaaattacaatcgctaattattgcgacgaattaattcgtttatattttaaggcaatgctcataattaccagtttcaaaatcactatcatgttttagctcaatattttattttactttagataattacatatataaagtttatatatatatattttctattatgtaattagcgggggccgggtggaaagttagagagagaaaaacgtagtcgcgagagagtctacgaaaataagagaacagacgcttagagaaaggcgagggatttgctgctcccagtgttaatggaaaagttcgttatttgaaccaatgcttttttaattataagaatttcataaaaacccattaactattccttttttaattataagaatttcataaaaacccattaactattccttttttaattatcaaaaaaaatccttttttggtaaaagtaatcattcaaaattttttcacctgcgtgataatttgctttaattttggtttttatgccgtgattaccattttatcctattgttttgggattacgtcaattaatttaatatttattaaaatatatccattaaaaggtatttaatcctacgaaaaagaaactaaatgcaacccaactcccattatagaaccatttttcaattttcattatatcattaaaagcacacaaactgttgacgtgctaacattttttattctcaaataaaaagcaatttgtgtccctaattagttttagatttcatataaaaaaaatttatctttgcagcaaaaaaaaattgtaaaaatttcatttttacccttaaatactttatttaatttacggcgatagaacataaagctaatggacttctttgaaaccaatgcaacaactcaggtaattaagccaaatttaatgttttaattaaacaattttttcaaggcattcaataagtccattttcacaatttcatcaccaacaatggaggaagtcaaaaattcagtgtttctcaaaatgattttcataattaatttgttcatcaatctgattggtggcataatgcacttcaccgttgtgtacatcagcattaaaaatcggtgaaaataatataaaatttacaaaaaaccatttttttaacctattcttgctttgaattanaaatttct

SEQ ID NO: 29002 - DNA, 1074 bp, Heterodera glycines
cacacaccgtccgaaaaaacgagatgtgtaccaataaatagagagtgccagagaaaaacattatctttttttctctaattttttgtctccttttggcgtactatctaatagtttcattattaggaaaaacaacatttacttcgctacgtttcattatttttctctacgttaaatcaacaccaaattttgcatatcgatagagaaaaaaattttgcatcgatttctatgtttattatcatcgcttaaatgttgtcttaaaaagttataagataaaaaagttaaattattattctttttaaagatttaatggctaaaagaactttattacggaagcgacagaccaaaaatgcacgtcatacgcgtgagaacaagcgggaggagaaaagctcagacggccaaggcgatgaaagcccggtgggctaagaaaagtgagttttttcaccaaattttatttaaaaaaatatctttttaatttcagcctctccagagccgaatcccaatgccgaaatgccaccgcaagacgaagcagggccgtcgtcgacatctgctgtaccggccgaagaactgatggagccgccgccaccagctccagcaccagtgccaacgccggagatggacgaggaaattttggaatttggcttttcgttgccatcgacatctgtcacggcattgaaatttaggttgtccacggcaaaggacaacctgatccctgcccgtgacctgccactgaagatcagtggcgattgctgcttcaccactttgttccatttgcgcgccaacaccgatttttggggcttttggatgagcagggtgggaccatatcattttttgggttcaattttaaatgttgtgatttttcaggagatgaggcattgcattccgtgtggcggcgacttgagcaactttggaagacgatgccggacgctgaacaaatgcgccaacagctggagcatcatttcgtctcaaattggttgatggacaccggcagactcgacgaattgaagctggtgagttgatggaaggggctttaaaataattatccaactaattaagaggtaggaggaacgacgggag

SEQ ID NO: 29003 - DNA, 2214 bp, Heterodera glycines
acatttttttgtattgatacaatacagtacctgggtctttcctaatttcaccgatggtccaaaaggcgtttattgaggtgttcggttgggcgatccagttttgcgaaacttcgatataagtgggctggaaattgcattcgaattaatgacactttgtttttaaaaaaacctccaatggagtgggcggaatgacaccggtgcaaatgctgagaaagcatccaacgttcacggaattgggaaaattctgaaaaaacgaaaaaaaaatttttaaaaaaatattttgctgttgttattggtgttttaccttgtacttgttgaagctgttccaaaattggatttcctggagcagttccaatgacgggttgttcgcaataatgcctgacaaaaataaggttatggacagaaaaaacacatattataatgggatggaatttcattaaaatcaagcaaaaatcaaaaaacagaaattcatcatttaaatttcgaaaaaccgcatttttcttgccaccaaatgcattttgattgcccaccgattaatacaacaacaacaacaaccaaagcaccactgctcacccacctccatcaatgtatttgttgtccacactggcaaaataggtaggggctgaaaattttttttgtaaatttaaaaaaaaattttttttattacccgccgatgaacgcctcaacactttccaaagcaacaaatcgtcgggcgtccggtagccgagctcctcattctcctcgtcatttgtcggcagtttgtaattgcgcatcagttccagctgaaccgggaagaactcggcccgcgtggtggtgaacataagtctggaatttttttttaaatgaggaaataatttcaattttcaaattttatcttcccatataaatatttttcagcaacgtccccgaaattaaaaaaaggaaagatattttcaagaaattttacaaaaaatttttttgctttcaacgacacatttttcaaaaaaaaaatcaagaatttttttccgagatttttttcggcgatgttatgtccctgacacattttgggaacaccgaagcaaccttggccacttgaggtcgctgaacattgtctcggcccccatctcctggcaaatgaacttctcgagcacccgcgtgttgtgcggccttcggtagtcgaacaccatgtctttgaagcgcaagtacagctgcaaaagcatgcacacaaaaattagtaaaataaaatcgaaattttttaaaaatttgttttaaaaattcccaaaatttgttttttttaaatgcaaaaaaaatttctaaaattaccgcaggaaaaattctgtttgtggttaatccgtcccacccaagcagaaaaaatctggaaatgtattgtcgctgtttagggacctcagttttagtcatttttaacataattttggcaagtttttatttttttaataattttccttgcgttgttatactttttaaaaattgcaaaaaaaaaaaatttcggtatgatggatggaatcaacggatatacttctctgcttggataaataaatattgattcaaaaagttcacccgctgaatttggtgcagtgtttggcccattgcgagcccggccgtgaccatggcaccggtggaagtgccgccaacccaatcaaaataggggaaaatcggctcgcccatgatgcgctcaacacagatcagaagctgaaatggaaatacgggaaatgaaaattcgattcgaacgagcttgtgagatagtcaggaccaaaaaaaaaaaatttggcacccaaatatttttttttcagaatccttgtaaattcaaaaaaaattccagcatattacactatcccatggtacaccaaactcattgaagtccccaggactagtttgtgggtgtaccacaacgtgagcatctcgtcccccccccctcccctacccaaaaattaaaacttttgcaaattttaaaaaatcatagaattcatcaaaaaaattttaattcgctagaaatactttttttaatttttcggggggtttgatttaggcctttgaatggcctcgcgaatcggatcggcattgtttacacccactcactcacctgaatgatgaccagcccacggatgccaccgccatccaacgaaaggacattgatgaaattgtggtcgggcggactgtcttcgtctgaggacacttcgggcaacttttccaacacctcgtcatatatgtccttaa

SEQ ID NO: 29004 - DNA, 925 bp, Heterodera glycines
tttttattgataaataaaattaattgagcagtcagaaaaatattcaaatttacgcaaaaaaacaccataacaattctctttctctacttcctctatgttttaaaactagagcacaattatttttggataaatggtaaacaccagggatggactttcgctttcggcactttcgctttcgcattttggcgcgaaacgcaaactttacacccctaagaatgagggataaattcccctaaaactttcaaaatgtgaccctagttggctaattttcagtgcaaacctttttaaaaatagtcaaaattaccaatttttcccccggcggcgcctatcgataacgggaccccaaaaaactcttatttttcttagaaaaatggccacataatcgcaaaattttgtacttttttgatgaaagtctgttaacaaattgcactcaaattttcaaaaaattttcccaggcgcgtggcttaattttcccctgcctaccggagattttgacggagaaaagtgagaggtttaaaacggtcatccttaagtgctttagagattcacatatgtaaatgaacaaaaacccggcatttctggcataggaatcggttcaaaaaattcgttcggtggcttgggaagtgcttctcgatttcctccaacagatttcccccgtcgatacattgcactgttgcgaaaaaggcttaaagaaatggatcatttattgacagtgtttgaaattagattttctcggtcatttaaataaagcgattttaatgagaaatgtaccattttattctcttatattagcccaattatgacgaattgattaagggtttcactatgaactcacaaagatatgagccccgttaagggggaaaattttactaaacctactttaatttcatgggcccgtaccccgcctaaaatattttcaaacaaa

SEQ ID NO: 29005 - DNA, 1547 bp, Heterodera glycines
ttgcgcgagtttcggcattttgtccacaataagcgaagtttcggcgattgttggtgtcgcccattttctcttcaaaaatttccctcgcaaattctgtcctttttgggttattcctaaatttaataaaagtttttcttatttattgtgccatttctaagttttgttttggcttccacttctccggcggtcactgtgccgacaatgattcaatttcaacgcaaaagaatcggcactcaaaagggcattccgacattggcattggcaaggcattcaaaaagcttttccgggctttttcaatttttcaaaattcagtgcttctgtcgacaatatattttccatttcggccttttcaattgcgttttctgtcttttctgctccttccggtgagtcattcgtcggtctctttttcctttaattaattagttaattaggccaatctcttctcactctgtccctcttcgccttcctccagactgggggatggaagggagaagggcttttgcttttgttggtgcgatgcttctgctgaacatttgtgacgtcgtttaaagggcgacgaacttatcgaaaggggacggaggagctgatggatggcataagcaaaggagaaaaagcctaacaaaaaaaggagtggagaagccgagcaaaagataactggaaaagaggaggggaagagaaacgagagggggagagggcaattaagagcattgagaaaaggggaggggaaaagaaacgagagagagtgagggagagagagagagagagagatgggggagggggggcaatgaaaagcattgatcggctgcggaaagagtttgatcagaggaaggcaaagcgaaacgggaatgaattggagaaaataacacaaatggaggggaaactgagggcaacgaccacacaaaaacataaggaaaaaaacaattgcaaaagtgaaagattgaaaaagggggaccaattggaaaagtgaattttataatttaaattggaaaaagcaatttgaaattttaaattggaaaagtgtcggttaaaaaaacaaaaaggaggagagaattctcaaattgaacacgaaatataatgaatttaatgattgatttgcgaatcacttgttcaattcggctgcattttgactaacggcgcaaaattttacacaatttttgagttcattcgccccccgggggtaaacacagaacagataaagattgaagggaaagtcggaaataataaaacacacgagggaaaaggaaataacggagggagagaatgagcaattaattcaactaattagagggaattaattcaactaattagagggaattaattcaactaattagagggaattaattcaactattagggggggggggggggcttcgctcgaaagggaacagcgagggaattttttgggaaattttggctatgctttctaactgaggatatttaaattacagcaaataaattttaattattattaaaataattttctttttgcccacctcgccacttccaacgcaactggcaaatcgccctcgggactcattttcagcgcct

SEQ ID NO: 29006 - DNA, 1463 bp, Heterodera glycines
  misc_feature (536)..(536): n is a, c, g, or t
gatgtcaccccattgtttgatgatcgactcggaggacttgggaggacacgcaaatttcagggtaaaaacgggaatgctatggagcactctttattaccctaacgtagcaggtcgtccccctcgttccccccccccccacccccgaaatgttttttttcatttttaagagaaattttaaaaaatcttagattttgatctgacaaagcgcactctttgggccggcaatttgtctttgcccgggacgcgtcttctccaaatcacttccgaacgtgtccaaatgctctccggtgatggcactttcacctccaaatggtgccctgatcctccatgtcgcatttcgttagcttctgtcaaccaggcgggtgcccaacttctgctttcgtccggccctcgcctcttttatttgcgcgtcgattcggaccaaattatgctgctccaccgcctggaatgtgctgatgaggtcgcctgtctcgacatttccccactcggtgtgctgttcagcggtgtttgcacccttttcatcgtgtttggctgtntaagatggccaaactctgtccgacttcttctccattggcttttggtctgagcattcggtcgctgtctacgcacttaaacctggcactgtgccagcattggtcgcggaggagcgtttgtccagtgaatttgtgccccgttccatgcttatggcacgcgtccctccttgcttttcttccatttctcatttgtcccctttcattcaggtgaccatggagggctctcactttcttttcgtcgctttgggcgatggcacagtgattcatttccgcgtcgattcgctcaccggcgctttgtcggcgcaaaagaaatttacactgggcactcagcccacttcgctgtgtcttttccaatcgcccaaaaagaatgcgcttaatgttttcgcctgttccgatcggccgactgtcatttattcgtccaaccacaaattgtccttttccaatgtcaatttgcgatcggtgacgcaaatctgtccattgaactcggaattctatcgtgattgccttgcgctgtcggacggcgaaaatttggtcatcggaacaattgacgacattcaaaagctgcacattcgaacggttccattgggcgaaagtgagtttatttcgggtggaatcgaatgcaaatgttggatttccaaaattattattttatttgtaatgtgtgataacggaaatttagcataatttgttcaaaaagtaagattcaaattttcataaaattgcaatgtaatattcaatcttatggtccaaccctttttcaattgttatttttataatttcactcgttaccaagctgttcatcgacttgcttaccaacccgagagcaatttggtcgcaattttgaccactcgttgtgatgactttttcactgccaatcgcctcagcagtacgaccgtccatttccgtcgactgggccaaatcgtacggcag

SEQ ID NO: 29007 - DNA, 910 bp, Heterodera glycines
gattctctttggtctttcttcattcgtggaagatcttttttaatgaaattcaattatttttattaattatttccgaaaacttacgtttcccttgagttattggagcagaatgagaaaaagcggcaactaacgacaggattatgaagatgtcagttgaaatgagttgcatttttggaattatgaattacgaaatattaaaatatggtttttgattatttttacacctaaaaagtcttattttataaatataaaaaattaagaaaattcttttttggaagaaataatattcgaaatccaaaatatatttaattttatatttttaaatttataattttctttaaatcagttcagcatcattatttaaaatattaaatacaaattaataaataaatttagaattttttaaaaatttcaaaccaagctcctaacccagaattccaacttacgatatgcttagggactaattccatcactggtaaactggggagtgagtttctaatggagaagcgaaaaatcccaatcattaaattctaaatttaattttcaataaaattaacaaagatagctgaaacagaagtaaatccctgttttttactaaaaatttttcgcgcatttttattaaggattttagataacattcacaactttttaaattcaattaactataatttttaatcaatattttacagaacattggaataaaaatatttgttagaaacatttttttaaattaatgagaaaattaattttctaacttgaagcaagcctgaacaacccgtataaaataatgaatacaattttgtttcattttaagggtttttgtcaaattgagtaaaagtaaattatttaaaatgaaaaatatagcaaatcacactgcctatttaaagggagttattaaaattggattgaa

SEQ ID NO: 29008 - DNA, 618 bp, Heterodera glycines
aaaaaaaaaaaataccaagaatttcaaaaatcgaatctcattccaacaaataaaaggaaagaaagtggttttttttctatttttaaatgtttctaattaacaaatattttaaccttgccaattttgggcatcaattggcgcgagagcaactctttcggtgacatggacatggcagcccaagcctgaaaagaagagtaatgatttagaagaaaacggatttgatggacttggatatattttctggacaaaaccctgataaaattcaggtttgtcaaggccgggcaggtcaaactcaaaatttgagactaaaatgcagatttttgggcaatatctgttcatttaaggacgtagacttttttcgaggtcccgtttataatgccggattcgtgctcagcaccataaaatagccctagaaaaatttttccaggcttttcaaataaaaaaaaacgggaccagtaaactagacctttgccataaaaacaatttgcaattctatttttggaattaaaaaaactgaccggctcgaccagccgttcaaccaccgcttcgcgcagcagcacactcatcggcacgttcagtgccaacacaaaaatcaccgcttcatgcctttgccggcgc

SEQ ID NO: 29009 - DNA, 835 bp, Heterodera glycines
ttctgccatcatccattttttttcctctttttcgaactttcggacgattgagggacggggcacgggatttgggtgtctcaggatcccatttttaaatgctgtctttttacaccattttgcggcacgctttttcaaaagttagtggaatatgcctgaggggggggggggttcagtatgtgctgttccttttgccttaggcaattctttcccaaataacaaattgcactgacccaccaaaaatgctctgaggttgtgttgttgacccaaaccattccctgttttgaatacgtaaatattttgttaatgcttttccttaaataaatatttctctctcttcaaatggtaatttgaatggcttaaataaagccttaaacccggggacacaacagcaatgctgattggtgggacaagcaatggttgcaacagcaacgggctacagatggatgggccggcgatggtgtggcacaaaatccgggccgtggtgaggaagggtaagcagggccaagaacgccaagccaattctcgattttaatcagcaattcaccaaaatcgcctgtgcggattgatcggaagaaggggcaaatggtgggcagagcccacggattagcaattgaatatttatgtgaaaagtgggtccaattgggataatccgccgccaaaaaatgtgtaatttatttatttttttaatttttgtcggagacagggtggggtcagctgccaattttgcgaggggtttcaacgccgcatttaacgcttttttttgctttcaaaacgcttttttaaagcatgctttttccaaaaaaaatatcaatgtaaaaatttcttggattccgag

SEQ ID NO: 29010 - DNA, 1848 bp, Heterodera glycines
  misc_feature (1742)..(1742): n is a, c, g, or t
  misc_feature (1762)..(1762): n is a, c, g, or t
  misc_feature (1805)..(1805): n is a, c, g, or t
gtcggtgttggtaatgatcatgttctactaatcccttccttgaggtcggtttatatgagaggcgtgatcggtgactttcgatttggtaccgaaaaccgatcgaaagaattttaaaatcaaaaatttttgatagaaatacccaaccccaaaattcccaagaatttaaatataacattttgtggctataaaatgatcaacaaaatgccaaaattacggtttttagcgctgccttcaaatgaaaaagcagcaaaggatttcgttgtgccgtttgcgcaaaactttggaagaaattgtggagaaaattgaaaatgctaaataaaaaaagaacggataatgagattggatttggtcattttttgcgctaatttagtgctttatgtttagaatttagcaacagtttttgttgttcggtcagctatgttttgtattttacagtgtgaagataaataaactgaattgagttgaaatttttaccaaatatataataatcaaagatgtaataagctattatgccgaaaaatttacattagtttgaaattcgagtttcgaaaaaaattctgggaccaaaaaaattgaaaaaattatactctattccaaatttcggactttttgtgtcgcaatttcggtttcccgggtttttttttacccataaaatacaaaaggctaacaaaagaaatattaattttcaaaataagcataaatttttattatttttacggttttctaagatttttatttattttatttttttgcacagttttctggagaaaattaaaataaatttttgatttatttgtttctgatttttacaacatttgacgaagggtcacgacaaataatggcaaacgatgtttattttccattgtcaacattatttcatcaggaaaatttggtcaattatacaaaaattgactctttcctgcgcaaaatttgcgcataggttttttttcgtaaatttctataaatgaaaagaaaaactatatttccttttaaaaaattttctaaaattgaaggatttaatgtcaattttagagcaaaaatacttaagctttttgtttaaattaatttttctatagcatttaatagcccataattaaaaaataataattccttaatttggcgcacaatgatttaattctttgcccatttttatacctgtgtttatatttcgatttttcattttaattccattttaattttcgatgtaatttctgcaaaatcttttttgattttgttcaaaaaaaaaatctgccgaattgtccagaaaccattttttacaacaataaatgtgtcgagtggaaaagaacaagttttggcggggaaggttcatgtgaaaatgaacacaaagaacacttgactttttatgaattttttaccaaactcattcattcacaaaaatcgttctttgaaaaccattttgcatttatatatttgatggacaacgaattgaaaagggattaacatttattaaaaatctttaatatttttggtcaatttttatatattttttattttctaaggaaaataaaaaaattttaataataataaatttaaaaatcgatttaggtgaattgacaggattcaaatttaaattaaattaaaatatatatatactttttctcattttaagttttttaaggaaaagaaaattattgattcttagtaaaaataattttaaataaaaactgattttaaccattttgaaagcatttatttgaaggtaaggaatttcaacggattanaatttaaattaaattaattnttttttataaatttttaattattttattttgtaaggaaataanattagcccttctaataacataaatttaaaaaaaagtgatttta

SEQ ID NO: 29011 - DNA, 1087 bp, Heterodera glycines
tctctctctttctctctccactctttctctctctccctctctctccctctttctctctgcctctttctttctctccttttgctctatctctctctctggtttctctctctctctcttctctctcgctgttcactcaccctctccctctctttctctctccctgtttctttctctccctttgctctatctctctctctttccctctttctcccttcgctctctctctctatttctctctccctctctgctttctctctctctttctctctcccactctttctctctctccctctttctttctctccttttgctctatctctctctctctggtttctctctccttctctctttctctctctctctttctctgctctctctctcgctttgctctatctctctctttccctctttctcccttcactctctctctctctttctcactcccactctttctctctcactctctctcttctcttgttctctctcctcttttctctctgtctcttttcgctctctcacttttttctcctcctttctcatttctacctctctaatgttctctttcatcttttttctctctctttctctctccctttgctttttctctcccttcgccctctctctctctctctttttctcttatttcattctctctcttcgctttttctgccctctctcttctctctctcacgtcctctcacctctctctttctcacgactctaatttttctcactttcttttttactctctctctctctgctctctatctctctctttccttctcttacgtcctctcacctctgtctctctctcacggttctctaatttcttctcagaatttcttcattctgtcccctctgttgcttcttttttcatctctctatagttttcctcttattctcattcctacacccataataaacataaacaaactcgcacgcattcaaccctgcgtgacaaccgcacgcgttacccattctaaccctcccacccgccccgacagagaaacaaacactgcactctcactactacccatccttttctctattaatctccaaatatattttttaatgttctcgttctttt

SEQ ID NO: 29012 - DNA, 518 bp, Heterodera glycines
gggggggggggccgaaggcccccctcgaggccgcgaagcggccgagtgagtaccatgggcgcaggaaaattattaaggaggagggttcattatttattgatttttgcaaaattaattcataaattttttttcagaaactgctctgaacgcgatccaaaatttatttacaagttgaataaggcactctgactcttatattatcaaaaaaggagatgaataaatattttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagttgttataaaaatttcaaaatgctgagtcttctatttttatttttgcaaaattaattcatattaattttttcagaaagtgttctgaaaggcaccaatttttttttacgagataacaaggtcctcttaggtttatattatgaataaggg

SEQ ID NO: 29013 - DNA, 1026 bp, Heterodera glycines
gcccatgggggattatttttcaacctcctcagaattgggggggataattagagactgggggattatgatagagggattatttttcaaaacacctcgtagactgggggataattggagactgcgggattaatagagactgggctataattagagcatatacggtatgccctttgatgcaatgtctctcaattgtcattttcatacggtacagcactttaggaaatgacatccaccattcttaccaaagtttggtacttttccgttttggggcctaaatttcaattttaaaaaaaaaatcaaatctagaccccaaaacggaaagtacccaaaaattttttatcatcaatcggcagcaactgaaaaaaagagttttttttttgattcttcattgtttaaagatttttttattattattttggtttttctattttttatttttggtctaataaatattatttttttaatgttaagtgggttctgttttgctatcaaaattacaaaaattataccaaattcaaaaaaagagataaagcaaggacccggaaaatttttttttaaatttttacttgcggatcagtgaattttatgctgctccatggtggccaattttttatgaaacaagcatgcaaagggatgagtaaagacgaaatggaagagaaaaaggaagaaagggaaggaaacagagaatgcggaagaaaaaaatggacgaagaaaaaaatatggaagatcggggagaagaagaagtaatagtataagagaacaaggaagaacgggaagatgaagaaccggaagaagaaatagaagagtaaaatgaataaaggaacgaaaatgcggaagaaacaatggaagagaaaagaaaaagaagacaattatggtgaagagaagaggaaaaaaagagtgaatgataaacaagtgtaagaggaagaagaaatggaatatgaaaaaggaagaaatagaagacgaagaagcgaagataaaatggaagagagaaaaaaaggatgaattatagaagatggggaagaggag

SEQ ID NO: 29014 - DNA, 1119 bp, Heterodera glycines
ttgtgccgatcatcgacaacttcaattttaacaccaccttccaaacctcataagcatcatcattgtcatttgtgatcgtgttcattataattttctttgaaaaaaaaatttgtttggcaaaatattttaactaaacaatcaaatttagcggtgctacgccaaaactgccaaaattgtttttggcacagcggacagaaaacgccacgcaaaacacaacaccaaattggaataaataaatcaaagttggcttttgcttcggtcgagcaatggaaaacgaaaaacgctgacaaaaatgaatttgagaaagagcgattttgcgagttggataaatagagtgggctcaatgcggagggtgggcaaagaagtggagaaaagggcggccattttctgttttacaaaagcaaaggaaaaagaagagaaaaagacggtgagagaaacataggattagacaaaaggcagtgaaattgtttatccatgtactatttctccaaatcttgtttcttttccttgcatgagaaaaaattttccgacacgaattcaattgacctacgctattttgtcagtttctaagtatctgtccaagattaattgtgaggttagaaaggaagatagtagtgaaaaatatcgtaaaatattaaattgttatgcaaatccgaattctaacaaaattgatcggtatttttaattaaaaattctgttgctttttgtgccaaaaattttcgcttaaaatttttgctttagcgatggaaattgaaaaattcagggtcgttgtcccgtaaatcgttttttatttagcctttgcatttttaaatggtattcaatcgtatcaaccccattttccttgcggccggcacttcttcggcagtcgcatttttcatcggttctcaatgctcaaccaaagaatggttgaatttggttgggatcaaaaggtacatacctactcctgaattaatttcaacatccatccacaggcacccgttatggatttggaacccaaattcaaaccaaaaaccggatttaacgcataattcaaggcagggttccatattttggcaaaaatgatgccatattattgatcaacagcctgattctaaccaacccaaaggatttttaaaattt

SEQ ID NO: 29015 - DNA, 871 bp, Heterodera glycines
gaaaaaaaagacttttacaaaaataatccccgggggaaaaggggaggggggaaacagattttcaaaatttttcaatttttttttagtctaatctactcaaagcggcatccagaattcaataaaaatcacatgcgcggtgggaaaagtgggttttgacaagtttagtgggaaaaaagagactacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaatgttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttt

SEQ ID NO: 29016 - DNA, 1125 bp, Heterodera glycines
agatttatggggaggccgaatccttcgggaatagctcccctacagcctgtactttaattctgcgttgggatttttgctccccataaattgtgtgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagtttccctatagcctgtactttaattctgcgttggatttttgctccccctaaatgtttgaggacccccaaccggaaacttggaaaaaatcgaattttttttgtttt

SEQ ID NO: 29017 - DNA, 975 bp, Heterodera glycines
tttttatttgaatttaatgcgccgttaaaaataggcacatattttttatcgcgttttcacaattgataattcacaattaattccaacatcatatttaactttttattagtgttttgttatattatattaaaaagatttacatattacttattgcccttcaattaaaagtttaattaactcgtcttaagccaaaatgtttcactgttttctgattaaagcaatgtgcgaaaaggtgccaaaaatatattaattgaaattttcttaataacaaatttaagagaaagcctttaaaaaatcaaacaaaaatacaataaaataaagaaaattaacatgaaataagagttgatattctgcttcaaaaatgcatgaaaaagtgatgattactaccaaaataaaatcaaatcaaatcaaatttataaggtacaatatttaataccctacaatatttaatacccacaaaatgtgaaagcacaataggtatcaccacataataaaatatctatattaaaatcaattgaaaatagtattaggcctaaattacatatactaattatttcaatgtaatcaattacagtagttttattaaattaataatatctaaaaatataatgcgtgtgtttaacataccaataaaaataagcatgacaacacctcagcatagattgttcaaagaactttgcaaagggaaataattaaagcatttaaaattaaaatattaaaatcaattattattaacataatacttgaaaagtacaaaatgcagacaatacataaatttttgtaagatataatttttataaattggaacattctcagaagtgccatcatggtcatgcatggtctaatattttccaataaataaatatatacttttcaaaacattgggaaattagcatcaagttaagacattttacaaaaaaaaaaaaaatttaaaaaaattcctataatgattaattatggaaaaacaatttgatt

SEQ ID NO: 29018 - DNA, 986 bp, Heterodera glycines
aagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtccccaaatttgacatccataaaactccatttttcataggccagcgtgtttaaatcaaacccgaactgataggaaattttaatgatc

SEQ ID NO: 29019 - DNA, 834 bp, Heterodera glycines
gaaatttggcattttaaggggtggggcagaccacattttgacatttgagaagagaatgttgaaaatgaacagaatggtgacggtggacaagtgatggcgagtgtggtggagcagcacggagagaacggtcgtgttcagacaaatgccgcacaaaagggcgatttccaagccaaggccaagccgtgcccagccactcagcgtggagaactcactgaacaattaaattttaattgccactgccaaaagcgacgatttgccgtcgtcacctgacactttcctcggccagcagcccctcgggcacttcgatcttttcgctgggccttcggttgcacgtctctctgagctgctgcgtctccgcctcgtcctccgcttcgctctgcagctgctcttccgttggcattgtgtccgtcccattgtttgttggttcgccctcctcttgaaagcgttcgttcgcttggaccattttgcatcttaaaattatgaccgatgttttggcattgctttttggcattttgacttgtaaagcatttcgacgcgagggtttagccaaatggtggccaatgagaaatgctgcaaaagaagtcgcgtcttcagcaccaaatggggcagcgaactcttctgcttgatcatccttttgatgtaactgctaaaacggcaaccaaatttggctttcggcactccgccaatgcccaaatgcctttcgcttatcttatttcgttgccgaccatcacatcgttggtcaaggcttggcccatcccaacacccaaaggtcgatttgcctcgacgaactcgcgaaaagtaaagcgatgcgttccctcgcaagtgtgcgagaag

SEQ ID NO: 29020 - DNA, 978 bp, Heterodera glycines
cccaactcatccaaacccaactcatccatacccaactcatccatgcccaactcatccatacccaactcatccatgcccgactcatccatacccaactcatccatacccaactcatccatagcacgatacgagtcgtcgccgtgacatttaatgccacgactaagaccgtacaaccaaaaaataccacgactaagaccgtacaaccaaaaaatgccacgactgagaccgcataatcaaaaatgtccacggtcaagaccggcataatcaaaaatgtccacggtcaagaccggcataatcaaaaatgtccacggtcaagaccggcataatcaaaaatgtccatggtcaagaccggcataatcaaaaatgtccacggtcaagaccggcataatcaaaaatgtccacggtcaagactggcataatcaaaaatgtccacggtcaagaccacataagcagaaaatgccatgccacgaccacataagcagaaaatgccatgccacgacgatgactcgcagcgttatggatgagttgggtctatggatcagttgggggtgactcaaatacgttgtcatgaatctgcaatcagattttgcgtctttttgtgatatatcgtaacgatgctaaaaaaaagtgatagataaaaatatacaaaaattaagcgttttttatagctttcaagcgagaaagtgtgtttaaccggcggcagaggttgcattatgacgcaaaaaaaaacgctgcggttgcgtaaaagagaaaagcattagtatatggcaattactttggcatccgtcttataaattggcttgctgaattgtatttttcaaaaatcatatttgtaggacccaaattatagttttggccccaattagattttattttggtaaaaaacttggcaaatttgtgaacaagcaagtattgggttcaaatactcttacagcacatcctccgacttcaccgccttgccttgggttctggccatca

SEQ ID NO: 29021 - DNA, 631 bp, Heterodera glycines
ctcattactctccacctcttccccattctctctctctctatcgttctctctttcccttcactctctcccttctctctctttcccttcactctctcccttctctctctctcccttctctctctcccttctctctctctctcttctcttctcccaatctcctttctctccccctcttcccccttctctctcttctctctctcctcccactcttcaccttctctctctctccttcgccctctctttctcttttttgaaaaaacagtaattcaacattaaattttgaaaagtcgctggaaaattttttaaattttttttttaaattttttctcggctgtgttatgcagggctcgtatccgtccttgaatggcaaggacgtccttgaaattgggccctctttcttgaaaataaaaaatgtccttggatgcaaggacgtccttgaaaatgagcatttggaaaatttttataaaattcaaagaaatttgataaatttttgtaattttcaacaatattttgattaaattatagcattatctaaataaaatgcaaatttaattgcccaaaatctcaaaatttggtcattttttagacaaaatctgctaacaaacagcattaaaattacaaaaaattttcc

SEQ ID NO: 29022 - DNA, 1599 bp, Heterodera glycines
ctcatctgcagcataagttgaaccgacaattttggtctcttttcgactcacaattctattacgctttttgaagcaaaacagccaatatggtgaagcctaattttagaaattgttcttcttattccaatttataaacaccttgaaatcatttaaatgcacatctcgggccttaagcaaagctgccgtaacaatgtccgcgtcgtgcaaagcttcacggcgttggcgagactctcggaacatcgaaatgcaatgctcttcgatttgtcgcaatttgtggaattttgttccccccttttcaacgtattccttaattctaacccgcctttcgtgagatttttcttgtcatgtcttaccgaataatttcaatgtcgctttttaattttttgaattggtgacgaatggatttataagttttgccatcatttagcatattcactatttgtatttgggtttcaaatggatatttggattgggttgggtcatgattattttcctcctgatcagtgttgttttctgattcgtcgtcgtataagtcgtcctcctgatcagagtcaaaatctagcccaatttggtctgctccaggctgttcatcgattagcgattgggcataatcgataagcccactgatcacttgccgtatttcaggattattttggtgttgttcaaaactggcgtttaactcgtccaaaaatacattcattttgggttgggaaatggggtgaaatcaacaaaggaatggcgaactagcggaaacgatgaccaaacgaaaggacgcgacgttttttcaactaatttgcatattttctgccctccccccaccggttgtaacgaatgaattacaatttttgaccaattgatgtgaacagaataattaaattgaaaattttttaaaatttatttttttttagaaatcaatcttgctttgatattaatgggtgccaaagagaattagggattgttccgaccgcaatcaattgtaaactttggttcttttggaaactcaataaaaagtggaatttcatccgatacccatactctgtctaatttatgccctttccacgctccaatgaatttataagaacaattcgtttggttatcaggggtccacacaattaaagttttgtcattttgtttacagtttcctttttcaaacgggcaatttaccgtttcacccataggcgcaaaaatggaagggtccccaaattttgacattacttgtgtcgggatgagataacaatttcactggattcgattttccatccccatgagccaaaaaaccatgttctcggggttgtatcaatttttcgatcagtatgtaaaaggcccgagtcatttttaagtgtacctaagctacatttttatgtctaatcatttgatcacattcattcaaactcacatccaaaaattcagggtcgagtagttctgtgattggaacatttgttaatgaagtgtattttctaagcgatttccttattttacgacaagcccatgcttccgtgtaatgtccaaaaaaatttggagaaaacagccacagtgacatcctttctgggttttggtttgattccactgaaaatttgggacagccaccgaacgagggaa

SEQ ID NO: 29023 - DNA, 1207 bp, Heterodera glycines
tgttttttccgccttagttttgcattttttacagaaaattactaaaaatacttactaaaatgtatggacaaccactaaaagtagtcatttaaaagattttaattcatgtttaaaatgtttcctaattgcgtgccgtgccgtttgtttgacggttttctaaccaaaatcactttttttgggtactgtaatatcatatcatatcattttatgttttcaatgattacttcctctgtcaggcaaataacacagatgtgttcagaatctgacgttgactgtttatttgtttgatcaatctggggcttttcgatgtaatttttcattttagctttcaaatgttgttcgctttcgtgcccggcggatgtttgagcattgttctttgggtacaacttccatcgctgacaaaatgctcttaattcatttacctgtaaaattttattttgtatttttatttgatctgttttaaaagtgacccgaatctctaattgtttctctaattgttctttaaattttatgtcgtccaataaagactgttgttcagcattttgaatttcacagagtccgtcaacaaagccaaaaactttgtctccataacggcagatattgcttaacatggcatcatttgtgctcgccttgatcagcgcatttgaaaaaatgccgagggcaatggcatccctttggttaaatggacagccaattgccttttgtgatttggcttgattgatggcatgacggagaatggccaggacaaagaattgtgtcttaagagcattgcagatgagaaatatttgtacattttattctcttttttcgcattagcacctattttcgttttcattttttggaccattcaaaaaagagaaactcaataaaaaaacgtttaaaaaataaaagaaaattatgacaaactctggccgatacggtgggctggtggttaaacgccgtgttgagtagaggtttaaaaccactatccaacaactcgaaatagtaaatcaaacaacgtctttgttccgaaaattgacatagatcattaattgactgatcattccttacaccgttctccacttttccatcaggagcaatgatttcctattgaatgtgttataaatgaacgattaaaatcaaattaaaaagacaatttttaattttaactaatttaaataatatgactaagaagataattaattaattatttttaaatgaaaactgg

SEQ ID NO: 29024 - DNA, 973 bp, Heterodera glycines
  misc_feature (256)..(256): n is a, c, g, or t
  misc_feature (926)..(926): n is a, c, g, or t
atttttggctttactttttttcttttcggctctaattttgaaaatacttagtacttaaggcatttttgccttacttttaaaataagacattttcaaagccaaagaacaaacttgtatgtttcccagtcgaattgaagtcgtaagtacgtggcgctgatgttccgcacacagtacatacaacagtcacacgaacggcacggtaccgaaatttcttgaattgatgatgatacgtacgtattatttgacgactaataanaaaataaccgtgtttctttttttaataatcattaaacttttttgcactttccattttaagtatggcattttttatattttttgaaagcagacgctattaataatcaacaaataggcgagactttttgttatccaaatgaagcaatttttgaagcagaagaacaaactttgcatgttttcccgacccgctgaagtcggaagtccgaggtgcagttgtttggcaagccaagcagcaaacttcgacacgcacagcgtgatggcggaattttttgttgagctcaaatttgggcatttgatgtgacaaaattgctgcattcgtgcaattaaaatgggtagtcttgtggcggcacatctgagttcgtccaatgagaaagcaatgccgtattcggcttactactatcgtcagaggaagatgaacgtaatcgaggcatattctagaattacgctgaaaaagcaattgtgggcgctatactttttcgtcagtaagcattttcgtcagtgaacgatttcgtcagtgattttcgtcagcggataatttcgtcagtgaacattttcgtcagtgtactatttttatttattttgctgttttccatttttttcgtcagtgttccaattcgtcagtgaacattttcgtcagtaagtatttcaggctcaattttttatatatattnctctcttaatagatttttaatagctgagaatttattttattcaaaaa

SEQ ID NO: 29025 - DNA, 1134 bp, Heterodera glycines
  misc_feature (1123)..(1123): n is a, c, g, or t
tcagtagcatatcgtcgggttcatttacggtgaccttctttaggaggagaacagatgaagaaaatgaacaagcgaactttgaagaaaatgtgagccaaacaatggcattgacaatctttgttttttggaaatttcgaccaatttccgcatttgacgctttggagaaaaatcacaatttatagtacaaggagaagaatattggactaaaagcgaggctgtgtgtatgtatcggtggcaaattttcggattttccgttgccgggtcgtccgctgcccaacaaaatccgctttaatcaacttcggattgagtaagtttaatgtgttgtttgcattaaaggctgatgattgatcccttttaagctgcattgccattccgtcattgaatttctccgtgccaacaagcacatttgggagagaatgggcaccaatttggaattgaatctgtgttcaagcgataatgatgatgatgaagagccgatttgggatgttttggcgcgtgaaatttggccaatttttgcaccaagcattcgccacttgggttttgccaattttgacgctttgtgccgtcgcatttcaccgacaattctcgccgatcttcatcaattgatttcaatcgatttcggacatctgtttcttcatggaattgatgacgacgatgaaccaaatgcaacttctcctggccaagtgttgtccgaatggttgcacactccgaaaaaagacgggcaaccgaagcgactgtttcataacttatgttaaatttgataattttatttaaaattttgcaagctaacagagaaaaagcttggctattttatggtactaagaatgtaaaatatgattgcctttaagcaaagttatgccatgttttgtcgaaaaaattgccaaaaattttgaattaacgggatttctggcgtaatgatgacaagttctgcttttgaaagtcaggtttctgcggtcagacgctaactgcatgaacctgtcaaaaatgacaggttttttccggtcggggtcgttttcgcgtgagggccattttcgcgcaccccccccccctaataaatgaaaaattttctcaaaaattcgactccaaattcttttacatacttgatatgaaatattttagcctnaattcacacaa

SEQ ID NO: 29026 - DNA, 570 bp, Heterodera glycines
agcaaaagtaaaagtaagcaacaagtaaaagtaaggaactttttttaaaaaggaaaggacattctgacaataacaacaataaaaatagtgagtttcaattgtcggtgggtcgattgctcagtgatttgaccccccccccccctctttctccccttcgcttttccctcctttctttctttctttttcttttgtgcgccgttttccatttttttctttcctgaaaaaatgaacaattaaatgaattatctttgaacaaacaaatgaatgaatgggctgatcaatgtcagtctttcattatcacttttattcagcgcggagattccatccgttcgtttagcgaagtcaatcagcgaaaagagttcagggcggatgatgggcggggagaagagagtgttgggaggtgagagagggggaaaagagggagagaggggagaaagggaaggggaggatgagggaggtattcacgctctagagtgatattagggatcagcgtatttttctaccccatagaaaaatgctttttaagagcttgctattttttactatcgggaccacaattctgcacctttg

SEQ ID NO: 29027 - DNA, 985 bp, Heterodera glycines
  misc_feature (10)..(10): n is a, c, g, or t
tttatgggcncaatgaaaaacaaaaaacgggtgagtaaatcttgaaaatattgcaaatcaaaagccataaacccacctcgtactgcgatttgagataaatttctgttttttcacactatgagttggtttttttaccaatgattttaccccaaaaatccccccctccatccctgtgatttttttcgtaggggctcattaaactgtaaaagtgccgaaaaaaccaatcatttaaaaatcctcacattttttttcttaaacgtcggttcattttgcggcaattagcgcacaattattgtcgttatttgtgatcggtaggggtcaactgcgtctgagccaactgctttcgtaccggcaaaggttcacagttttcggaatatgaaacaaaagggtccataaaatacaaaaaaaggaatttaaattttttttaggcattaaatctttttttccgagaattaacgtttttctgctttttttttgtaaaatttgcggaattacttttacaaaaatgttaagaatcaaatttaaaagagtcaatacgatttatgagaaaatttatataaaaggcagagaaattgacagttaatttcatttttgcaattataacttacgacaaaattgtgcagctaattgccacaaaatgaatcagcggcgtttaaagaaaatgtgaggcattttttaattgaagctttatcggtaatttaattaatgttttcacgtatttcagctggatttgccacgatgtttggatggatattttgccattttttcgtcgtcgtaaactcggcctcaatttggcactgatttccgatcgtttcgatgttttggtggacgcgcatttcgatggcaaatcagaattgacgatttggaaagctatcaggattcacaaagacgctttcacagaagtgccgaaattaagtgtgctaatcgataatgccaatcctgtaaagtttccatggcctgaccgtccgttgcacaacaaaattcg

SEQ ID NO: 29028 - DNA, 1547 bp, Heterodera glycines
  misc_feature (58)..(58): n is a, c, g, or t
gtatagctcgcctcaacggtaacatgtagcacagttgtaccccttcctataggcgtcncggtttcctgtgtcgtaaaaaaatcttaaatttctctcaatcatgcagaaacagaagagtggggtgcggtgataggtggcaatataatcagaatagcggctttcgtagtccctgtgtgttataattttataatttgaagcctcaattaacaatgcctccacttctgctctgtttttctgccagaaaaaatcttctttttcgagagcctcctcaaaatatttttgaaacgagtacattttaactgaaaaattaataaagaaaaaaaactcgaataaataataatggaatgaacaaaaaataatgaaagggaaaaaatgaaaaaattttatttaacagggaaagaataagtgccaataattattgaaattctctggtctaacaaattcacttccccaaatgattgctgcctgtgcatgaactcgttgaaaacaatgtctgggttcgattgttggaaggggcgggcagggatgatcactgggtctgacagggcactgcaataaaggtccactgaaattttctcaattttccagcccggctcagcttctcggctcattgcatcccccattaattttttcaggatttttttaaacattttttcgggatcttcgttttctgggcatttaaaatagaaagttgtcacgtgctcttttatcccaaattttttattttcgtttgtgtgactctccacttcttcgaaacatttttccaaattaggactattcttgaaataatttttggtatttttcgagcggcggacttcttttgaagtttcttggaagtttttctttgacatctaaaaaataggaaaagaatatgattaatttaaatattaaatgttataaacattaatacaaaaaaaacaaaatttttaaatctcttaataatgtccaaagggcaaaacattaaaatgatcgtcgataattccttttttctgcaccggcgtatattctttttgtacatcttttgagagaacccggaagtcgtttgtcggcccgatcttctccgggtagtgaaaaacttttttgactccttccttgtggtctagcaccatctctttgaacaattcatatttaaattcgtttcgtctatccaatgtcatccctctgattttggttttgtgccaaatcaccccgtccttctttcttctaagtttcaaggcgtactgcttcggacccgcggacacaaactccaaaatttcgctgtcagcatactctcgagtcatctcccttaaaaccacaatttaaatgcgtttcaaaatttatgttttaccctaaaaatttcccctccaccaacggacaccgccccttccgatgagcaaaagctagagaatctaaatttttggtgtttattttctttttattccttttcacctgtgtcacaatagagcagtttacacccctccttcttgtagacctgctccatgtactcgtacagctttagcctcgcagcactcgtggtccacaatgacaaaacaatattcgacacttta

SEQ ID NO: 29029 - DNA, 965 bp, Heterodera glycines
tgaatgttgtcccattttacgttgtggtctgcggcctacggtcgcttcagagccatttacgccttcttttcaatattcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaaccttttttatgaatgttgtcccattttactttgtggtctgcggcctatggacgcttcagagccatttacgccttcttttcaatattcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaacctttttttatgaatgttgtcccattttacgttgtggtctgcggcctatggatgcttcagagccatttacgccttcttttcaatattcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaccctttttatgaatgttgtcccattttactttgtggtctgcggcctatggacgcttcagagccatttacgccttcttttcatattcgtatgtaaaacgactatctcttttttcggaacacttttt

SEQ ID NO: 29030 - DNA, 1319 bp, Heterodera glycines
gccatgcctccgattgctggtggcacaccatgtcctcacttagtgaaggtgcatttgaaccgtgccgattgtgttgccggtgtcgtcgcgcagaattaatgagctctgttggcctgccggaagcagagtcagagtggtggcggtgttgacgcggcaggtgagtccagagtgactcttgaggcaagattcggtccgagtggtcaccgagatggtctcggcgttgccgaagatgacgggagtggccaataggatgccgatcagtcgagtagctgctcgctgagctcgccgcccgtggtgccgtggctgccgtcggacccgttgaattccaacttcgagacgttccgcaacacgttctcgatcttcccgtgtccagggacgaccggcgagggagaatgctagtcggaggggccaggagagaaggaacgcggtgatttgatagccgaaattgagcacaactcgggcggatgagcagaaacagactacccacccgatcagacagctgatcagcgacccgataattaggaaaaggaagacagagaggcgggggttgcaccgccaattggcgagttggtcaatgcaaacggagcagtcaatcagctcgcattcgtcgatggctgagcagacggtttcggcggcgcaactacgggtcgatgagaggctgaacgttgcggaacagccgtaattgttgacgagaaggtcagcggacaactcatattcaatggtggcagcgcccaaccgatcaaggcacgaattggcgcaacaaatcgtgaccttctggacggcgggagtggaggagactcggacgcctcttctggtgcaattgacgtggtttccgatgcaatgggatgttgggggtggctcgggatggtctgaggcgaatggccaaattccttgtgctggggaggcttggacgcccaggaaagtgacgaggatggccatgatcattgtcgtggtgggggggattccgagaagccgcgattttcgtcgcgttaccatgccgtcgtgcccacgggtcatcggttcttcgggaagtgacgggacaggcgtcatgtcctgtccaacaagttcggcgtttttggagtctctgcgactttgattagtcgggttcggttcggtggcgtccgattcgggttccagggcctggttttcggtctccaaggggcaaagacggctgattggtcgtgtgacggtttgcccattcggcattcgcagctggacgctccgcacattcgggggggatccatttagggcgacgacgacccccatgggccataagttcctggtgcggaggtcctcttcgacgatgactacttggccga

SEQ ID NO: 29031 - DNA, 1067 bp, Heterodera glycines
taaatggtcattcttttctcaatttgtctacaacattcatacacattgggctatatatatataccagcagaacaaactcaagaaatgggccaaaatgtgaagcaaaaataggaaacggggggcagacacgaacgacgacgaaagagcgaccaaagaagccgctgccgctgatgatgctagtggtgaagaatcgattgtctttcaacatatatatccttcggggggaagggggatctgagtgtgtgctgcttggagaggatggggcaagaagagggcacagggaggatgaggggaattcggaagagagacaacaactgctgctggtggtgctgtccctcttcccccccccccctctttcagttgctgctgttgtaccccgtccacctcatttcccctccatctcaccatccccgtcaatttgcccctcttccgctcacaaaatgcacttgccgcttatatatgtattgaaaataaataggttttctttctttctctctctttctgtgtgtgtgggggcttgaggggatttgtgaatcgtgagatgaattagcctctgaggaagtaaattaatagcccaatagcgcccgatgacttaaaaaattttatattccactcatcatcataatacataattatcagcatccacccacccacaaaaggagaaaaagttggggggggggggaaggaataaataatgatgattagatgatgagatcatcagcagcgtgatcactgatcacaggacaatggggcgggcggacagatgggtgtgtaaaataaatgaatgaacgaacgaatttgaaagtgaaaccgggggttgaaatgaaaatggaaatgaaccaaagaatatgggggacactaaatttttgtaattaatgtgtgaagcgcagaaatgaaaaatgccattggcggcgcagcggcgcgagggttatgccgcgctcctcaagggcacagccagcagcagcagatgaagaaagaaaaggcaacccccaaccccaccacaccaccataaatgtgtgtgtgttgtggggggggggggggtaaataggtattttagttgtgattct

SEQ ID NO: 29032 - DNA, 1286 bp, Heterodera glycines
gactttttccattaattatttattatttgcaaaaaataattcataaatatttttagaacgtgctctgaaacgcaccaaatgttaattaaaagttaaataaggctctctgatgctttcactatcaaaaagggagatgaataaaaaatctaaaaatttttaattgctttttaaatttgcgaaagattttaggcttaactttttttttataaactgatcagaagcggaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctccccataaatgtttgagtaccccaacggacactgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggcg

SEQ ID NO: 29033 - DNA, 1225 bp, Heterodera glycines
gtcatattcaagcgggattttagtaaccatgcacattgtttcaaattcggaatagcctatatcgattgggatgtttaccaatccgtaaacaggaattttttatcccttataggtggcaaactgatatggcagtcctctcaaatcacccccctttctttgtctctctctctatctctttgtctctctctttcttcctctccatctctttgtgtctctgtctgtttctttctctatctctctctctctctttgtctatctatttctttgtctctctctctttctccctccatctctttctctctctctttgtctctcactctctccctctgtctctcactcttctttgtctccctctctttctctcccctctctcattatttctctctctctctctcactctctctttttgttcataatttttttatgcgtatatgtataggagagatttttgtattctgttcaaaaatattgtaaataatatgaaaatttctgtgaatacgtttttaatgcgtatacgaatagagatttttgtattctgttcaaaaatattggaaataatatgaaaatttctgtgaatacgtttttaatgcgtatacgaatagagatttttgtattctgttcaaaaatattggaaataatatgaaaatttctgtgaatacgtttttaatgcgtatacgaatagagatttttgtattctgtgcaaaaatattgtaaataatatgaaaatttctgtgaatacgtttttaatgcgtatacgaatagagatttttgtattctgttcaaaaatattggaaataatataaaatttctgtgaatacgtttttaatgcgtatacgaatagagatttttgtattctgttcaaaaatattgtaaataatatgaaaatttctgtgaatacgtttttaatgcgtatacgaatagagatttttgtattctgttcaaaaatattgtaaataatatgaaaatttctgtgaatacgtttttaatgcgtatacgaatagagctttttgtattctgttcaaaaatattggaaataatataaaatttctgtgaatatgtttttaatgcttatatggagtttgttttttgtgcagaataagcatataaattgactggattgcggctttcaaaatcacaatttccaaaaactaaaactaaaaaatgaaacaaattaatgctcaataagcgctgccattttttgaatctaaaatataaaatagagaaa

SEQ ID NO: 29034 - DNA, 994 bp, Heterodera glycines
aaacccccggaaactgattttgatcccaaattaaacatcttattttaagatagaaacccccattcttcaggattgccagtctttgaaaccatttccgattagcaaataataatttcgctattataaaaaataacattttgccggccatgtagcgctgcactttgacctttttcatcacaattctgcctttctcatcttttactggaattgcgcctgccgtgggcaatggtcgcgggcccaaaggtttgttgtccaaattacgctcaaattttggcacgaagtcacccattatttctgaaaaataggtatgtgtatgtacaaaataggaaattttttataaaaaatgtcaatttaacggactgttaatggaatcaagtgcaagcatttaaaagagattcagacattggcgatttgtttcaaataaaaaacactaaaaaaagaaaagttatttcatttcctctgggaagcctgccaaaaagtacaatccttttgtttctatcaaaattttaagcattgtgtcgacaaactaatcttattacattgcgctcgaatatgacaattcactctcgtaaagtggtggcctactattatgatggtccattttttaaccaaatcggtctcataaattccgttacaggtgatgtcggcaattactactacggccaaggccatccgatgaaaccccaccgaattcggatgactcacaaccttctgttgaactacggactctatcgcaaaatggaagttttcgtaagtatttattgctttttcgtttaaaattgcctttgcagagaccaaaggctgcgtcactagaagaaatgactaaatatcacagcgatgactatatgtgttttctgaaggttagtcaggttaaacacagtaacaatttaaaacgcttcagagcataaaacccgacaatatcgccgattttggtcgtcaaatgcaacgcttcaacgtgagcgaggactgtcccgtgtttgacggtctatttgag
